US009976157B2

(12) United States Patent
Poraty-Gavra et al.

(10) Patent No.: US 9,976,157 B2
(45) Date of Patent: May 22, 2018

(54) ISOLATED POLYNUCLEOTIDES AND POLYPEPTIDES, AND METHODS OF USING SAME FOR INCREASING PLANT YIELD AND/OR AGRICULTURAL CHARACTERISTICS

(75) Inventors: Limor Poraty-Gavra, Holon (IL); Eyal Emmanuel, Rechovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 964 days.

(21) Appl. No.: 14/239,787

(22) PCT Filed: Aug. 23, 2012

(86) PCT No.: PCT/IL2012/050327
§ 371 (c)(1),
(2), (4) Date: Jun. 9, 2014

(87) PCT Pub. No.: WO2013/027223
PCT Pub. Date: Feb. 28, 2013

(65) Prior Publication Data
US 2014/0289900 A1 Sep. 25, 2014

Related U.S. Application Data

(60) Provisional application No. 61/526,299, filed on Aug. 23, 2011, provisional application No. 61/585,688, filed on Jan. 12, 2012.

(51) Int. Cl.
| C12N 15/82 | (2006.01) |
| C12Q 1/68 | (2018.01) |

(52) U.S. Cl.
CPC ..... *C12N 15/8271* (2013.01); *C12N 15/8247* (2013.01); *C12N 15/8261* (2013.01); *C12Q 1/6895* (2013.01); *C12Q 2600/158* (2013.01)

(58) Field of Classification Search
None
See application file for complete search history.

(56) References Cited

U.S. PATENT DOCUMENTS

| 6,084,153 | A | 7/2000 | Good et al. | |
| 7,214,786 | B2 | 5/2007 | Kovalic et al. | |
| 8,362,325 | B2 * | 1/2013 | Troukhan | C07K 14/415 435/183 |
| 2002/0046419 | A1 | 4/2002 | Choo et al. | |
| 2004/0123343 | A1 | 6/2004 | La Rosa et al. | |
| 2005/0108791 | A1 | 5/2005 | Edgerton | |
| 2006/0123505 | A1 | 6/2006 | Kikuchi et al. | |
| 2006/0179511 | A1 | 8/2006 | Chomet et al. | |
| 2009/0094717 | A1 * | 4/2009 | Troukhan | C07K 14/415 800/290 |
| 2011/0080674 | A1 | 4/2011 | Durand | |
| 2011/0214206 | A1 | 9/2011 | La Rosa et al. | |

FOREIGN PATENT DOCUMENTS

| JP | 2005185101 A * | 7/2005 | ........... C07K 14/415 |
| WO | WO 2004/081173 | 9/2004 | |
| WO | WO 2004/104162 | 12/2004 | |
| WO | WO 2004/111183 | 12/2004 | |
| WO | WO 2005/121364 | 12/2005 | |
| WO | WO 2007/020638 | 2/2007 | |
| WO | WO 2007/049275 | 5/2007 | |
| WO | WO 2008/034648 | 3/2008 | |
| WO | WO 2008/075364 | 6/2008 | |
| WO | WO 2008/122980 | 10/2008 | |
| WO | WO 2009/013750 | 1/2009 | |
| WO | WO 2009/083958 | 7/2009 | |
| WO | WO 2009/141824 | 11/2009 | |
| WO | WO 2010/020941 | 2/2010 | |
| WO | WO 2010/049897 | 5/2010 | |
| WO | WO 2010/076756 | 7/2010 | |
| WO | WO 2010/100595 | 9/2010 | |
| WO | WO 2010/143138 | 12/2010 | |
| WO | WO 2011/015985 | 2/2011 | |
| WO | WO 2011/080674 | 7/2011 | |
| WO | WO 2011/135527 | 11/2011 | |
| WO | WO 2012/028993 | 3/2012 | |
| WO | WO 2012/085862 | 6/2012 | |

(Continued)

OTHER PUBLICATIONS

The International Brachypodium Initiative (Genome sequencing and analysis of the model grass Brachypodium distachyon. Nature. 463: 763-768, Feb. 2010).*
Burk et al (A Katanin-like Protein Regulates Normal Cell Wall Biosynthesis and Cell Elongation. The Plant Cell, vol. 13, 807-827, Apr. 2001).*
Stoppin-Mellet et al (Katanin's severing activity favors bundling of cortical microtubules in plants. The Plant Journal 46, 1009-1017, 2006).*
International Preliminary Report on Patentability dated Mar. 6, 2014 From the International Bureau of WIPO Re. Application No. PCT/IL2012/050327.
Examination Report dated Jun. 12, 2016 From the Instituto Mexicano de la Propiedad Industrial, IMPI Re. Application No. MX/a/2014/002049 and Its Translation Into English.
Examination Report dated Jan. 12, 2017 From the Australian Government, IP Australia Re. Application No. 2012298157. (3 Pages).
Examination Report dated Nov. 22, 2016 From the Instituto Mexicano de la Propiedad Industrial, IMPI Re. Application No. MX/a/2014/002049 and Its Translation Into English. (13 Pages).

(Continued)

*Primary Examiner* — Medina A Ibrahim
*Assistant Examiner* — Wayne Zhong

(57) ABSTRACT

Provided are isolated polynucleotides at least 80% identical to SEQ ID NOs: 1-479, 813-5173, 8511, 8513, 8515, 8517, 8519, 8521, 8523, 9096-9141 and 9142; and isolated polypeptides at least 80% homologous to an amino acid sequence selected from the group consisting of SEQ ID NOs: 624, 480-623, 625-812, 5174-7015, 7017-7021, 7024, 7026-8510, 8512, 8514, 8516, 8518, 8520, 8522, 8524, 9143-9177, such as the polypeptides set forth in SEQ ID NO:480-812, 5174-8510, 8512, 8514, 8516, 8518, 8520, 8522, 8524, and 9143-9177, nucleic acid constructs comprising same, transgenic cells and plants expressing same and methods of using same for increasing yield, biomass, growth rate, vigor, oil content, fiber yield, fiber quality, nitrogen use efficiency, and/or abiotic stress tolerance of a plant.

22 Claims, 8 Drawing Sheets

(56) References Cited

FOREIGN PATENT DOCUMENTS

| WO | WO 2012/150598 | 11/2012 |
|---|---|---|
| WO | WO 2013/027223 | 2/2013 |
| WO | WO 2013/078153 | 5/2013 |
| WO | WO 2013/128448 | 9/2013 |
| WO | WO 2013/179211 | 12/2013 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
International Search Report and the Written Opinion dated Apr. 10, 2013 From the International Searching Authority Re. Application No. PCT/IL2012/050327.
Invitation to Pay Additional Fees dated Dec. 31, 2012 From the International Searching Authority Re. Application No. PCT/IL2012/050327.
Soderlund et al. "Sequencing, Mapping, and Analysis of 27,455 Maize Full-Length cDNAs", PLoS Genetics, 5(11): e1000740-1-e1000740-13, Nov. 2009.
Examination Report dated Aug. 15, 2017 From the Australian Government, IP Australia Re. Application No. 2012298157. (9 Pages).
Kawaura et al. "Triticum Aestivum cDNA Clone: SET2_C15, Cultivar: Chinese Spring", Database NCBI [Online], GenBank: AK333791.1, Database Accession No. AK333791, Jun. 25, 2009.
Sasaki et al. "Katanin [*Oryza sativa* Japonica Group]", Database NCBI [Online], GenBank: BAD87507.1, Database Accession No. BAD87507, Feb. 16, 2008.
Sasaki et al. "Vacuolar Protein Sorting Factor 4B-Like [*Olyza sativa* Japonica Group]", Database NCBI [Online], GenBank: BAD73312.1, Database Accession No. BAD73312, Feb. 16, 2008.
Sasaki et al. "Vacuolar Protein Sorting Factor 4B-Like [*Olyza saliva* Japonica Group]", Database NCBI [Online], GenBank: BAD73365.1, Database Accession No. BAD73365, Feb. 16, 2008.
Soderlund et al. "Unknown [*Zea mays*]", Database NCBI [Online], GenBank: ACF85066.1, Database Accession No. ACF85066, Jul. 30, 2008.
Soderlund et al. "Unknown [*Zea mays*]", Database NCBI [Online], GenBank: ACN28820.1, Database Accession No. ACN28820, Feb. 21, 2009.
Examination Report dated Aug. 7, 2017 From the Instituto Mexicano de la Propiedad Industrial, IMPI, Direccion Divisional de Patentes, Subdireccion Divisional de Fondo de Patentes Areas Biotecnologia, Farmaceutica y Quimica Re. Application No. MX/a/2014/002049 and Its Translation Into English. (8 Pages).

* cited by examiner pQFN, pQFNc

Normal conditions

Osmotic stress (15 % PEG)

Nitrogen limiting conditions pQNa_RP

ISOLATED POLYNUCLEOTIDES AND POLYPEPTIDES, AND METHODS OF USING SAME FOR INCREASING PLANT YIELD AND/OR AGRICULTURAL CHARACTERISTICS

RELATED APPLICATIONS

This application is a National Phase of PCT Patent Application No. PCT/IL2012/050327 having International filing date of Aug. 23, 2012, which claims the benefit of priority under 35 USC § 119(e) of U.S. Provisional Patent Application Nos. 61/526,299 filed on Aug. 23, 2011 and 61/585,688 filed on Jan. 12, 2012. The contents of the above applications are all incorporated by reference as if fully set forth herein in their entirety.

SEQUENCE LISTING STATEMENT

The ASCII file, entitled 58501SequenceListing.txt, created on Feb. 13, 2014 comprising 20,892,831 bytes, submitted concurrently with the filing of this application is incorporated herein by reference.

FIELD AND BACKGROUND OF THE INVENTION

The present invention, in some embodiments thereof, relates to isolated polynucleotides and polypeptides which can increase the yield (e.g., biomass, grain quantity and/or quality, seed yield, oil yield), growth rate, vigor, abiotic stress tolerance (ABST), water use efficiency (WUE), nitrogen use efficiency (NUE) and/or fertilizer use efficiency (FUE) of a plant.

The ever-increasing world population and the decreasing availability in arable land for agriculture affect the yield of plants and plant-related products. The global shortage of water supply, desertification, abiotic stress (ABS) conditions (e.g., salinity, drought, flood, suboptimal temperature and toxic chemical pollution), and/or limited nitrogen and fertilizer sources cause substantial damage to agricultural plants such as major alterations in the plant metabolism, cell death, and decreases in plant growth and crop productivity.

Drought is a gradual phenomenon, which involves periods of abnormally dry weather that persists long enough to produce serious hydrologic imbalances such as crop damage, water supply shortage and increased susceptibility to various diseases.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Thus, salination of soils that are used for agricultural production is a significant and increasing problem in regions that rely heavily on agriculture, and is worsen by over-utilization, over-fertilization and water shortage, typically caused by climatic change and the demands of increasing population.

Suboptimal temperatures affect plant growth and development through the whole plant life cycle. Thus, low temperatures reduce germination rate and high temperatures result in leaf necrosis. In addition, mature plants that are exposed to excess heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Suboptimal nutrient (macro and micro nutrient) affect plant growth and development through the whole plant life cycle. A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen usually needs to be replenished every year, particularly for cereals, which comprise more than half of the cultivated areas worldwide. For example, inorganic nitrogenous fertilizers such as ammonium nitrate, potassium nitrate, or urea, typically accounts for about 40% of the costs associated with crops such as corn and wheat.

Nitrogen is an essential macronutrient for the plant, responsible for biosynthesis of amino acids and nucleic acids, prosthetic groups, plant hormones, plant chemical defenses, and the like. In addition, nitrogen is often the rate-limiting element in plant growth and all field crops have a fundamental dependence on inorganic nitrogen. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation. Phosphorous and Potassium have a direct correlation to yield and general plant tolerance.

Since fertilizer is rapidly depleted from most soil types, it must be supplied to growing crops two or three times during the growing season, particularly for cereals, which comprise more than half of the cultivated areas worldwide. For example, inorganic nitrogenous fertilizers such as ammonium nitrate, potassium nitrate, or urea, typically accounts for 40% of the costs associated with crops such as corn and wheat. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering. Attempts to generate plants with increased FUE have been described in U.S. Pat. Appl. No. 20020046419 to Choo, et al.; U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, oils and metabolites used in industrial processes. The ability to increase plant yield, whether through increase dry matter accumulation rate, modifying cellulose or lignin composition, increase stalk strength, enlarge meristem size, change of plant branching pattern, erectness of levees, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

SUMMARY OF THE INVENTION

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide at least 80% identical to SEQ ID NO: 480-812, 5174-7015, 7017-7021, 7024, 7026-8510, 8512, 8514, 8516, 8518, 8520, 8522, 8524, 9143-9176 or 9177, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs:480-812, 5174-8510, 8512, 8514, 8516, 8518, 8520, 8522, 8524, and 9143-9177, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least 80% identical to SEQ ID NO: 1-479, 813-5173, 8511, 8513, 8515, 8517, 8519, 8521, 8523, 9096-9141 or 9142, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising the nucleic acid sequence selected from the group consisting of SEQ ID NOs: 1-479, 813-5173, 8511, 8513, 8515, 8517, 8519, 8521, 8523, and 9096-9142, thereby increasing the yield, biomass, growth rate, vigor, oil content, fiber yield, fiber quality, abiotic stress tolerance, and/or nitrogen use efficiency of the plant.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 480-812, 5174-7015, 7017-7021, 7024, 7026-8510, 8512, 8514, 8516, 8518, 8520, 8522, 8524, 9143-9176 or 9177, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 480-812, 5174-8510, 8512, 8514, 8516, 8518, 8520, 8522, 8524, and 9143-9177.

According to an aspect of some embodiments of the present invention there is provided an isolated polynucleotide comprising a nucleic acid sequence at least 80% identical to SEQ ID NO:1-479, 813-5173, 8511, 8513, 8515, 8517, 8519, 8521, 8523, 9096-9141 or 9142, wherein the nucleic acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polynucleotide comprising the nucleic acid sequence selected from the group consisting of SEQ ID NOs: 1-479, 813-5173, 8511, 8513, 8515, 8517, 8519, 8521, 8523, and 9096-9142.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 480-812, 5174-7015, 7017-7021, 7024, 7026-8510, 8512, 8514, 8516, 8518, 8520, 8522, 8524, 9143-9176 or 9177, wherein the amino acid sequence is capable of increasing yield, biomass, growth rate, vigor, oil content, fiber yield, fiber quality, abiotic stress tolerance, and/or nitrogen use efficiency of a plant.

According to an aspect of some embodiments of the present invention there is provided an isolated polypeptide comprising the amino acid sequence selected from the group consisting of SEQ ID NOs: 480-812, 5174-8510, 8512, 8514, 8516, 8518, 8520, 8522, 8524, and 9143-9177.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention.

According to some embodiments of the invention, the nucleic acid sequence encodes an amino acid sequence selected from the group consisting of SEQ ID NOs: 480-812, 5174-8510, 8512, 8514, 8516, 8518, 8520, 8522, 8524, and 9143-9177.

According to some embodiments of the invention, the nucleic acid sequence is selected from the group consisting of SEQ ID NOs: 1-479, 813-5173, 8511, 8513, 8515, 8517, 8519, 8521, 8523, and 9096-9142.

According to some embodiments of the invention, the polynucleotide consists of the nucleic acid sequence selected from the group consisting of SEQ ID NOs: 1-479, 813-5173, 8511, 8513, 8515, 8517, 8519, 8521, 8523, and 9096-9142.

According to some embodiments of the invention, the nucleic acid sequence encodes the amino acid sequence selected from the group consisting of SEQ ID NOs: 480-812, 5174-8510, 8512, 8514, 8516, 8518, 8520, 8522, 8524, and 9143-9177.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide.

According to some embodiments of the invention, the promoter is heterologous to the host cell.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
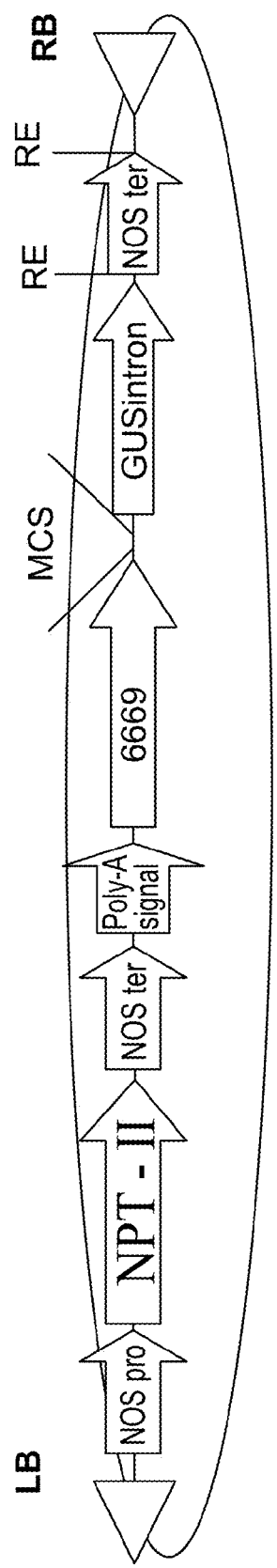
FIG. 1 is a schematic illustration of the modified pGI binary plasmid containing the new At6669 promoter (SEQ ID NO: 8529) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.

The present invention, in some embodiments thereof, relates to isolated polynucleotides and polypeptides, nucleic acid constructs, transgenic cells and transgenic plants comprising same and methods of generating and using same, and, more particularly, but not exclusively, to methods of increasing yield, biomass, growth rate, vigor, oil content, fiber yield, fiber quality abiotic stress tolerance, and/or fertilizer use efficiency (e.g., nitrogen use efficiency) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to increase yield, growth rate, biomass, oil content, vigor, abiotic stress tolerance and/or fertilizer (e.g., nitrogen) use efficiency of a plant.

Thus, as shown in the Examples section which follows, the present inventors have utilized bioinformatics tools to identify polynucleotides which enhance yield (e.g., seed yield, oil yield, oil content), growth rate, biomass, vigor, fiber yield and/or quality, abiotic stress tolerance and/or fertilizer (e.g., nitrogen) use efficiency of a plant. Genes which affect the trait-of-interest were identified based on expression profiles and gene copy number of genes of several Barley, *Arabidopsis, Sorghum, Maize, Brachypodium*, Foxtail Millet, and Soybean ecotypes, accessions and varieties in various tissues, developmental stages, ABST and fertilizer-limiting conditions; as well as homology with genes known to affect the trait-of-interest and using digital expression profile in specific tissues and conditions (Tables 1, 3-50, Examples 1 and 3-11 of the Examples section which follows). Homologous polypeptides and polynucleotides having the same function were also identified (Table 2, Example 2 of the Examples section which follows). The novel polynucleotides were cloned into nucleic acid constructs (e.g., binary vectors, Table 51, Example 12 of the Examples section which follows), transformed into *agrobacterium tumefaciens* cells, and transgenic *Arabidopsis* plants transformed with the isolated polynucleotides were generated (Example 13 of the Examples section which follows) for evaluation of the effect of the transgene on plant performance. Transgenic plants over-expressing the identified polynucleotides were found to exhibit increased seed yield, oil content, biomass, and growth rate (Tables 52-64; Examples 14-16 of the Examples section which follows), and increased tolerance to abiotic stress conditions. Altogether, these results suggest the use of the novel polynucleotides and polypeptides of the invention for increasing yield (including oil yield, seed yield and oil content, fiber yield and/or quality), growth rate, biomass, vigor, abiotic stress tolerance and/or fertilizer (e.g., nitrogen) use efficiency of a plant.

Thus, according to an aspect of some embodiments of the invention, there is provided method of increasing yield, growth rate, biomass, vigor, oil content, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 480-812, 5174-7015, 7017-7021, 7024, 7026-8510, 8512, 8514, 8516, 8518, 8520, 8522, 8524, 9143-9177, thereby increasing the yield, growth rate, biomass, vigor, oil content, fiber yield, fiber quality, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (Zea mays L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, Spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, seed yield, biomass, growth rate, vigor, oil content, fiber yield, fiber quality, abiotic stress tolerance, and/or nitrogen use efficiency of a plant as compared to a native plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 480-812, 5174-7015, 7017-7021, 7024, 7026-8510, 8512, 8514, 8516, 8518, 8520, 8522, 8524, 9143-9177.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web(dot)ncbi(dot)nlm(dot)nih(dot)gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web(dot)ebi(dot)ac(dot)uk/Tools/clustalw2/index dot)html], followed by a neighbor-joining tree (Hypertext Transfer Protocol://en(dot)wikipedia(dot)org/wiki/Neighbor-joining) which helps visualizing the clustering.

Homology (e.g., percent homology, identity+similarity) can be determined using any homology comparison software computing a pairwise sequence alignment.

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from http://emboss(dot)sourceforge(dot)net/apps/cvs/emboss/apps/needle(dot)html can be used) to find the optimum alignment (including gaps) of two sequences along their entire length—a "Global alignment". Default parameters for Needleman-Wunsch algorithm (EMBOSS-6.0.1) include: gap—open=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm (Halperin, E., Faigler, S, and Gill-More, R. (1999)—FramePlus: aligning DNA to protein sequences. Bioinformatics, 15, 867-873) (available from http://www(dot)biocceleration(dot)com/Products(dot)html) can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from http://emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it use as only a filter for the global alignment stage. The default filtering of the Blast package was not utilized (by setting the parameter "-F F").

In the second stage, homologs were defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter): EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

| | | |
|---|---|---|
| [-asequence] | sequence | Sequence filename and optional format, or reference (input USA) |
| [-bsequence] | seqall | Sequence(s) filename and optional format, or reference (input USA) |
| -gapopen | float | [10.0 for any sequence] The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0) |
| -gapextend | float | [0.5 for any sequence] The gap extension. penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0) |
| [-outfile] | align | [*.needle] Output alignment file name |

Additional (Optional) Qualifiers:

| | | |
|---|---|---|
| -datafile | matrixf | [EBLOSUM62 for protein, EDNAFULL for DNA] This is the scoring matrix file used when comparing sequences. By default it is the file 'EBLOSUM62' (for proteins) or the file 'EDNAFULL' (for nucleic sequences). These files are found in the 'data' directory of the EMBOSS installation. |

Advanced (Unprompted) Qualifiers:

| | | |
|---|---|---|
| -[no]brief | boolean | [Y] Brief identity and similarity |

Associated Qualifiers:

| "-asequence" associated qualifiers | | |
|---|---|---|
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |
| -sformat1 | string | Input sequence format |
| -sdbname1 | string | Database name |
| -sid1 | string | Entryname |
| -ufo1 | string | UFO features |
| -fformat1 | string | Features format |
| -fopenfile1 | string | Features file name |

| "-bsequence" associated qualifiers | | |
|---|---|---|
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |

| "-outfile" associated qualifiers | | |
|---|---|---|
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |

General Qualifiers:

| | | |
|---|---|---|
| -auto | boolean | Turn off prompts |
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean | Report command line options. More information on associated and general qualifiers can be found with -help -verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the tblastn Filter):

GenCore 6.0 OneModel application utilizing the Frame+algorithm with the following parameters: model=frame+_p2n.model mode=qglobal -q=protein.sequence -db=nucleotide.sequence. The rest of the parameters are unchanged from the default options:

Usage:

```
om -model=<model_fname> [-q=]query [-db=]database [options]
-model=<model_fname> Specifies the model that you want to run. All
    models supplied by Compugen are located in the
    directory $CGNROOT/models/.
```

Valid Command Line Parameters:

---

-dev=<dev_name> Selects the device to be used by the application.
    Valid devices are:
        bic - Bioccelerator (valid for SW, XSW, FRAME_N2P,
            and FRAME_P2N models).
        xlg - BioXL/G (valid for all models except XSW).
        xlp - BioXL/P (valid for SW, FRAME+_N2P, and
            FRAME_P2N models),
        xlh - BioXL/H (valid for SW, FRAME+_N2P, and
            FRAME_P2N models),
        soft - Software device (for all models).

---

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify a query using accession numbers.

-dacc Add this parameter to the command line if you specify a database using accession numbers.

-dfmt/-qfmt=<format_type> Chooses the database/query format type. Possible formats are:

--- fasta - fasta with seq type auto-detected.
        fastap - fasta protein seq.
        fastan - fasta nucleic seq.
        gcg - gcg format, type is auto-detected.
        gcg9seq - gcg9 format, type is auto-detected.
        gcg9seqp - gcg9 format protein seq.
        gcg9seqn - gcg9 format nucleic seq.
        nbrf - nbrf seq, type is auto-detected.
        nbrfp - nbrf protein seq.
        nbrfn - nbrf nucleic seq.
        embl - embl and swissprot format.
        genbank - genbank format (nucleic).
        blast - blast format.
        nbrf_gcg - nbrf-gcg seq, type is auto-detected.
        nbrf_gcgp - nbrf-gcg protein seq.
        nbrf_gcgn - nbrf-gcg nucleic seq.
        raw - raw ascii sequence, type is auto-detected.
        rawp - raw ascii protein sequence.
        rawn - raw ascii nucleic sequence.
        pir - pir codata format, type is auto-detected.
        profile - gcg profile (valid only for -qfmt
        in SW, XSW, FRAME_P2N, and FRAME+_P2N).

---

-out=<out_fname> The name of the output file.

-suffix=<name> The output file name suffix.

-gapop=<n> Gap open penalty. This parameter is not valid for FRAME+. For FrameSearch the default is 12.0. For other searches the default is 10.0.

-gapext=<n> Gap extend penalty. This parameter is not valid for FRAME+. For FrameSearch the default is 4.0. For other models: the default for protein searches is 0.05, and the default for nucleic searches is 1.0.

-qgapop=<n> The penalty for opening a gap in the query sequence. The default is 10.0. Valid for XSW.

-qgapext=<n> The penalty for extending a gap in the query sequence. The default is 0.05. Valid for XSW.

-start=<n> The position in the query sequence to begin the search.

-end=<n> The position in the query sequence to stop the search.

-qtrans Performs a translated search, relevant for a nucleic query against a protein database. The nucleic query is translated to six reading frames and a result is given for each frame. Valid for SW and XSW.

-dtrans Performs a translated search, relevant for a protein query against a DNA database. Each database entry is translated to six reading frames and a result is given for each frame. Valid for SW and XSW.

Note: "-qtrans" and "-dtrans" options are mutually exclusive.

-matrix=<matrix_file> Specifies the comparison matrix to be used in the search. The matrix must be in the BLAST format. If the matrix file is not located in $CGNROOT/tables/matrix, specify the full path as the value of the -matrix parameter.

-trans=<transtab_name> Translation table. The default location for the table is $CGNROOT/tables/trans.

-onestrand Restricts the search to just the top strand of the query/database nucleic sequence.

-list=<n> The maximum size of the output hit list. The default is 50.

-docalign=<n> The number of documentation lines preceding each alignment. The default is 10.

-thr_score=<score_name> The score that places limits on the display of results. Scores that are smaller than -thr_min value or larger than -thr_max value are not shown. Valid options are:
    quality.
    zscore.
    escore.

-thr_max=<n> The score upper threshold. Results that are larger than -thr_max value are not shown.

-thr_min=<n> The score lower threshold. Results that are lower than -thr_min value are not shown.

-align=<n> The number of alignments reported in the output file.

-noalign Do not display alignment.

Note: "-align" and "-noalign" parameters are mutually exclusive.

-outfmt=<format_name> Specifies the output format type. The default format is PFS. Possible values are:
    PFS—PFS text format
    FASTA—FASTA text format
    BLAST—BLAST text format -nonorm Do not perform score normalization.

-norm=<norm_name> Specifies the normalization method. Valid options are:
    log—logarithm normalization.
    std—standard normalization.
    stat—Pearson statistical method.

Note: "-nonorm" and "-norm" parameters cannot be used together.

Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet). The default is 12.0.

-xgapext=<n> The penalty for extending a gap when inserting a codon (triplet). The default is 4.0.

-ygapop=<n> The penalty for opening a gap when deleting an amino acid. The default is 12.0.

-ygapext=<n> The penalty for extending a gap when deleting an amino acid. The default is 4.0.

-fgapop=<n> The penalty for opening a gap when inserting a DNA base. The default is 6.0.

-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note:"-batch" and "-wait" parameters are mutually exclusive.
-version Prints the software version number.
-help Displays this help message. To get more specific help type: "om -model=<model_fname> -help".

According to some embodiments the homology is local homology or local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 480-812, 5174-7015, 7017-7021, 7024, 7026-8510, 8512, 8514, 8516, 8518, 8520, 8522, 8524, 9143-9177.

According to some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 480-812, 5174-7015, 7017-7021, 7024, 7026-8510, 8512, 8514, 8516, 8518, 8520, 8522, 8524, 9143-9177, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO: 480-812, 5174-8510, 8512, 8514, 8516, 8518, 8520, 8522, 8524, 9143-9176 or 9177.

According to an aspect of some embodiments of the invention, the method of increasing yield, biomass, growth rate, vigor, oil content, fiber yield, fiber quality, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs: 480-812, 5174-8510, 8512, 8514, 8516, 8518, 8520, 8522, 8524, and 9143-9177, thereby increasing the yield, biomass, growth rate, vigor, oil content, fiber yield, fiber quality, abiotic stress tolerance, and/or nitrogen use efficiency of the plant.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 480-812, 5174-8510, 8512, 8514, 8516, 8518, 8520, 8522, 8524, and 9143-9177, thereby increasing the yield, biomass, growth rate, vigor, oil content, fiber yield, fiber quality, abiotic stress tolerance, and/or nitrogen use efficiency of the plant.

According to some embodiments of the invention, the exogenous polynucleotide encodes a polypeptide consisting of the amino acid sequence set forth by SEQ ID NO: 480-812, 5174-8510, 8512, 8514, 8516, 8518, 8520, 8522, 8524, 9143-9176 or 9177.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs:1-479, 813-5173, 8511, 8513, 8515, 8517, 8519, 8521, 8523, and 9096-9142.

According to an aspect of some embodiments of the invention, there is provided a method of increasing yield, biomass, growth rate, vigor, oil content, fiber yield, fiber quality, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-479, 813-5173, 8511, 8513, 8515, 8517, 8519, 8521, 8523, and 9096-9142, thereby increasing the yield, biomass, growth rate, vigor, oil content, fiber yield, fiber quality, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-479, 813-5173, 8511, 8513, 8515, 8517, 8519, 8521, 8523, and 9096-9142.

According to some embodiments of the invention the exogenous polynucleotide is set forth by SEQ ID NO: 1-479, 813-5173, 8511, 8513, 8515, 8517, 8519, 8521, 8523, 9096-9141 or 9142.

According to some embodiments of the invention the exogenous polynucleotide is set forth by the nucleic acid sequence selected from the group consisting of SEQ ID NOs: 1-479, 813-5173, 8511, 8513, 8515, 8517, 8519, 8521, 8523, and 9096-9142.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web(dot)kazusa(dot)or(dot)jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 217, 218, 276, 277, 479, 928, 929, 930, 1045, 1876, 2326, 2374, 2375, 2451, 3045, 3046, 3053, 3200, 3208, 3212, 3217, 3223, 3227, 3298, 3394, 3427, 3428, 3463, 3464, 3572, 3573, 3574, 3575, 3581, 4017, 4064, 4065, 4066, 4068, 4071, 4073, 4075, 4076, 4078, 4409, 4413, 4415, 4420, 4422, 4425, 4426, 4428, 4429, 4430, 4439, 4442, 4443, 4461, 4465, 4466, 4470, 4475, 4480, 4481, 4482, 4493, 4496, 4557, 4564, 4568, 4644, 4692, 4693, 4694, 4698, 4699, 4700, 4701, 4702, 4703, 4704, 4705, 4707, 4716, 4722, 4726, 4730, 4736, 4744, 4746, 4747, 4753, 4760, 9100, 9104, 9109, 9112, 9116, 9118, 9124, 9129, 9130, 9133, 9134, and 9135.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-479, 813-5173, 8511, 8513, 8515, 8517, 8519, 8521, 8523, and 9096-9142.

According to some embodiments of the invention the nucleic acid sequence is capable of increasing yield, growth rate, vigor, biomass, oil content, fiber yield, fiber quality, nitrogen use efficiency, fertilizer use efficiency, abiotic stress tolerance and/or water use efficiency of a plant.

According to some embodiments of the invention the isolated polynucleotide comprising the nucleic acid sequence selected from the group consisting of SEQ ID NOs: 1-479, 813-5173, 8511, 8513, 8515, 8517, 8519, 8521, 8523, and 9096-9142.

According to some embodiments of the invention the isolated polynucleotide is set forth by SEQ ID NO: 1-479, 813-5173, 8511, 8513, 8515, 8517, 8519, 8521, 8523, 9096-9141 or 9142.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 480-812, 5174-7015, 7017-7021, 7024, 7026-8510, 8512, 8514, 8516, 8518, 8520, 8522, 8524, 9143-9177.

According to some embodiments of the invention the amino acid sequence is capable of increasing yield, growth rate, vigor, biomass, oil content, fiber yield and/or quality, nitrogen use efficiency, fertilizer use efficiency, abiotic stress tolerance and/or water use efficiency of a plant.

The invention provides an isolated polynucleotide comprising a nucleic acid sequence encoding a polypeptide which comprises the amino acid sequence selected from the group consisting of SEQ ID NOs: 480-812, 5174-8510, 8512, 8514, 8516, 8518, 8520, 8522, 8524, and 9143-9177.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 480-812, 5174-7015, 7017-7021, 7024, 7026-8510, 8512, 8514, 8516, 8518, 8520, 8522, 8524, 9143-9177.

According to some embodiments of the invention, the polypeptide comprising an amino acid sequence selected from the group consisting of SEQ ID NOs: 480-812, 5174-8510, 8512, 8514, 8516, 8518, 8520, 8522, 8524, and 9143-9177.

According to some embodiments of the invention, the polypeptide is set forth by SEQ ID NO: 480-812, 5174-8510, 8512, 8514, 8516, 8518, 8520, 8522, 8524, 9143-9176 or 9177.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cyclonia oblonga*, *Cryptomeria japonica*, *Cymbopogon* spp., *Cynthea dealbata*, *Cyclonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussel sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable constitutive promoters include, for example, CaMV 35S promoter [SEQ ID NO: 8525 (pQFNC); SEQ ID NO: 8526 (PJJ 35S from *Brachypodium*); SEQ ID NO:8527 (Odell et al., Nature 313:810-812, 1985)], *Arabidopsis* At6669 promoter (SEQ ID NO:8528; see PCT Publication No. WO04081173A2 or the new At6669 promoter (SEQ ID NO:8529); maize Ubi 1 (maize polyubiquitin-1, SEQ ID NO:8530; Christensen et al., Plant Sol. Biol. 18:675-689, 1992; Taylor et al., Plant Cell Rep 12:491-495, 1993); rice actin 1 (SEQ ID NO:8531, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (SEQ ID NO:8532, de Pater et al, Plant November; 2(6):837-44, 1992); Ubi 1 promoter (SEQ ID NO:8533); RBCS promoter (SEQ ID NO:8534); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608, 144; 5,604,121; 5,569,597: 5,466,785; 5,399,680; 5,268, 463; and 5,608,142.

Suitable tissue-specific promoters include, but not limited to, leaf-specific promoters [e.g., AT5G06690 (Thioredoxin) (high expression, SEQ ID NO:8535), AT5G61520 (AtSTP3) (low expression, SEQ ID NO:8536) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:8537 from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (U.S. Pat. No. 7,700, 835), early seed development *Arabidopsis* BAN (SEQ ID NO:8538, US 2009/0031450 A1), late seed development *Arabidopsis* ABI3 (SEQ ID NO:8539) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], endosperm specific promoters [e.g., wheat LMW and HMW, glutenin-1 (Thomas and Flavell, The Plant Cell 2:1171-1180, 1990; Mol Gen Genet. 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Barley SS2 (Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma of al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet. 217:240-245; 1989), *Arabidopsis* apetala-3 (Tilly et al., Development. 125:1647-57, 1998), *Arabidopsis* APETALA 1 (AT1G69120, AP1) (SEQ ID NO:8540) (Hempel et al., Development 124:3845-3853, 1997)], and root promoters [e.g., the ROOTP promoter [SEQ ID NO: 8541]; rice ExpB5 and barley ExpB1 promoters (Won et al. Mol. Cells. 30: 369-376, 2010); *arabidopsis* monoterpene synthase (AT3G25820) promoter (Chen et al., Plant Phys 135:1956-66, 2004); *arabidopsis* Pho1 promoter (SEQ ID NO:8542, Hamburger et al., Plant Cell. 14: 889-902, 2002), which is also slightly induced Pi stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

For expression of a polypeptide-of-interest in a specific plant tissue or organelle, a signal peptide may be added to the coding sequence of the polypeptide. For example, a signal peptide for expression in a chloroplast of *Arabidopsis* is provided in SEQ ID NO:9178 (nucleic acid sequence) and SEQ ID NO:9179 (amino acid sequence). The sequence of the signal peptide may be introduced upstream of the coding sequence, e.g., by replacing the codon of the initiator methionine. For further description see Examples 1 and 12 of the Examples section which follows.

Since processes which increase yield, oil content, yield, seed yield, fiber yield, fiber quality, fiber length, growth rate, biomass, vigor, nitrogen use efficiency, fertilizer use efficiency, and/or abiotic stress tolerance of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on yield, oil content, yield, seed yield, fiber yield, fiber quality, fiber length, growth rate, biomass, vigor, nitrogen use efficiency, fertilizer use efficiency, and/or abiotic stress tolerance of the plant.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, drought, water deprivation, excess of water (e.g., flood, waterlogging), etiolation, low temperature (e.g., cold stress), high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased abiotic stress tolerance, increased nitrogen use efficiency, increased biomass, increased growth rate, increased vigor, increased yield and increased fiber yield or quality as compared to a non-transformed plant.

The effect of the transgene (the exogenous polynucleotide encoding the polypeptide) on abiotic stress tolerance can be determined using known methods such as detailed below and in the Examples section which follows.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control Arabidopsis plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat Stress Tolerance—

Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency— can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)] \times 100 \qquad \text{Formula I}$$

Fertilizer Use Efficiency—

To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—

To analyze whether the transgenic plants (e.g., Arabidopsis plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—

The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen Determination—

The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant Vigor—

The plant vigor can be calculated by the increase in growth parameters such as leaf area, fiber length, rosette diameter, plant fresh weight and the like per time.

Growth Rate—

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in $cm^2$ per day of leaf area).

Relative Growth Area
can be calculated using Formula II.

Relative growth rate area=Regression coefficient of area along time course     Formula II:

Thus, the relative growth area rate is in units of 1/day and length growth rate is in units of 1/day.

Seed Yield—

Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000     Formula III:

The Harvest Index can be calculated using Formula IV

Harvest Index=Average seed yield per plant/Average dry weight     Formula IV:

Grain Protein Concentration—

Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber Length—

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://WorldWide Web(dot)cottoninc(dot)com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil Content—

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to another embodiment of the present invention, there is provided a food or feed comprising the plants or a portion thereof of the present invention.

According to some embodiments of the invention, the plant cell forms a part of a plant.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA Extraction—

Tissues growing at various growth conditions (as described below) were sampled and RNA was extracted using TRIzol Reagent from Invitrogen [Hypertext Transfer Protocol://World Wide Web(dot)invitrogen(dot)com/content (dot)cfm?pageid=469]. Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc, CA USA). For convenience, each micro-array expression information tissue type has received an expression Set ID.

Correlation Analysis— was performed for selected genes according to some embodiments of the invention, in which the characterized parameters (measured parameters according to the correlation IDs) were used as "x axis" for correlation with the tissue transcriptome, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved yield, growth rate, nitrogen use efficiency, abiotic stress tolerance and the like).

Example 1

Identifying Genes which Improve Yield and Agronomical Important Traits in Plants The present inventors have identified polynucleotides which expression thereof in plants can increase yield, fiber yield, fiber quality, growth rate, vigor, biomass, growth rate, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly available databases or from performing sequencing using the Solexa technology (e.g. Barley and *Sorghum*). Sequence data from 100 different plant species was introduced into a single, comprehensive database. Other information on gene expression, protein annotation, enzymes and pathways were also incorporated.

Major databases used include:
Genomes
- *Arabidopsis* genome [TAIR genome version 6 (Hypertext Transfer Protocol://World Wide Web(dot)*arabidopsis* (dot)org/)]
- Rice genome [IRGSP build 4.0 (Hypertext Transfer Protocol://rgp(dot)dna(dot)affrc(dot)go(dot)jp/IRGSP/)].
- Poplar [*Populus* trichocarpa release 1.1 from JGI (assembly release v1.0) (Hypertext Transfer Protocol://World Wide Web(dot)genome(dot)jgi-psf(dot)org/)]
- *Brachypodium* [JGI 4× assembly, Hypertext Transfer Protocol://World Wide Web(dot)brachpodium(dot)org)]
- Soybean [DOE-JGI SCP, version Glyma0 (Hypertext Transfer Protocol://World Wide Web(dot)phytozome (dot)net/)]
- Grape [French-Italian Public Consortium for Grapevine Genome Characterization grapevine genome (Hypertext Transfer Protocol://World Wide Web(dot)genoscope(dot)cns(dot)fr/)]
- Castobean [TIGR/J Craig Venter Institute 4× assembly [(Hypertext Transfer Protocol://msc(dot)jcvi(dot)org/r communis]
- *Sorghum* [DOE-JGI SCP, version Sbi1 [Hypertext Transfer Protocol://World Wide Web(dot)phytozome(dot) net/)].
- Partially assembled genome of Maize [Hypertext Transfer Protocol://maizesequence(dot)org/]

Expressed EST and mRNA Sequences were Extracted from the Following Databases:
- GenBank Hypertext Transfer Protocol://World Wide Web (dot)ncbi(dot)nlm(dot)nih(dot)gov/dbEST
- RefSeq (Hypertext Transfer Protocol://World Wide Web (dot)ncbi(dot)nlm(dot)nih(dot)gov/RefSeq/).
- TAR (Hypertext Transfer Protocol://World Wide Web (dot)*arabidopsis* (dot)org/).

Protein and Pathway Databases
- Uniprot [Hypertext Transfer Protocol://World Wide Web (dot)uniprot(dot)org/]
- AraCyc [Hypertext Transfer Protocol://World Wide Web (dot)*arabidopsis* (dot)org/biocyc/index(dot)jsp].
- ENZYME [Hypertext Transfer Protocol://expasy(dot)org/ enzyme/].

Microarray Datasets were Downloaded from:
- GEO (Hypertext Transfer Protocol://World Wide Web.ncbi.nlm.nih.gov/geo/)
- TAIR (Hypertext Transfer Protocol://World Wide Web.arabidopsis.org/).
- Proprietary microarray data (WO2008/122980).

QTL and SNPs information
- Gramene [Hypertext Transfer Protocol://World Wide Web (dot)gramene(dot)org/qtl/].
- Panzea [Hypertext Transfer Protocol://World Wide Web (dot)panzea(dot)org/index(dot)html].

Database Assembly—
was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly—
For gene clustering and assembly of organisms with available genome sequence data (*arabidopsis*, rice, castorbean, grape, *brachypodium*, poplar, soybean, *sorghum*) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene Annotation—
Predicted genes and proteins were annotated as follows:
Blast search [Hypertext Transfer Protocol://blast(dot) ncbi(dot)nlm(dot)nih(dot)gov/Blast(dot)cgi] against all plant UniProt [Hypertext Transfer Protocol://World Wide Web(dot)uniprot(dot)org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web(dot)ebi(dot)ac(dot)uk/interpro/].

Blast against proteins from AraCyc and ENZYME databases was used to map the predicted transcripts to AraCyc pathways.

Predicted proteins from different species were compared using blast algorithm

[Hypertext Transfer Protocol://World Wide Web(dot)ncbi (dot)nlm(dot)nih(dot)gov/Blast(dot)cgi] to validate the accuracy of the predicted protein sequence, and for efficient detection of orthologs.

Gene Expression Profiling—
Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web(dot)icugi(dot)org/] confirmed the accuracy of the sequencing and assembly. Expression patterns of selected genes fitted well their qRT-PCR (quantitative reverse transcription-polymerase chain reaction) data.

Overall, 228 genes (SEQ ID NOs: 1-277 and 8511, 8513, 8515, 8517, 8519, 8521 and 8523 for polynucleotides and SEQ ID NOs: 480-733, 8512, 8514, 8516, 8518, 8520, 8522 and 8524 for polypeptides) were identified to have a major impact on plant yield, growth rate, vigor, biomass, growth rate, oil content, fiber quality, fiber yield, abiotic stress tolerance, nitrogen use efficiency, water use efficiency and fertilizer use efficiency when expression thereof is increased in plants. The identified genes, their curated polynucleotide and polypeptide sequences, as well as their updated sequences according to Genbank database are summarized in Table 1, hereinbelow.

TABLE 1

Identified genes for increasing yield, growth rate, vigor, biomass, growth rate, oil content, abiotic stress tolerance, nitrogen use efficiency, water use efficiency and fertilizer use efficiency of a plant

| Gene Name | Organism\|Cluster Name | Polyn. SEQ ID NO: | Polyp. SEQ ID NO: |
|---|---|---|---|
| LYM521 | barley\|10v2\|AV835023 | 1 | 480 |
| LYM522 | barley\|10v2\|AV835528 | 2 | 481 |
| LYM523 | barley\|10v2\|AV909896 | 3 | 482 |
| LYM524 | barley\|10v2\|BE193288 | 4 | 483 |
| LYM525 | barley\|10v2\|BE412904 | 5 | 484 |
| LYM526 | barley\|10v2\|BE421167XX1 | 6 | 485 |
| LYM527 | barley\|10v2\|BE421922 | 7 | 486 |
| LYM528 | barley\|10v2\|BE454463 | 8 | 487 |
| LYM529 | barley\|10v2\|BF619969 | 9 | 488 |
| LYM530 | barley\|10v2\|BG309276 | 10 | 489 |
| LYM531 | barley\|10v2\|BG417256 | 11 | 490 |
| LYM532 | barley\|10v2\|BI954139 | 12 | 491 |
| LYM533 | barley\|10v2\|BU983824 | 13 | 492 |
| LYM535 | brachypodium\|09v1\|DV477501 | 14 | 493 |
| LYM536 | brachypodium\|09v1\|DV485542 | 15 | 494 |
| LYM537 | brachypodium\|09v1\|GT773244 | 16 | 495 |
| LYM538 | brachypodium\|09v1\|GT805233 | 17 | 496 |
| LYM539 | brachypodium\|09v1\|GT827944 | 18 | 497 |
| LYM540 | foxtail_millet\|10v2\|FXTRMSLX03457717D1 | 19 | 498 |
| LYM541 | foxtail_millet\|10v2\|FXTRMSLX05531696D1 | 20 | 499 |
| LYM543 | foxtail_millet\|10v2\|OXFXTRMSLX00381957D1T1 | 21 | 500 |
| LYM544 | foxtail_millet\|10v2\|SICRP015693 | 22 | 501 |
| LYM545 | foxtail_millet\|10v2\|SICRP020126 | 23 | 502 |
| LYM546 | foxtail_millet\|10v2\|SICRP025730 | 24 | 503 |
| LYM547 | foxtail_millet\|10v2\|SICRP027169 | 25 | 504 |
| LYM548 | foxtail_millet\|10v2\|SICRP033760 | 26 | 505 |
| LYM549 | foxtail_millet\|10v2\|SICRP041745 | 27 | 506 |
| LYM550 | foxtail_millet\|10v2\|SICRP042104 | 28 | 507 |
| LYM552 | foxtail_millet\|11v1\|\|FOXTAILXMILLETX10 V2XFXTRMSLX00063087D1XT1 | 29 | 508 |
| LYM553 | foxtail_millet\|11v1\|FOXTAILXMILLETX10 V2XFXTRMSLX00097229D1XT1 | 30 | 509 |
| LYM554 | foxtail_millet\|11v1\|FOXTAILXMILLETX10 V2XFXTRMSLX00166958D2XT1 | 31 | 510 |
| LYM555 | foxtail_millet\|11v1\|FOXTAILXMILLETX10 V2XFXTRMSLX00424921XT1 | 32 | 511 |
| LYM556 | foxtail_millet\|11v1\|FOXTAILXMILLETX10 V2XFXTRMSLX00448399D2XT1 | 33 | 512 |
| LYM557 | foxtail_millet\|11v1\|FOXTAILXMILLETX10 V2XFXTRMSLX00706755D2XT1 | 34 | 513 |
| LYM558 | foxtail_millet\|11v1\|FOXTAILXMILLETX10 V2XFXTRMSLX00959728D1XT1 | 35 | 514 |
| LYM559 | foxtail_millet\|11v1\|FOXTAILXMILLETX10 V2XFXTRMSLX01366155D1XT1 | 36 | 515 |
| LYM560 | foxtail_millet\|11v1\|FOXTAILXMILLETX10 V2XFXTRMSLX01545798D1XT1 | 37 | 516 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism\|Cluster Name | Polyn. SEQ ID NO: | Polyp. SEQ ID NO: |
|---|---|---|---|
| LYM561 | foxtail_millet\|11v1\|FOXTAILXMILLETX10V2XFXTRMSLX02070403D1XT1 | 38 | 517 |
| LYM562 | foxtail_millet\|11v1\|FOXTAILXMILLETX10V2XFXTRMSLX04864194D2XT1 | 39 | 518 |
| LYM563 | foxtail_millet\|11v1\|FOXTAILXMILLETX10V2XFXTRMSLX10859716D2XT1 | 40 | 519 |
| LYM564 | foxtail_millet\|11v1\|FOXTAILXMILLETX10V2XSICRP012933XT1 | 41 | 520 |
| LYM565 | maize\|10v1\|AA072431 | 42 | 521 |
| LYM566 | maize\|10v1\|AA072467 | 43 | 522 |
| LYM567 | maize\|10v1\|AA979784 | 44 | 523 |
| LYM568 | maize\|10v1\|AA979964 | 45 | 524 |
| LYM569 | maize\|10v1\|AF055909 | 46 | 525 |
| LYM570 | maize\|10v1\|AI001334 | 47 | 526 |
| LYM571 | maize\|10v1\|AI372248 | 48 | 527 |
| LYM572 | maize\|10v1\|AI396035 | 49 | 528 |
| LYM573 | maize\|10v1\|AI438409 | 50 | 529 |
| LYM574 | maize\|10v1\|AI438928 | 51 | 530 |
| LYM575 | maize\|10v1\|AI491367 | 52 | 531 |
| LYM576 | maize\|10v1\|AI491557 | 53 | 532 |
| LYM577 | maize\|10v1\|AI586713 | 54 | 533 |
| LYM578 | maize\|10v1\|AI600403 | 55 | 534 |
| LYM579 | maize\|10v1\|AI600507 | 56 | 535 |
| LYM580 | maize\|10v1\|AI600515 | 57 | 536 |
| LYM581 | maize\|10v1\|AI600733 | 58 | 537 |
| LYM582 | maize\|10v1\|AI612407 | 59 | 538 |
| LYM583 | maize\|10v1\|AI615098 | 60 | 539 |
| LYM585 | maize\|10v1\|AI629688 | 61 | 540 |
| LYM586 | maize\|10v1\|AI629873 | 62 | 541 |
| LYM587 | maize\|10v1\|AI637040 | 63 | 542 |
| LYM588 | maize\|10v1\|AI637252 | 64 | 543 |
| LYM589 | maize\|10v1\|AI649568 | 65 | 544 |
| LYM590 | maize\|10v1\|AI649935 | 66 | 545 |
| LYM591 | maize\|10v1\|AI657300 | 67 | 546 |
| LYM592 | maize\|10v1\|AI666255 | 68 | 547 |
| LYM593 | maize\|10v1\|AI667844 | 69 | 548 |
| LYM594 | maize\|10v1\|AI667854 | 70 | 549 |
| LYM595 | maize\|10v1\|AI670363 | 71 | 550 |
| LYM596 | maize\|10v1\|AI670381 | 72 | 551 |
| LYM598 | maize\|10v1\|AI714403 | 73 | 552 |
| LYM599 | maize\|10v1\|AI737669 | 74 | 553 |
| LYM600 | maize\|10v1\|AI795494 | 75 | 554 |
| LYM601 | maize\|10v1\|AI861485 | 76 | 555 |
| LYM602 | maize\|10v1\|AI901512 | 77 | 556 |
| LYM603 | maize\|10v1\|AI901728 | 78 | 557 |
| LYM604 | maize\|10v1\|AI901848 | 79 | 558 |
| LYM606 | maize\|10v1\|AI947476 | 80 | 559 |
| LYM607 | maize\|10v1\|AI947520 | 81 | 560 |
| LYM608 | maize\|10v1\|AI947771 | 82 | 561 |
| LYM609 | maize\|10v1\|AI966935 | 83 | 562 |
| LYM610 | maize\|10v1\|AI973425 | 84 | 563 |
| LYM611 | maize\|10v1\|AW060148 | 85 | 564 |
| LYM612 | maize\|10v1\|AW066649 | 86 | 565 |
| LYM613 | maize\|10v1\|AW066717 | 87 | 566 |
| LYM614 | maize\|10v1\|AW066878 | 88 | 567 |
| LYM615 | maize\|10v1\|AW066932 | 89 | 568 |
| LYM616 | maize\|10v1\|AW129882 | 90 | 569 |
| LYM617 | maize\|10v1\|AW146650 | 91 | 570 |
| LYM618 | maize\|10v1\|AW165558 | 92 | 571 |
| LYM619 | maize\|10v1\|AW282383 | 93 | 572 |
| LYM620 | maize\|10v1\|AW288657 | 94 | 573 |
| LYM621 | maize\|10v1\|AW455616 | 95 | 574 |
| LYM622 | maize\|10v1\|AW497872 | 96 | 575 |
| LYM623 | maize\|10v1\|AW498234 | 97 | 576 |
| LYM624 | maize\|10v1\|AW562949 | 98 | 577 |
| LYM625 | maize\|10v1\|AW574438 | 99 | 578 |
| LYM627 | maize\|10v1\|AY530730 | 100 | 579 |
| LYM628 | maize\|10v1\|BE055960 | 101 | 580 |
| LYM630 | maize\|10v1\|BE511742 | 102 | 581 |
| LYM631 | maize\|10v1\|BE552767 | 103 | 582 |
| LYM632 | maize\|10v1\|BE553127 | 104 | 583 |
| LYM634 | maize\|10v1\|BG265855 | 105 | 584 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism\|Cluster Name | Polyn. SEQ ID NO: | Polyp. SEQ ID NO: |
|---|---|---|---|
| LYM635 | maize\|10v1\|BG317160 | 106 | 585 |
| LYM636 | maize\|10v1\|BG319843 | 107 | 586 |
| LYM638 | maize\|10v1\|BG321228 | 108 | 587 |
| LYM639 | maize\|10v1\|BG354339 | 109 | 588 |
| LYM640 | maize\|10v1\|BG360795 | 110 | 589 |
| LYM642 | maize\|10v1\|BG835850 | 111 | 590 |
| LYM643 | maize\|10v1\|BG841225 | 112 | 591 |
| LYM644 | maize\|10v1\|BG842956 | 113 | 592 |
| LYM645 | maize\|10v1\|BI233906 | 114 | 593 |
| LYM646 | maize\|10v1\|BI388911 | 115 | 594 |
| LYM647 | maize\|10v1\|BI679419 | 116 | 595 |
| LYM648 | maize\|10v1\|BM072733 | 117 | 596 |
| LYM649 | maize\|10v1\|BM075457 | 118 | 597 |
| LYM650 | maize\|10v1\|BM078303 | 119 | 598 |
| LYM652 | maize\|10v1\|BM348210 | 120 | 599 |
| LYM653 | maize\|10v1\|BM379855 | 121 | 600 |
| LYM654 | maize\|10v1\|BM381581 | 122 | 601 |
| LYM655 | maize\|10v1\|BM499069 | 123 | 602 |
| LYM656 | maize\|10v1\|BM500372 | 124 | 603 |
| LYM657 | maize\|10v1\|BM501213 | 125 | 604 |
| LYM658 | maize\|10v1\|BQ164220 | 126 | 605 |
| LYM659 | maize\|10v1\|BU197908 | 127 | 606 |
| LYM660 | maize\|10v1\|BU582167 | 128 | 607 |
| LYM661 | maize\|10v1\|CB331023 | 129 | 608 |
| LYM662 | maize\|10v1\|CD936450 | 130 | 609 |
| LYM663 | maize\|10v1\|CD943493 | 131 | 610 |
| LYM665 | maize\|10v1\|CF028749 | 132 | 611 |
| LYM666 | maize\|10v1\|CF650630 | 133 | 612 |
| LYM667 | maize\|10v1\|DR797784 | 134 | 613 |
| LYM668 | maize\|10v1\|DR802129 | 135 | 614 |
| LYM669 | maize\|10v1\|DW797958 | 136 | 615 |
| LYM670 | maize\|10v1\|DW833446 | 137 | 616 |
| LYM671 | maize\|10v1\|DY537984 | 138 | 617 |
| LYM672 | maize\|10v1\|EE162371 | 139 | 618 |
| LYM673 | maize\|10v1\|T12698 | 140 | 619 |
| LYM674 | maize\|10v1\|T18762 | 141 | 620 |
| LYM675 | maize\|10v1\|T18786 | 142 | 621 |
| LYM677 | maize\|10v1\|T20367 | 143 | 622 |
| LYM678 | maize\|10v1\|T70695 | 144 | 623 |
| LYM679 | maize\|10v1\|W21715 | 145 | 624 |
| LYM680 | maize\|10v1\|W59811 | 146 | 625 |
| LYM682 | maize\|gb170\|BM378498 | 147 | 626 |
| LYM683 | rice\|gb170\|OS03G50430 | 148 | 627 |
| LYM684 | rice\|gb170\|OS08G01380 | 149 | 628 |
| LYM685 | rice\|gb170\|OS09G38440 | 150 | 629 |
| LYM686 | rice\|gb170\|OS11G08330 | 151 | 630 |
| LYM687 | sorghum\|09v1\|CD204441 | 152 | 631 |
| LYM688 | sorghum\|09v1\|SB01G007070 | 153 | 632 |
| LYM689 | sorghum\|09v1\|SB01G008550 | 154 | 633 |
| LYM690 | sorghum\|09v1\|SB01G017160 | 155 | 634 |
| LYM691 | sorghum\|09v1\|SB01G019510 | 156 | 635 |
| LYM692 | sorghum\|09v1\|SB01G023260 | 157 | 636 |
| LYM693 | sorghum\|09v1\|SB01G028930 | 158 | 637 |
| LYM694 | sorghum\|09v1\|SB01G031740 | 159 | 638 |
| LYM695 | sorghum\|09v1\|SB01G034070 | 160 | 639 |
| LYM697 | sorghum\|09v1\|SB01G036360 | 161 | 640 |
| LYM698 | sorghum\|09v1\|SB01G045110 | 162 | 641 |
| LYM699 | sorghum\|09v1\|SB01G047160 | 163 | 642 |
| LYM700 | sorghum\|09v1\|SB02G003520 | 164 | 643 |
| LYM701 | sorghum\|09v1\|SB02G005780 | 165 | 644 |
| LYM702 | sorghum\|09v1\|SB02G020880 | 166 | 645 |
| LYM703 | sorghum\|09v1\|SB02G031600 | 167 | 646 |
| LYM704 | sorghum\|09v1\|SB02G034560 | 168 | 647 |
| LYM705 | sorghum\|09v1\|SB02G042910 | 169 | 648 |
| LYM706 | sorghum\|09v1\|SB02G043760 | 170 | 649 |
| LYM707 | sorghum\|09v1\|SB03G003100 | 171 | 650 |
| LYM708 | sorghum\|09v1\|SB03G020183 | 172 | 651 |
| LYM709 | sorghum\|09v1\|SB03G034280 | 173 | 652 |
| LYM710 | sorghum\|09v1\|SB03G038270 | 174 | 653 |
| LYM711 | sorghum\|09v1\|SB06G025710 | 175 | 654 |
| LYM712 | sorghum\|09v1\|SB04G006450 | 176 | 655 |
| LYM713 | sorghum\|09v1\|SB05G002380 | 177 | 656 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism\|Cluster Name | Polyn. SEQ ID NO: | Polyp. SEQ ID NO: |
| --- | --- | --- | --- |
| LYM714 | sorghum\|09v1\|SB06G020280 | 178 | 657 |
| LYM715 | sorghum\|09v1\|SB06G020440 | 179 | 658 |
| LYM716 | sorghum\|09v1\|SB06G021190 | 180 | 659 |
| LYM717 | sorghum\|09v1\|SB07G004900 | 181 | 660 |
| LYM718 | sorghum\|09v1\|SB07G024936 | 182 | 661 |
| LYM719 | sorghum\|09v1\|SB07G025570 | 183 | 662 |
| LYM720 | sorghum\|09v1\|SB07G026090 | 184 | 663 |
| LYM721 | sorghum\|09v1\|SB08G004193 | 185 | 664 |
| LYM722 | sorghum\|09v1\|SB08G004400 | 186 | 665 |
| LYM723 | sorghum\|09v1\|SB09G002700 | 187 | 666 |
| LYM724 | sorghum\|09v1\|SB09G003280 | 188 | 667 |
| LYM725 | sorghum\|09v1\|SB09G005930 | 189 | 668 |
| LYM726 | sorghum\|09v1\|SB09G023380 | 190 | 669 |
| LYM727 | sorghum\|09v1\|SB09G026280 | 191 | 670 |
| LYM728 | sorghum\|09v1\|SB09G027995 | 192 | 671 |
| LYM729 | sorghum\|09v1\|SB09G029480 | 193 | 672 |
| LYM730 | sorghum\|09v1\|SB09G029660 | 194 | 673 |
| LYM731 | sorghum\|09v1\|SB10G006950 | 195 | 674 |
| LYM732 | sorghum\|09v1\|SB10G023320 | 196 | 675 |
| LYM733 | sorghum\|09v1\|SB10G028690 | 197 | 676 |
| LYM734 | sorghum\|09v1\|SLXL50035388D1 | 198 | 677 |
| LYM735 | wheat\|10v2\|AL816373 | 199 | 678 |
| LYM736 | wheat\|10v2\|BE217006 | 200 | 679 |
| LYM737 | wheat\|10v2\|BE515545 | 201 | 680 |
| LYM739 | wheat\|10v2\|BQ804893 | 202 | 681 |
| LYM740 | wheat\|10v2\|CA691702 | 203 | 682 |
| LYM741 | wheat\|10v2\|WHTHBP1A | 204 | 683 |
| LYM742 | barley\|10v2\|BF622991 | 205 | 684 |
| LYM743 | brachypodium\|09v1\|SRR031797S0088390 | 206 | 685 |
| LYM744 | maize\|10v1\|BM381972 | 207 | 686 |
| LYM745 | maize\|10v1\|CF040199 | 208 | 687 |
| LYM746 | sorghum\|09v1\|SB03G035130 | 209 | 688 |
| LYM747 | sorghum\|09v1\|SB04G006860 | 210 | 689 |
| LYM748 | sorghum\|09v1\|SB10G008610 | 211 | 690 |
| LYM749 | foxtail_millet\|11v1\|FOXTAILXMILLETX10V2XFXTRMSLX00653965D1XT1 | 212 | 691 |
| LYM750 | maize\|gb170\|BE640144 | 213 | 692 |
| LYM531_H6 | maize\|10v1\|AI901736 | 214 | 693 |
| LYM596_H9 | brachypodium\|09v1\|DV469171 | 215 | 694 |
| LYM701_H1 | maize\|10v1\|AI586919 | 216 | 695 |
| LYM534 | barley\|10v2\|EX578703 | 217 | — |
| LYM633 | maize\|10v1\|BE639998 | 218 | — |
| LYM522 | barley\|10v2\|AV835528 | 219 | 696 |
| LYM526 | barley\|10v2\|BE421167XX1 | 220 | 485 |
| LYM528 | barley\|10v2\|BE454463 | 221 | 697 |
| LYM529 | barley\|10v2\|BF619969 | 222 | 698 |
| LYM530 | barley\|10v2\|BG309276 | 223 | 699 |
| LYM531 | barley\|10v2\|BG417256 | 224 | 700 |
| LYM533 | barley\|10v2\|BU983824 | 225 | 492 |
| LYM537 | brachypodium\|09v1\|GT773244 | 226 | 495 |
| LYM538 | brachypodium\|09v1\|GT805233 | 227 | 496 |
| LYM539 | brachypodium\|09v1\|GT827944 | 228 | 497 |
| LYM541 | foxtail_millet\|10v2\|FXTRMSLX05531696D1 | 229 | 701 |
| LYM544 | foxtail_millet\|10v2\|SICRP015693 | 230 | 702 |
| LYM549 | foxtail_millet\|10v2\|SICRP041745 | 231 | 703 |
| LYM554 | foxtail_millet\|11v1\|FOXTAILXMILLETX10V2XFXTRMSLX00166958D2XT1 | 232 | 704 |
| LYM561 | foxtail_millet\|11v1\|FOXTAILXMILLETX10V2XFXTRMSLX02070403D1XT1 | 233 | 517 |
| LYM564 | foxtail_millet\|11v1\|FOXTAILXMILLETX10V2XSICRP012933XT1 | 234 | 705 |
| LYM570 | maize\|10v1\|AI001334 | 235 | 706 |
| LYM571 | maize\|10v1\|AI372248 | 236 | 527 |
| LYM582 | maize\|10v1\|AI612407 | 237 | 538 |
| LYM586 | maize\|10v1\|AI629873 | 238 | 541 |
| LYM592 | maize\|10v1\|AI666255 | 239 | 547 |
| LYM596 | maize\|10v1\|AI670381 | 240 | 707 |
| LYM606 | maize\|10v1\|AI947476 | 241 | 559 |
| LYM642 | maize\|10v1\|BG835850 | 242 | 708 |
| LYM644 | maize\|10v1\|BG842956 | 243 | 709 |
| LYM649 | maize\|10v1\|BM075457 | 244 | 710 |
| LYM650 | maize\|10v1\|BM078303 | 245 | 711 |

TABLE 1-continued

Identified genes for increasing yield, growth rate, vigor, biomass, growth rate, oil content, abiotic stress tolerance, nitrogen use efficiency, water use efficiency and fertilizer use efficiency of a plant

| Gene Name | Organism\|Cluster Name | Polyn. SEQ ID NO: | Polyp. SEQ ID NO: |
|---|---|---|---|
| LYM661 | maize\|10v1\|CB331023 | 246 | 712 |
| LYM667 | maize\|10v1\|DR797784 | 247 | 713 |
| LYM668 | maize\|10v1\|DR802129 | 248 | 714 |
| LYM670 | maize\|10v1\|DW833446 | 249 | 715 |
| LYM670 | maize\|10v1\|DW833446 | 250 | 716 |
| LYM671 | maize\|10v1\|DY537984 | 251 | 717 |
| LYM672 | maize\|10v1\|EE162371 | 252 | 718 |
| LYM680 | maize\|10v1\|W59811 | 253 | 719 |
| LYM685 | rice\|gb170\|OS09G38440 | 254 | 720 |
| LYM686 | rice\|gb170\|OS11G08330 | 255 | 630 |
| LYM687 | sorghum\|09v1\|CD204441 | 256 | 721 |
| LYM689 | sorghum\|09v1\|SB01G008550 | 257 | 722 |
| LYM693 | sorghum\|09v1\|SB01G028930 | 258 | 723 |
| LYM700 | sorghum\|09v1\|SB02G003520 | 259 | 724 |
| LYM701 | sorghum\|09v1\|SB02G005780 | 260 | 644 |
| LYM702 | sorghum\|09v1\|SB02G020880 | 261 | 725 |
| LYM711 | sorghum\|09v1\|SB03G047535 | 262 | 726 |
| LYM712 | sorghum\|09v1\|SB04G006450 | 263 | 655 |
| LYM717 | sorghum\|09v1\|SB07G004900 | 264 | 727 |
| LYM721 | sorghum\|09v1\|SB08G004193 | 265 | 728 |
| LYM726 | sorghum\|09v1\|SB09G023380 | 266 | 729 |
| LYM729 | sorghum\|09v1\|SB09G029480 | 267 | 672 |
| LYM734 | sorghum\|09v1\|SLXL50035388D1 | 268 | 730 |
| LYM740 | wheat\|10v2\|CA691702 | 269 | 731 |
| LYM743 | brachypodium\|09v1\|SRR031797S0088390 | 270 | 685 |
| LYM744 | maize\|10v1\|BM381972 | 271 | 732 |
| LYM745 | maize\|10v1\|CF040199 | 272 | 733 |
| LYM748 | sorghum\|09v1\|SB10G008610 | 273 | 690 |
| LYM596_H9 | brachypodium\|09v1\|DV469171 | 274 | 694 |
| LYM701_H1 | maize\|10v1\|AI586919 | 275 | 695 |
| LYM633 | maize\|10v1\|BE639998 | 276 | — |
| LYM663 | maize\|10v1\|CD943493 | 277 | — |
| LYM721 | sorghum\|09v1\|SB08G004193 | 8511 | 8512 |
| LYM721 | sorghum\|09v1\|SB08G004193 | 8513 | 8514 |
| LYM670 | maize\|10v1\|DW833446 | 8515 | 8516 |
| LYM670 | maize\|10v1\|DW833446 | 8517 | 8518 |
| LYM745 | maize\|10v1\|CF040199 | 8519 | 8520 |
| LYM745 | maize\|10v1\|CF040199 | 8521 | 8522 |
| LYM745 | maize\|10v1\|CF040199 | 8523 | 8524 |

Table 1: Provided are the identified genes, their annotation, organism and polynucleotide and polypeptide sequence identifiers.
"polyn." = polynucleotide; "polyp." = polypeptide.
"SP" = signal peptide for expression in *Arabidopsis* chloroplast (SEQ ID NO: 9178 for nucleic acid sequence, and SEQ ID NO: 9179 for amino acid sequence).
It is noted that SEQ ID NO: 8511 (LYM721-EVO15070730) depicts a polynucleotide transcript with SP; SEQ ID NO: 8512 (LYM721-EVO15070730) depicts the protein with SP; SEQ ID NO: 8513 (LYM721-EVO15070730) depicts a polynucleotide transcript without SP; SEQ ID NO: 8514 (LYM721-EVO15070730) depicts a protein without SP; SEQ ID NO: 8515 (LYM670-EVO15070679) depicts a polynucleotide transcript with SP; SEQ ID NO: 8516 (LYM670-EVO15070679) depicts a protein with SP; SEQ ID NO: 8517 (LYM670-EVO15070679) depicts a polynucleotide transcript without SP; SEQ ID NO: 8518 (LYM670-EVO15070679) depicts a protein without SP; SEQ ID NO: 8519 (LYM745-EVO15070754) depicts a polynucleotide transcript full length with Thr as 1st amino acid; SEQ ID NO: 8520 (LYM745-EVO15070754) depicts a protein full length with Thr as 1st amino acid; SEQ ID NO: 8521 (LYM745-EVO15070754) transcript full length with Met as 1st amino acid; SEQ ID NO: 8522 (LYM745-EVO15070754) protein full length with Met as 1st amino acid; SEQ ID NO: 8523 (LYM745-EVO15070754) transcript about half length protein starting from 1st Met appearing in amino acid (aa) sequence; SEQ ID NO: 8524 (LYM745-EVO15070754) protein about half length protein starting from 1st Met appearing in aa sequence.

Example 2

Identification of Homologous Sequences that Increase Yield, Fiber Yield, Fiber Quality, Growth Rate, Biomass, Oil Content, Vigor, ABST, and/or NUE of a Plant The concepts of orthology and paralogy have recently been applied to functional characterizations and classifications on the scale of whole-genome comparisons. Orthologs and paralogs constitute two major types of homologues: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes affecting plant yield, oil yield, oil content, seed yield, growth rate, vigor, biomass, fiber yield, fiber quality, abiotic stress tolerance, and fertilizer use efficiency (FUE) genes and/or nitrogen use efficiency, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (Hordeum vulgare), Arabidopsis (Arabidopsis thaliana), maize (Zea mays), cotton (Gossypium), Oilseed rape (Brassica napus), Rice (Oryza sativa), Sugar cane (Saccharum officinarum), Sorghum (Sorghum bicolor), Soybean (Glycine max), Sunflower (Helianthus annuus), Tomato (Lycopersicon esculentum), and Wheat (Triticum aestivum).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web(dot)biochem(dot)ucl(dot)ac(dot)uk/bsm/dbbrowser/protocol/prodomqry(dot)html), PR (Hypertext Transfer Protocol://pir(dot)Georgetown(dot)edu/) or Pfam (Hypertext Transfer Protocol://World Wide Web(dot)sanger(dot)ac(dot)uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+algorithm alignment for the second stage. Local identity (Blast alignments) was defined with a very permissive cutoff—60% Identity on a span of 60% of the sequences lengths because it use as only a filter for the global alignment stage. The default filtering of the Blast package was not utilized (by setting the parameter "—F F").

In the second stage, homologs were defined based on a global identity of at least 80% to the core gene polypeptide sequence.

Two distinct forms for finding the optimal global alignment for protein or nucleotide sequences were used in this application:

1. Between two proteins (following the blastp filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter):
GenCore 6.0 OneModel application utilizing the Frame+algorithm with the following parameters: model=frame+_p2n.model mode=qglobal -q=protein.sequence -db=nucleotide.sequence. The rest of the parameters are unchanged from the default options described hereinabove. The query polypeptide sequences were SEQ ID NOs: 480-733, 8512, 8514, 8516, 8518, 8520, 8522 and 8524 (which are encoded by the polynucleotides SEQ ID NOs:1-277 and 8511, 8513, 8515, 8517, 8519, 8521 and 8523, shown in Table 1 above) and the identified orthologous and homologous sequences having at least 80% global sequence identity are provided in Table 2, below. These homologous genes are expected to increase plant yield, seed yield, oil yield, oil content, growth rate, fiber yield, fiber quality, biomass, vigor, ABST and/or NUE of a plant.

TABLE 2

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 813 | LYM521 | wheat|10v2|BE427073 | 5174 | 480 | 92.4 | globlastp |
| 814 | LYM521 | wheat|10v2|BE497126 | 5175 | 480 | 89.5 | globlastp |
| 815 | LYM521 | rye|12v1|DRR001012.118652_P1 | 5176 | 480 | 88.9 | globlastp |
| 816 | LYM521 | leymus|gb166|EG375994_P1 | 5177 | 480 | 87.2 | globlastp |
| 817 | LYM521 | barley|10v2|BF065879_T1 | 5178 | 480 | 80.44 | glotblastn |
| 818 | LYM522 | wheat|10v2|BE500817 | 5179 | 481 | 98.8 | globlastp |
| 819 | LYM522 | rye|12v1|DRR001012.114121_P1 | 5180 | 481 | 98.3 | globlastp |
| 820 | LYM522 | brachypodium|09v1|DV470933 | 5181 | 481 | 82.4 | globlastp |
| 821 | LYM522 | brachypodium|12v1|BRADI5G22570T2_P1 | 5181 | 481 | 82.4 | globlastp |
| 822 | LYM522 | foxtail_millet|11v3|PHY7SI009409M_P1 | 5182 | 481 | 82.3 | globlastp |
| 823 | LYM522 | rice|11v1|AU069414_P1 | 5183 | 481 | 81.6 | globlastp |
| 824 | LYM522 | rice|gb170|OS04G53540 | 5183 | 481 | 81.6 | globlastp |
| 825 | LYM524 | rye|12v1|DRR001012.145703_P1 | 5184 | 483 | 97.6 | globlastp |
| 826 | LYM524 | rye|12v1|DRR001013.147777_P1 | 5184 | 483 | 97.6 | globlastp |
| 827 | LYM524 | rye|12v1|DRR001017.146458_P1 | 5184 | 483 | 97.6 | globlastp |
| 828 | LYM524 | wheat|10v2|BE424468 | 5184 | 483 | 97.6 | globlastp |
| 829 | LYM524 | wheat|10v2|BE497042 | 5184 | 483 | 97.6 | globlastp |
| 830 | LYM524 | wheat|10v2|BE518127 | 5185 | 483 | 97 | globlastp |
| 831 | LYM524 | brachypodium|09v1|SRR031795S0031948 | 5186 | 483 | 89.8 | globlastp |
| 832 | LYM524 | brachypodium|12v1|BRADI3G57530_P1 | 5186 | 483 | 89.8 | globlastp |
| 833 | LYM524 | rice|11v1|BM421486_P1 | 5187 | 483 | 86.1 | globlastp |
| 834 | LYM524 | rice|gb170|OS02G53320 | 5187 | 483 | 86.1 | globlastp |
| 835 | LYM524 | sorghum|09v1|SB04G034630 | 5188 | 483 | 86.1 | globlastp |
| 836 | LYM524 | sorghum|12v1|SB04G034630_P1 | 5188 | 483 | 86.1 | globlastp |
| 837 | LYM524 | switchgrass|gb167|FE631346 | 5189 | 483 | 84.2 | globlastp |
| 838 | LYM524 | foxtail_millet|11v3|PHY7SI018533M_P1 | 5190 | 483 | 83.6 | globlastp |
| 839 | LYM524 | millet|10v1|EVO454PM058146_P1 | 5191 | 483 | 83 | globlastp |
| 840 | LYM524 | maize|10v1|AI901933_P1 | 5192 | 483 | 81.2 | globlastp |
| 841 | LYM525 | leymus|gb166|EG377887_P1 | 5193 | 484 | 99.1 | globlastp |
| 842 | LYM525 | wheat|10v2|BE422948 | 5194 | 484 | 99.1 | globlastp |
| 843 | LYM525 | rye|12v1|DRR001012.101796_P1 | 5195 | 484 | 98.9 | globlastp |
| 844 | LYM525 | brachypodium|09v1|DV475357 | 5196 | 484 | 88.7 | globlastp |
| 845 | LYM525 | brachypodium|12v1|BRADI1G53920_P1 | 5196 | 484 | 88.7 | globlastp |
| 846 | LYM525 | oat|10v2|GR328188 | 5197 | 484 | 85.9 | globlastp |
| 847 | LYM525 | oat|11v1|GR328188_P1 | 5197 | 484 | 85.9 | globlastp |
| 848 | LYM525 | switchgrass|gb167|FE603554 | 5198 | 484 | 82.1 | globlastp |
| 849 | LYM525 | switchgrass|gb167|FL696864 | 5199 | 484 | 81.9 | globlastp |
| 850 | LYM525 | sorghum|09v1|SB02G006500 | 5200 | 484 | 81.6 | globlastp |
| 851 | LYM525 | sorghum|12v1|SB02G006500_P1 | 5200 | 484 | 81.6 | globlastp |
| 852 | LYM525 | millet|10v1|EVO454PM003745_P1 | 5201 | 484 | 81.4 | globlastp |
| 853 | LYM525 | foxtail_millet|11v3|PHY7SI029863M_P1 | 5202 | 484 | 81.2 | globlastp |
| 854 | LYM525 | sugarcane|10v1|BU102751 | 5203 | 484 | 81.2 | globlastp |
| 855 | LYM525 | foxtail_millet|10v2|SICRP004879 | 5204 | 484 | 81.18 | glotblastn |
| 856 | LYM525 | maize|10v1|AW224952_P1 | 5205 | 484 | 81 | globlastp |
| 857 | LYM525 | rice|gb170|OS07G12110 | 5206 | 484 | 81 | globlastp |
| 858 | LYM525 | rice|11v1|AA751455_P1 | 5207 | 484 | 80.7 | globlastp |
| 859 | LYM525 | maize|10v1|AW017682_P1 | 5208 | 484 | 80 | globlastp |
| 860 | LYM526 | wheat|10v2|BE490724 | 5209 | 485 | 94.3 | globlastp |
| 861 | LYM526 | wheat|10v2|CA634494 | 5210 | 485 | 94.3 | globlastp |
| 862 | LYM526 | wheat|10v2|CA678574XX1 | 5210 | 485 | 94.3 | globlastp |
| 863 | LYM526 | wheat|10v2|CD935038 | 5209 | 485 | 94.3 | globlastp |
| 864 | LYM526 | wheat|10v2|BG907254 | 5211 | 485 | 93.8 | globlastp |
| 865 | LYM526 | wheat|10v2|TAU73217 | 5212 | 485 | 93.8 | globlastp |
| 866 | LYM526 | rye|12v1|DRR001012.125475_P1 | 5213 | 485 | 93.2 | globlastp |
| 867 | LYM526 | rye|12v1|DRR001012.17351_P1 | 5214 | 485 | 92.6 | globlastp |
| 868 | LYM526 | leymus|gb166|EG394965_P1 | 5215 | 485 | 92.6 | globlastp |
| 869 | LYM526 | rye|12v1|DRR001012.147835_P1 | 5216 | 485 | 91.5 | globlastp |
| 870 | LYM527 | barley|10v2|BE421977_T1 | 5217 | 486 | 94.87 | glotblastn |
| 871 | LYM527 | oat|10v2|GR356711 | 5218 | 486 | 94.87 | glotblastn |
| 872 | LYM527 | wheat|10v2|BE428386 | 5218 | 486 | 94.87 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 873 | LYM527 | barley\|10v2\|BG300270_T1 | 5219 | 486 | 93.59 | glotblastn |
| 874 | LYM527 | foxtail_millet\|10v2\|FXTSLX00007922 | 5220 | 486 | 93.59 | glotblastn |
| 875 | LYM527 | wheat\|10v2\|BE493375 | 5221 | 486 | 93.59 | glotblastn |
| 876 | LYM527 | wheat\|10v2\|CA612298 | 5222 | 486 | 93.59 | glotblastn |
| 877 | LYM527 | wheat\|10v2\|CA623003 | 5220 | 486 | 93.59 | glotblastn |
| 878 | LYM527 | wheat\|10v2\|CJ564049 | 5222 | 486 | 93.59 | glotblastn |
| 879 | LYM527 | rye\|12v1\|DRR001012.100136_T1 | 5223 | 486 | 92.31 | glotblastn |
| 880 | LYM527 | rye\|12v1\|DRR001012.113458_T1 | 5224 | 486 | 92.31 | glotblastn |
| 881 | LYM527 | rye\|12v1\|DRR001012.159370_T1 | 5225 | 486 | 92.31 | glotblastn |
| 882 | LYM527 | rye\|12v1\|DRR001012.377636_T1 | 5223 | 486 | 92.31 | glotblastn |
| 883 | LYM527 | rye\|12v1\|EH412084_T1 | 5226 | 486 | 92.31 | glotblastn |
| 884 | LYM527 | rye\|12v1\|EH412124_T1 | 5226 | 486 | 92.31 | glotblastn |
| 885 | LYM527 | oat\|11v1\|GR359014_T1 | 5227 | 486 | 92.31 | glotblastn |
| 886 | LYM527 | wheat\|10v2\|BE419814 | 5228 | 486 | 92.31 | glotblastn |
| 887 | LYM527 | wheat\|10v2\|BE428533 | 5229 | 486 | 92.31 | glotblastn |
| 888 | LYM527 | wheat\|10v2\|BF292824 | 5230 | 486 | 92.31 | glotblastn |
| 889 | LYM527 | wheat\|10v2\|BF293139 | 5228 | 486 | 92.31 | glotblastn |
| 890 | LYM527 | wheat\|10v2\|BF294036 | 5228 | 486 | 92.31 | glotblastn |
| 891 | LYM527 | rye\|12v1\|BE704771_T1 | 5231 | 486 | 91.03 | glotblastn |
| 892 | LYM527 | rye\|12v1\|DRR001012.1049_T1 | 5231 | 486 | 91.03 | glotblastn |
| 893 | LYM527 | rye\|12v1\|DRR001012.10929_T1 | 5232 | 486 | 91.03 | glotblastn |
| 894 | LYM527 | rye\|12v1\|DRR001012.114999_T1 | 5231 | 486 | 91.03 | glotblastn |
| 895 | LYM527 | rye\|12v1\|DRR001012.161872_T1 | 5231 | 486 | 91.03 | glotblastn |
| 896 | LYM527 | rye\|12v1\|EH412093_T1 | 5231 | 486 | 91.03 | glotblastn |
| 897 | LYM527 | rye\|gb164\|BE704771 | 5233 | 486 | 91.03 | glotblastn |
| 898 | LYM527 | cotton\|11v1\|BM359628_T1 | 5234 | 486 | 91.03 | glotblastn |
| 899 | LYM527 | wheat\|10v2\|BE638072 | 5235 | 486 | 91.03 | glotblastn |
| 900 | LYM527 | wheat\|10v2\|SRR043328S0000958 | 5236 | 486 | 91.03 | glotblastn |
| 901 | LYM527 | rye\|12v1\|DRR001012.13265_T1 | 5237 | 486 | 89.74 | glotblastn |
| 902 | LYM527 | rye\|12v1\|DRR001012.18866_T1 | 5238 | 486 | 89.74 | glotblastn |
| 903 | LYM527 | wheat\|10v2\|CK217440 | 5239 | 486 | 88.5 | globlastp |
| 904 | LYM527 | rye\|12v1\|DRR001012.187695_T1 | 5240 | 486 | 88.46 | glotblastn |
| 905 | LYM527 | wheat\|10v2\|CA696958 | 5241 | 486 | 88.46 | glotblastn |
| 906 | LYM527 | rye\|12v1\|DRR001012.310554_P1 | 5242 | 486 | 87.2 | globlastp |
| 907 | LYM527 | rye\|12v1\|DRR001013.2682_P1 | 5242 | 486 | 87.2 | globlastp |
| 908 | LYM527 | rye\|12v1\|DRR001012.10446_T1 | 5243 | 486 | 87.18 | glotblastn |
| 909 | LYM527 | rye\|12v1\|DRR001012.152110_T1 | 5244 | 486 | 87.18 | glotblastn |
| 910 | LYM527 | rye\|12v1\|EH412086_T1 | 5245 | 486 | 87.18 | glotblastn |
| 911 | LYM527 | rye\|12v1\|DRR001012.121076_T1 | 5246 | 486 | 85.9 | glotblastn |
| 912 | LYM527 | wheat\|10v2\|CA691317 | 5247 | 486 | 85.9 | globlastp |
| 913 | LYM527 | rye\|12v1\|DRR001012.15316_T1 | 5248 | 486 | 82.05 | glotblastn |
| 914 | LYM527 | foxtail_millet\|10v2\|FXTSLX00058120 | 5249 | 486 | 80.77 | glotblastn |
| 915 | LYM528 | wheat\|10v2\|BG907262 | 5250 | 487 | 97.2 | globlastp |
| 916 | LYM528 | wheat\|10v2\|BE405512 | 5251 | 487 | 93.4 | globlastp |
| 917 | LYM528 | leymus\|gb166\|EG384174_P1 | 5252 | 487 | 87.9 | globlastp |
| 918 | LYM528 | oat\|10v2\|GO592969 | 5253 | 487 | 85.8 | globlastp |
| 919 | LYM528 | oat\|11v1\|GO592969_P1 | 5253 | 487 | 85.8 | globlastp |
| 920 | LYM529 | wheat\|10v2\|CA685625 | 5254 | 488 | 95.7 | globlastp |
| 921 | LYM529 | brachypodium\|12v1\|BRADI3G55570_P1 | 5255 | 488 | 89 | globlastp |
| 922 | LYM529 | rice\|11v1\|BQ060183_P1 | 5256 | 488 | 88.1 | globlastp |
| 923 | LYM529 | rice\|gb170\|OS02G57420 | 5256 | 488 | 88.1 | globlastp |
| 924 | LYM529 | foxtail_millet\|11v3\|PHY7SI017278M_P1 | 5257 | 488 | 87 | globlastp |
| 925 | LYM529 | maize\|10v1\|BM072806_P1 | 5258 | 488 | 85.3 | globlastp |
| 926 | LYM529 | sorghum\|12v1\|SB04G037460_P1 | 5259 | 488 | 84.3 | globlastp |
| 927 | LYM529 | maize\|10v1\|BE025441_P1 | 5260 | 488 | 80 | globlastp |
| 928 | LYM530 | b_rapa\|11v1\|BRA040977_T1 | — | 489 | 100 | glotblastn |
| 928 | LYM745 | b_rapa\|11v1\|BRA040977_T1 | — | 687 | 94.18 | glotblastn |
| 928 | LYM721 | b_rapa\|11v1\|BRA040977_T1 | — | 728 | 91.23 | glotblastn |
| 929 | LYM530 | b_rapa\|11v1\|BRA040981_T1 | — | 489 | 100 | glotblastn |
| 929 | LYM721 | b_rapa\|11v1\|BRA040981_T1 | — | 728 | 91.23 | glotblastn |
| 929 | LYM745 | b_rapa\|11v1\|BRA040981_T1 | — | 733 | 95.63 | glotblastn |
| 930 | LYM530 | wheat\|10v2\|SRR043326S0076204 | — | 489 | 100 | glotblastn |
| 930 | LYM721 | wheat\|10v2\|SRR043326S0076204 | — | 728 | 91.23 | glotblastn |
| 931 | LYM530 | brachypodium\|09v1\|CRPBD006396 | 5261 | 489 | 93.94 | glotblastn |
| 932 | LYM530 | brachypodium\|09v1\|CRPBD004062 | 5262 | 489 | 92.4 | globlastp |
| 933 | LYM532 | pseudoroegneria\|gb167\|FF357444 | 5263 | 491 | 95.69 | glotblastn |
| 934 | LYM532 | leymus\|gb166\|EG374930_P1 | 5264 | 491 | 95.1 | globlastp |
| 935 | LYM532 | rye\|12v1\|DRR001012.66265_P1 | 5265 | 491 | 94.6 | globlastp |
| 936 | LYM532 | rye\|12v1\|DRR001017.1042346_P1 | 5266 | 491 | 94.3 | globlastp |
| 937 | LYM532 | wheat\|10v2\|BE470582 | 5267 | 491 | 94.1 | globlastp |
| 938 | LYM532 | oat\|11v1\|GR313652_P1 | 5268 | 491 | 86.6 | globlastp |
| 939 | LYM532 | oat\|10v2\|GR313652 | 5269 | 491 | 86.3 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 940 | LYM532 | sorghum\|09v1\|SB01G022490 | 5270 | 491 | 83.4 | globlastp |
| 941 | LYM532 | sorghum\|12v1\|SB01G022490_P1 | 5270 | 491 | 83.4 | globlastp |
| 942 | LYM532 | maize\|10v1\|CF273231_P1 | 5271 | 491 | 82.6 | globlastp |
| 943 | LYM532 | switchgrass\|gb167\|FE649610 | 5272 | 491 | 81.55 | glotblastn |
| 944 | LYM532 | wheat\|10v2\|BF485042 | 5273 | 491 | 81.55 | glotblastn |
| 945 | LYM532 | brachypodium\|12v1\|BRADI1G07560_P1 | 5274 | 491 | 81 | globlastp |
| 946 | LYM532 | leymus\|gb166\|EG397836_P1 | 5275 | 491 | 80.5 | globlastp |
| 947 | LYM532 | rye\|12v1\|DRR001012.201138_T1 | 5276 | 491 | 80.48 | glotblastn |
| 948 | LYM532 | brachypodium\|09v1\|DV475654 | 5277 | 491 | 80.43 | glotblastn |
| 949 | LYM532 | rye\|12v1\|DRR001012.14421_T1 | 5278 | 491 | 80.32 | glotblastn |
| 950 | LYM532 | rice\|11v1\|GFXAC083943X19_P1 | 5279 | 491 | 80.3 | globlastp |
| 951 | LYM533 | rye\|12v1\|DRR001012.410709_P1 | 5280 | 492 | 93.9 | globlastp |
| 952 | LYM533 | wheat\|10v2\|CJ808255 | 5280 | 492 | 93.9 | globlastp |
| 953 | LYM533 | wheat\|10v2\|CA646704 | 5281 | 492 | 92.4 | globlastp |
| 954 | LYM533 | rye\|12v1\|DRR001015.104637_T1 | 5282 | 492 | 89.39 | glotblastn |
| 955 | LYM533 | lolium\|10v1\|EB709728_T1 | 5283 | 492 | 84.85 | glotblastn |
| 956 | LYM533 | sorghum\|12v1\|SB10G030100_P1 | 5284 | 492 | 84.8 | globlastp |
| 957 | LYM533 | brachypodium\|09v1\|GT764798 | 5285 | 492 | 84.8 | globlastp |
| 958 | LYM533 | brachypodium\|12v1\|BRADI1G35150T2_P1 | 5285 | 492 | 84.8 | globlastp |
| 959 | LYM533 | sorghum\|09v1\|SB10G030100 | 5284 | 492 | 84.8 | globlastp |
| 960 | LYM533 | foxtail_millet\|11v3\|PHY7SI007768M_T1 | 5286 | 492 | 80.3 | glotblastn |
| 961 | LYM535 | wheat\|10v2\|BQ238549 | 5287 | 493 | 93.5 | globlastp |
| 962 | LYM535 | sugarcane\|10v1\|CA072504 | 5288 | 493 | 93.2 | globlastp |
| 963 | LYM535 | rye\|12v1\|BE494474_P1 | 5289 | 493 | 92.9 | globlastp |
| 964 | LYM535 | rye\|12v1\|DRR001012.234914_P1 | 5290 | 493 | 92.9 | globlastp |
| 965 | LYM535 | barley\|10v2\|BF625837_P1 | 5291 | 493 | 92.7 | globlastp |
| 966 | LYM535 | rice\|11v1\|BE040109_P1 | 5292 | 493 | 92.7 | globlastp |
| 967 | LYM535 | rice\|gb170\|OS01G55260 | 5292 | 493 | 92.7 | globlastp |
| 968 | LYM535 | sorghum\|09v1\|SB03G035010 | 5293 | 493 | 92.2 | globlastp |
| 969 | LYM535 | sorghum\|12v1\|SB03G035010_P1 | 5293 | 493 | 92.2 | globlastp |
| 970 | LYM535 | switchgrass\|gb167\|FE598871 | 5294 | 493 | 92 | globlastp |
| 971 | LYM535 | millet\|10v1\|EVO454PM140977_P1 | 5295 | 493 | 91.9 | globlastp |
| 972 | LYM535 | maize\|10v1\|AI600808_P1 | 5296 | 493 | 90.9 | globlastp |
| 973 | LYM535 | cenchrus\|gb166\|EB654148_P1 | 5297 | 493 | 90.4 | globlastp |
| 974 | LYM535 | switchgrass\|gb167\|FE644372 | 5298 | 493 | 90.4 | globlastp |
| 975 | LYM535 | foxtail_millet\|11v3\|PHY7SI004261M_P1 | 5299 | 493 | 90.2 | globlastp |
| 976 | LYM535 | foxtail_millet\|10v2\|FXTRMSLX01807035D1 | 5300 | 493 | 80.26 | glotblastn |
| 976 | LYM749 | foxtail_millet\|10v2\|FXTRMSLX01807035D1 | 5300 | 691 | 90.1 | glotblastn |
| 977 | LYM536 | rye\|12v1\|DRR001012.129728_T1 | 5301 | 494 | 82.14 | glotblastn |
| 978 | LYM536 | wheat\|10v2\|BQ619946 | 5302 | 494 | 81.6 | globlastp |
| 979 | LYM536 | barley\|10v2\|BE411384_P1 | 5303 | 494 | 80.6 | globlastp |
| 980 | LYM536 | oat\|11v1\|GR319739_P1 | 5304 | 494 | 80 | globlastp |
| 981 | LYM537 | rice\|11v1\|CB639228_P1 | 5305 | 495 | 90.9 | globlastp |
| 982 | LYM537 | sorghum\|09v1\|SB10G030970 | 5306 | 495 | 89.6 | globlastp |
| 983 | LYM537 | sorghum\|12v1\|SB10G030970_P1 | 5306 | 495 | 89.6 | globlastp |
| 984 | LYM537 | maize\|10v1\|AI600399_P1 | 5307 | 495 | 88.8 | globlastp |
| 985 | LYM537 | foxtail_millet\|11v3\|PHY7SI005663M_T1 | 5308 | 495 | 88.57 | glotblastn |
| 986 | LYM537 | rye\|12v1\|DRR001012.106165_P1 | 5309 | 495 | 87.2 | globlastp |
| 987 | LYM537 | foxtail_millet\|11v3\|PHY7SI016067M_P1 | 5310 | 495 | 85.3 | globlastp |
| 988 | LYM537 | rice\|11v1\|AI978287_P1 | 5311 | 495 | 84.9 | globlastp |
| 989 | LYM537 | brachypodium\|09v1\|DV477985 | 5312 | 495 | 84.2 | globlastp |
| 990 | LYM537 | brachypodium\|12v1\|BRADI3G60790_P1 | 5312 | 495 | 84.2 | globlastp |
| 991 | LYM537 | sorghum\|09v1\|SB04G038510 | 5313 | 495 | 84.2 | globlastp |
| 992 | LYM537 | sorghum\|12v1\|SB04G038510_P1 | 5314 | 495 | 84 | globlastp |
| 993 | LYM537 | rice\|gb170\|OS06G51270 | 5315 | 495 | 82.2 | globlastp |
| 994 | LYM537 | rye\|12v1\|DRR001012.102789_T1 | 5316 | 495 | 82.06 | glotblastn |
| 995 | LYM537 | rye\|12v1\|DRR001012.102994_T1 | 5317 | 495 | 81.65 | glotblastn |
| 996 | LYM538 | wheat\|10v2\|BF291937 | 5318 | 496 | 86.5 | globlastp |
| 997 | LYM538 | wheat\|10v2\|BE418784 | 5319 | 496 | 85 | globlastp |
| 998 | LYM538 | pseudoroegneria\|gb167\|FF344261 | 5320 | 496 | 84.1 | globlastp |
| 999 | LYM538 | rye\|12v1\|DRR001012.111995_T1 | 5321 | 496 | 84.02 | glotblastn |
| 1000 | LYM538 | millet\|10v1\|EB411076_P1 | 5322 | 496 | 84 | globlastp |
| 1001 | LYM538 | foxtail_millet\|11v3\|PHY7SI010206M_P1 | 5323 | 496 | 83.8 | globlastp |
| 1002 | LYM538 | barley\|10v2\|BF623862_P1 | 5324 | 496 | 83.7 | globlastp |
| 1003 | LYM538 | switchgrass\|gb167\|FE600126 | 5325 | 496 | 83.2 | globlastp |
| 1004 | LYM538 | sorghum\|09v1\|SB06G019430 | 5326 | 496 | 81.3 | globlastp |
| 1005 | LYM538 | sorghum\|12v1\|SB06G019430_P1 | 5326 | 496 | 81.3 | globlastp |
| 1006 | LYM538 | maize\|10v1\|AW018143_P1 | 5327 | 496 | 81.2 | globlastp |
| 1007 | LYM538 | rice\|11v1\|AA749562_P1 | 5328 | 496 | 81.1 | globlastp |
| 1008 | LYM538 | rice\|gb170\|OS04G39270 | 5329 | 496 | 81.09 | glotblastn |
| 1009 | LYM539 | rye\|12v1\|DRR001012.102635_P1 | 5330 | 497 | 87.5 | globlastp |
| 1010 | LYM539 | rice\|gb170\|OS09G21230 | 5331 | 497 | 86.26 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1011 | LYM539 | foxtail_millet\|11v3\|PHY7SI029298M_P1 | 5332 | 497 | 86.1 | globlastp |
| 1012 | LYM539 | rice\|11v1\|BI805208_P1 | 5333 | 497 | 86 | globlastp |
| 1013 | LYM539 | sorghum\|09v1\|SB02G023690 | 5334 | 497 | 85.1 | globlastp |
| 1014 | LYM539 | switchgrass\|gb167\|FL712273 | 5335 | 497 | 85 | globlastp |
| 1015 | LYM539 | sorghum\|12v1\|SB02G023690_P1 | 5336 | 497 | 84.8 | globlastp |
| 1016 | LYM539 | millet\|10v1\|EVO454PM001443_P1 | 5337 | 497 | 84.5 | globlastp |
| 1017 | LYM539 | maize\|10v1\|AI987500_P1 | 5338 | 497 | 83.6 | globlastp |
| 1018 | LYM540 | switchgrass\|gb167\|FE614537 | 5339 | 498 | 93.4 | globlastp |
| 1019 | LYM540 | switchgrass\|gb167\|FE619568 | 5340 | 498 | 90.5 | globlastp |
| 1020 | LYM540 | sorghum\|09v1\|SB06G032600 | 5341 | 498 | 88.2 | globlastp |
| 1021 | LYM540 | sorghum\|12v1\|SB06G032600_P1 | 5341 | 498 | 88.2 | globlastp |
| 1022 | LYM540 | cynodon\|10v1\|ES292366_P1 | 5342 | 498 | 87.2 | globlastp |
| 1023 | LYM540 | sugarcane\|10v1\|CA092460 | 5343 | 498 | 86.5 | globlastp |
| 1024 | LYM540 | leymus\|gb166\|EG394000_P1 | 5344 | 498 | 83.1 | globlastp |
| 1025 | LYM540 | wheat\|10v2\|BF484005 | 5345 | 498 | 83 | globlastp |
| 1026 | LYM540 | wheat\|10v2\|BG904388 | 5346 | 498 | 82.6 | globlastp |
| 1027 | LYM540 | rye\|12v1\|DRR001012.306230_P1 | 5347 | 498 | 82.3 | globlastp |
| 1028 | LYM540 | rye\|12v1\|DRR001012.283400_P1 | 5348 | 498 | 81.8 | globlastp |
| 1029 | LYM540 | oat\|10v2\|GR356404 | 5349 | 498 | 81.7 | globlastp |
| 1030 | LYM540 | oat\|11v1\|GR356404_P1 | 5349 | 498 | 81.7 | globlastp |
| 1031 | LYM540 | brachypodium\|09v1\|GT808574 | 5350 | 498 | 81.1 | globlastp |
| 1032 | LYM540 | brachypodium\|12v1\|BRADI5G25860_P1 | 5350 | 498 | 81.1 | globlastp |
| 1033 | LYM540 | barley\|10v2\|BI947806_P1 | 5351 | 498 | 80.9 | globlastp |
| 1034 | LYM540 | rye\|12v1\|DRR001012.34995_T1 | 5352 | 498 | 80.68 | glotblastn |
| 1035 | LYM540 | sugarcane\|10v1\|CF571505 | 5353 | 498 | 80.61 | glotblastn |
| 1036 | LYM543 | switchgrass\|gb167\|FL787260 | 5354 | 500 | 99.1 | globlastp |
| 1037 | LYM543 | switchgrass\|gb167\|FE599325 | 5355 | 500 | 98.1 | globlastp |
| 1038 | LYM543 | switchgrass\|gb167\|DN152239 | 5356 | 500 | 97.2 | globlastp |
| 1039 | LYM543 | rice\|11v1\|AA750424_P1 | 5357 | 500 | 96.8 | globlastp |
| 1040 | LYM543 | rice\|gb170\|BI795073 | 5357 | 500 | 96.8 | globlastp |
| 1041 | LYM543 | rice\|gb170\|OS08G44450 | 5358 | 500 | 96.8 | globlastp |
| 1042 | LYM543 | switchgrass\|gb167\|DN142407 | 5359 | 500 | 96.8 | globlastp |
| 1043 | LYM543 | switchgrass\|gb167\|FE608046 | 5359 | 500 | 96.8 | globlastp |
| 1044 | LYM543 | switchgrass\|gb167\|FE645014 | 5359 | 500 | 96.8 | globlastp |
| 1045 | LYM543 | rice\|11v1\|AF093786_T1 | — | 500 | 96.76 | glotblastn |
| 1046 | LYM543 | foxtail_millet\|10v2\|OXFXTRMSLX00171177D2T1 | 5360 | 500 | 96.3 | globlastp |
| 1047 | LYM543 | sugarcane\|10v1\|BQ529961 | 5361 | 500 | 96.3 | globlastp |
| 1048 | LYM543 | sugarcane\|10v1\|BQ537074 | 5361 | 500 | 96.3 | globlastp |
| 1049 | LYM543 | sorghum\|09v1\|SB07G024200 | 5362 | 500 | 95.8 | globlastp |
| 1050 | LYM543 | sorghum\|12v1\|SB07G024200_P1 | 5362 | 500 | 95.8 | globlastp |
| 1051 | LYM543 | sorghum\|09v1\|SB07G024210 | 5362 | 500 | 95.8 | globlastp |
| 1052 | LYM543 | sorghum\|12v1\|SB07G024210_P1 | 5362 | 500 | 95.8 | globlastp |
| 1053 | LYM543 | maize\|10v1\|T70669_P1 | 5363 | 500 | 94.4 | globlastp |
| 1054 | LYM543 | millet\|10v1\|EVO454PM000449_P1 | 5364 | 500 | 94.4 | globlastp |
| 1055 | LYM543 | millet\|10v1\|EVO454PM005384_P1 | 5364 | 500 | 94.4 | globlastp |
| 1056 | LYM543 | millet\|10v1\|EVO454PM447766_P1 | 5364 | 500 | 94.4 | globlastp |
| 1057 | LYM543 | brachypodium\|09v1\|DV471443 | 5365 | 500 | 93.5 | globlastp |
| 1058 | LYM543 | brachypodium\|12v1\|BRADI4G38510_P1 | 5365 | 500 | 93.5 | globlastp |
| 1059 | LYM543 | barley\|10v2\|BF257610_P1 | 5366 | 500 | 93.1 | globlastp |
| 1060 | LYM543 | cynodon\|10v1\|ES292982_P1 | 5367 | 500 | 93.1 | globlastp |
| 1061 | LYM543 | leymus\|gb166\|EG375129_P1 | 5368 | 500 | 93.1 | globlastp |
| 1062 | LYM543 | maize\|10v1\|AI615083_P1 | 5369 | 500 | 93.1 | globlastp |
| 1063 | LYM543 | pseudoroegneria\|gb167\|FF350081 | 5370 | 500 | 93.1 | globlastp |
| 1064 | LYM543 | oat\|11v1\|GO590662_P1 | 5371 | 500 | 92.6 | globlastp |
| 1065 | LYM543 | leymus\|gb166\|EG377276_P1 | 5372 | 500 | 92.6 | globlastp |
| 1066 | LYM543 | pineapple\|10v1\|CO731145_P1 | 5373 | 500 | 92.6 | globlastp |
| 1067 | LYM543 | wheat\|10v2\|BE498290 | 5374 | 500 | 92.6 | globlastp |
| 1068 | LYM543 | rye\|12v1\|DRR001012.553513_T1 | 5375 | 500 | 92.13 | glotblastn |
| 1069 | LYM543 | maize\|10v1\|GRMZM2G170561T01_T1 | 5376 | 500 | 92.13 | glotblastn |
| 1070 | LYM543 | rye\|12v1\|BE493774_P1 | 5377 | 500 | 92.1 | globlastp |
| 1071 | LYM543 | rye\|12v1\|BG263898_P1 | 5377 | 500 | 92.1 | globlastp |
| 1072 | LYM543 | rye\|12v1\|DRR001013.111633_P1 | 5377 | 500 | 92.1 | globlastp |
| 1073 | LYM543 | rye\|12v1\|DRR001013.12149_P1 | 5377 | 500 | 92.1 | globlastp |
| 1074 | LYM543 | rye\|12v1\|DRR001013.136831_P1 | 5377 | 500 | 92.1 | globlastp |
| 1075 | LYM543 | banana\|10v1\|BBS1965T3_P1 | 5378 | 500 | 92.1 | globlastp |
| 1076 | LYM543 | oat\|10v2\|GO584775 | 5379 | 500 | 92.1 | globlastp |
| 1077 | LYM543 | oat\|11v1\|GO590593_P1 | 5379 | 500 | 92.1 | globlastp |
| 1078 | LYM543 | oat\|10v2\|GO590662 | 5379 | 500 | 92.1 | globlastp |
| 1079 | LYM543 | oat\|11v1\|GR332001_P1 | 5379 | 500 | 92.1 | globlastp |
| 1080 | LYM543 | wheat\|10v2\|BE399095 | 5380 | 500 | 92.1 | globlastp |
| 1081 | LYM543 | banana\|10v1\|BBS2029T3_P1 | 5381 | 500 | 91.7 | globlastp |
| 1082 | LYM543 | banana\|10v1\|BBS3197T3_P1 | 5381 | 500 | 91.7 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1083 | LYM543 | banana\|10v1\|FF560632_P1 | 5382 | 500 | 91.7 | globlastp |
| 1084 | LYM543 | maize\|10v1\|DW846793_T1 | 5383 | 500 | 91.67 | glotblastn |
| 1085 | LYM543 | rice\|11v1\|BE228235_P1 | 5384 | 500 | 91.2 | globlastp |
| 1086 | LYM543 | rye\|12v1\|BF145257_P1 | 5385 | 500 | 91.2 | globlastp |
| 1087 | LYM543 | barley\|10v2\|BI950625_P1 | 5386 | 500 | 91.2 | globlastp |
| 1088 | LYM543 | wheat\|10v2\|BE405698 | 5386 | 500 | 91.2 | globlastp |
| 1089 | LYM543 | wheat\|10v2\|BE637952 | 5386 | 500 | 91.2 | globlastp |
| 1090 | LYM543 | wheat\|10v2\|BE638076 | 5386 | 500 | 91.2 | globlastp |
| 1091 | LYM543 | wheat\|10v2\|CD905356 | 5386 | 500 | 91.2 | globlastp |
| 1092 | LYM543 | maize\|10v1\|AI861331_T1 | 5387 | 500 | 90.74 | glotblastn |
| 1093 | LYM543 | amorphophallus\|11v2\|SRR089351X113366_P1 | 5388 | 500 | 90.7 | globlastp |
| 1094 | LYM543 | oil_palm\|gb166\|CN600379 | 5389 | 500 | 90.7 | globlastp |
| 1095 | LYM543 | oil_palm\|gb166\|EL681363 | 5390 | 500 | 90.7 | globlastp |
| 1096 | LYM543 | wheat\|10v2\|CA673311 | 5391 | 500 | 90.7 | globlastp |
| 1097 | LYM543 | distylium\|11v1\|SRR065077X101573_P1 | 5392 | 500 | 90.3 | globlastp |
| 1098 | LYM543 | kiwi\|gb166\|FG418372_P1 | 5393 | 500 | 90.3 | globlastp |
| 1099 | LYM543 | pseudoroegneria\|gb167\|FF347130 | 5394 | 500 | 90.3 | globlastp |
| 1100 | LYM543 | phalaenopsis\|11v1\|SRR125771.1033372_T1 | 5395 | 500 | 90.28 | glotblastn |
| 1101 | LYM543 | maize\|10v1\|DW916030_T1 | 5396 | 500 | 90.28 | glotblastn |
| 1102 | LYM543 | wheat\|10v2\|CA662666 | 5397 | 500 | 90.28 | glotblastn |
| 1103 | LYM543 | lovegrass\|gb167\|EH185205_T1 | 5398 | 500 | 89.81 | glotblastn |
| 1104 | LYM543 | chelidonium\|11v1\|SRR084752X100908_P1 | 5399 | 500 | 89.8 | globlastp |
| 1105 | LYM543 | chelidonium\|11v1\|SRR084752X101815_P1 | 5400 | 500 | 89.8 | globlastp |
| 1106 | LYM543 | oat\|11v1\|GO581903_P1 | 5401 | 500 | 89.8 | globlastp |
| 1107 | LYM543 | oil_palm\|11v1\|EE593325_P1 | 5402 | 500 | 89.8 | globlastp |
| 1108 | LYM543 | rice\|11v1\|AF093786_P1 | 5403 | 500 | 89.8 | globlastp |
| 1109 | LYM543 | aristolochia\|10v1\|SRR039082S0070766_P1 | 5404 | 500 | 89.8 | globlastp |
| 1110 | LYM543 | brachypodium\|09v1\|DV474207 | 5405 | 500 | 89.8 | globlastp |
| 1111 | LYM543 | brachypodium\|12v1\|BRADI3G42800T6_P1 | 5405 | 500 | 89.8 | globlastp |
| 1112 | LYM543 | nuphar\|gb166\|CK747559_P1 | 5406 | 500 | 89.8 | globlastp |
| 1113 | LYM543 | oat\|10v2\|CK780248 | 5401 | 500 | 89.8 | globlastp |
| 1114 | LYM543 | oil_palm\|gb166\|EE593325 | 5402 | 500 | 89.8 | globlastp |
| 1115 | LYM543 | rice\|11v1\|AA750592_P1 | 5407 | 500 | 89.8 | globlastp |
| 1116 | LYM543 | rice\|gb170\|OS02G21660 | 5407 | 500 | 89.8 | globlastp |
| 1117 | LYM543 | oat\|11v1\|CK780248_P1 | 5401 | 500 | 89.8 | globlastp |
| 1118 | LYM543 | humulus\|11v1\|GD242898_P1 | 5408 | 500 | 89.4 | globlastp |
| 1119 | LYM543 | maritime_pine\|10v1\|AL751307_P1 | 5409 | 500 | 89.4 | globlastp |
| 1120 | LYM543 | oil_palm\|11v1\|EY396835_P1 | 5410 | 500 | 89.4 | globlastp |
| 1121 | LYM543 | phalaenopsis\|11v1\|SRR125771.1004556_P1 | 5411 | 500 | 89.4 | globlastp |
| 1122 | LYM543 | sarracenia\|11v1\|SRR192669.103979_P1 | 5412 | 500 | 89.4 | globlastp |
| 1123 | LYM543 | spruce\|11v1\|ES245127_P1 | 5413 | 500 | 89.4 | globlastp |
| 1124 | LYM543 | spruce\|11v1\|EX347615_P1 | 5413 | 500 | 89.4 | globlastp |
| 1125 | LYM543 | tabernaemontana\|11v1\|SRR098689X11504_P1 | 5414 | 500 | 89.4 | globlastp |
| 1126 | LYM543 | avocado\|10v1\|CK748264_P1 | 5415 | 500 | 89.4 | globlastp |
| 1127 | LYM543 | ginseng\|10v1\|CN848206_P1 | 5416 | 500 | 89.4 | globlastp |
| 1128 | LYM543 | peanut\|10v1\|EE124950_P1 | 5417 | 500 | 89.4 | globlastp |
| 1129 | LYM543 | pine\|10v2\|AA556310_P1 | 5409 | 500 | 89.4 | globlastp |
| 1130 | LYM543 | pseudotsuga\|10v1\|SRR065119S0005295 | 5418 | 500 | 89.4 | globlastp |
| 1131 | LYM543 | soybean\|11v1\|GLYMA19G37980 | 5419 | 500 | 89.4 | globlastp |
| 1132 | LYM543 | spruce\|11v1\|EX350063_P1 | 5413 | 500 | 89.4 | globlastp |
| 1133 | LYM543 | spruce\|gb162\|CO230273 | 5413 | 500 | 89.4 | globlastp |
| 1134 | LYM543 | abies\|11v2\|SRR098676X106955_T1 | 5420 | 500 | 89.35 | glotblastn |
| 1135 | LYM543 | spruce\|11v1\|DR542779_T1 | 5421 | 500 | 89.35 | glotblastn |
| 1136 | LYM543 | oil_palm\|11v1\|EL691247_P1 | 5422 | 500 | 88.9 | globlastp |
| 1137 | LYM543 | phyla\|11v2\|SRR099035X104155_P1 | 5423 | 500 | 88.9 | globlastp |
| 1138 | LYM543 | poppy\|11v1\|FE964822_P1 | 5424 | 500 | 88.9 | globlastp |
| 1139 | LYM543 | aristolochia\|10v1\|SRR039082S0135731_P1 | 5425 | 500 | 88.9 | globlastp |
| 1140 | LYM543 | cacao\|10v1\|CF972749_P1 | 5426 | 500 | 88.9 | globlastp |
| 1141 | LYM543 | cyamopsis\|10v1\|EG977006_P1 | 5427 | 500 | 88.9 | globlastp |
| 1142 | LYM543 | cycas\|gb166\|CB089948_P1 | 5428 | 500 | 88.9 | globlastp |
| 1143 | LYM543 | ginseng\|10v1\|EW712050_P1 | 5429 | 500 | 88.9 | globlastp |
| 1144 | LYM543 | leymus\|gb166\|CN466494_P1 | 5430 | 500 | 88.9 | globlastp |
| 1145 | LYM543 | liquorice\|gb171\|FS239671_P1 | 5431 | 500 | 88.9 | globlastp |
| 1146 | LYM543 | liquorice\|gb171\|FS239752_P1 | 5431 | 500 | 88.9 | globlastp |
| 1147 | LYM543 | liriodendron\|gb166\|CK753392_P1 | 5432 | 500 | 88.9 | globlastp |
| 1148 | LYM543 | nuphar\|gb166\|CD474021_P1 | 5433 | 500 | 88.9 | globlastp |
| 1149 | LYM543 | oat\|10v2\|CN816132 | 5434 | 500 | 88.9 | globlastp |
| 1150 | LYM543 | sorghum\|09v1\|SB03G040550 | 5435 | 500 | 88.9 | globlastp |
| 1151 | LYM543 | sorghum\|12v1\|SB03G040550_P1 | 5435 | 500 | 88.9 | globlastp |
| 1152 | LYM543 | sugarcane\|10v1\|AA577661 | 5435 | 500 | 88.9 | globlastp |
| 1153 | LYM543 | zamia\|gb166\|DY031878 | 5436 | 500 | 88.9 | globlastp |
| 1154 | LYM543 | eschscholzia\|11v1\|CK750888_P1 | 5437 | 500 | 88.9 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1155 | LYM543 | amorphophallus\|11v2\|SRR089351X100060_T1 | 5438 | 500 | 88.89 | glotblastn |
| 1156 | LYM543 | primula\|11v1\|SRR098679X104520_T1 | 5439 | 500 | 88.89 | glotblastn |
| 1157 | LYM543 | tabernaemontana\|11v1\|SRR098689X122189_P1 | 5440 | 500 | 88.5 | globlastp |
| 1158 | LYM543 | citrus\|gb166\|CB304385 | 5441 | 500 | 88.5 | globlastp |
| 1159 | LYM543 | lovegrass\|gb167\|EH193399_T1 | 5442 | 500 | 88.43 | glotblastn |
| 1160 | LYM543 | millet\|10v1\|EVO454PM077721_T1 | 5443 | 500 | 88.43 | glotblastn |
| 1161 | LYM543 | bupleurum\|11v1\|SRR301254.11858_P1 | 5444 | 500 | 88.4 | globlastp |
| 1162 | LYM543 | catharanthus\|11v1\|EG562566_P1 | 5445 | 500 | 88.4 | globlastp |
| 1163 | LYM543 | cedrus\|11v1\|SRR065007X109999_P1 | 5446 | 500 | 88.4 | globlastp |
| 1164 | LYM543 | cotton\|11v1\|AI725849_P1 | 5447 | 500 | 88.4 | globlastp |
| 1165 | LYM543 | gossypium_raimondii\|12v1\|AI725849_P1 | 5447 | 500 | 88.4 | globlastp |
| 1166 | LYM543 | olea\|11v1\|SRR014463.11312_P1 | 5448 | 500 | 88.4 | globlastp |
| 1167 | LYM543 | platanus\|11v1\|SRR096786X120035_P1 | 5449 | 500 | 88.4 | globlastp |
| 1168 | LYM543 | poppy\|11v1\|SRR030259.101622_P1 | 5450 | 500 | 88.4 | globlastp |
| 1169 | LYM543 | poppy\|11v1\|SRR030259.115832_P1 | 5451 | 500 | 88.4 | globlastp |
| 1170 | LYM543 | poppy\|11v1\|SRR030259.210198_P1 | 5451 | 500 | 88.4 | globlastp |
| 1171 | LYM543 | poppy\|11v1\|SRR096789.100157_P1 | 5450 | 500 | 88.4 | globlastp |
| 1172 | LYM543 | pteridium\|11v1\|SRR043594X105469_P1 | 5452 | 500 | 88.4 | globlastp |
| 1173 | LYM543 | sarracenia\|11v1\|SRR192669.101116_P1 | 5453 | 500 | 88.4 | globlastp |
| 1174 | LYM543 | thalictrum\|11v1\|SRR096787X103466_P1 | 5454 | 500 | 88.4 | globlastp |
| 1175 | LYM543 | cryptomeria\|gb166\|BJ937459_P1 | 5455 | 500 | 88.4 | globlastp |
| 1176 | LYM543 | medicago\|09v1\|LLES610908 | 5456 | 500 | 88.4 | globlastp |
| 1177 | LYM543 | medicago\|12v1\|ES610908_P1 | 5456 | 500 | 88.4 | globlastp |
| 1178 | LYM543 | papaya\|gb165\|EX249851_P1 | 5457 | 500 | 88.4 | globlastp |
| 1179 | LYM543 | soybean\|11v1\|GLYMA12G31040 | 5458 | 500 | 88.4 | globlastp |
| 1180 | LYM543 | soybean\|11v1\|GLYMA13G39270 | 5459 | 500 | 88.4 | globlastp |
| 1181 | LYM543 | eschscholzia\|11v1\|CK766388_P1 | 5460 | 500 | 88.4 | globlastp |
| 1182 | LYM543 | catharanthus\|11v1\|EG558011_T1 | 5461 | 500 | 88.02 | glotblastn |
| 1183 | LYM543 | amsonia\|11v1\|SRR098688X104577_P1 | 5462 | 500 | 88 | globlastp |
| 1184 | LYM543 | beet\|12v1\|BI643115_P1 | 5463 | 500 | 88 | globlastp |
| 1185 | LYM543 | canola\|11v1\|DW998678_P1 | 5464 | 500 | 88 | globlastp |
| 1186 | LYM543 | cephalotaxus\|11v1\|SRR064395X151698_P1 | 5465 | 500 | 88 | globlastp |
| 1187 | LYM543 | cotton\|11v1\|AI726853_P1 | 5466 | 500 | 88 | globlastp |
| 1188 | LYM543 | cotton\|11v1\|BF270789_P1 | 5466 | 500 | 88 | globlastp |
| 1189 | LYM543 | cotton\|11v1\|CO084076_P1 | 5467 | 500 | 88 | globlastp |
| 1190 | LYM543 | eschscholzia\|11v1\|CD477238_P1 | 5468 | 500 | 88 | globlastp |
| 1191 | LYM543 | eschscholzia\|11v1\|CD478319_P1 | 5468 | 500 | 88 | globlastp |
| 1192 | LYM543 | eucalyptus\|11v2\|CU396236_P1 | 5469 | 500 | 88 | globlastp |
| 1193 | LYM543 | fagopyrum\|11v1\|SRR063689X107500_P1 | 5470 | 500 | 88 | globlastp |
| 1194 | LYM543 | fraxinus\|11v1\|SRR058827.117586_P1 | 5471 | 500 | 88 | globlastp |
| 1195 | LYM543 | gossypium_raimondii\|12v1\|AI726853_P1 | 5466 | 500 | 88 | globlastp |
| 1196 | LYM543 | gossypium_raimondii\|12v1\|BE054773_P1 | 5466 | 500 | 88 | globlastp |
| 1197 | LYM543 | gossypium_raimondii\|12v1\|BF270789_P1 | 5466 | 500 | 88 | globlastp |
| 1198 | LYM543 | olea\|11v1\|SRR014463.18658_P1 | 5472 | 500 | 88 | globlastp |
| 1199 | LYM543 | poppy\|11v1\|FE964490_P1 | 5473 | 500 | 88 | globlastp |
| 1200 | LYM543 | poppy\|11v1\|FG611847_P1 | 5474 | 500 | 88 | globlastp |
| 1201 | LYM543 | scabiosa\|11v1\|SRR063723X10991_P1 | 5475 | 500 | 88 | globlastp |
| 1202 | LYM543 | thellungiella_halophilum\|11v1\|DN774728_P1 | 5476 | 500 | 88 | globlastp |
| 1203 | LYM543 | antirrhinum\|gb166\|AJ560015_P1 | 5477 | 500 | 88 | globlastp |
| 1204 | LYM543 | b_juncea\|10v2\|E6ANDIZ01BL5SP_P1 | 5464 | 500 | 88 | globlastp |
| 1205 | LYM543 | b_rapa\|11v1\|H74781_P1 | 5464 | 500 | 88 | globlastp |
| 1206 | LYM543 | b_rapa\|gb162\|CX267538 | 5464 | 500 | 88 | globlastp |
| 1207 | LYM543 | basilicum\|10v1\|DY325036_P1 | 5478 | 500 | 88 | globlastp |
| 1208 | LYM543 | beet\|gb162\|BI643115 | 5463 | 500 | 88 | globlastp |
| 1209 | LYM543 | canola\|10v1\|DW998678 | 5464 | 500 | 88 | globlastp |
| 1210 | LYM543 | canola\|11v1\|EE480861_P1 | 5464 | 500 | 88 | globlastp |
| 1211 | LYM543 | canola\|10v1\|H74781 | 5464 | 500 | 88 | globlastp |
| 1212 | LYM543 | canola\|11v1\|AI352956_P1 | 5464 | 500 | 88 | globlastp |
| 1213 | LYM543 | catharanthus\|gb166\|EG558011 | 5479 | 500 | 88 | globlastp |
| 1214 | LYM543 | cenchrus\|gb166\|EB654688_P1 | 5480 | 500 | 88 | globlastp |
| 1215 | LYM543 | clementine\|11v1\|CB304385_P1 | 5481 | 500 | 88 | globlastp |
| 1216 | LYM543 | cotton\|10v2\|BE054773 | 5467 | 500 | 88 | globlastp |
| 1217 | LYM543 | cotton\|11v1\|BE054773XX1_P1 | 5466 | 500 | 88 | globlastp |
| 1218 | LYM543 | cotton\|10v2\|DT050220 | 5482 | 500 | 88 | globlastp |
| 1219 | LYM543 | cotton\|10v2\|OXDN779325T1 | 5466 | 500 | 88 | globlastp |
| 1220 | LYM543 | cotton\|11v1\|DN779325_P1 | 5466 | 500 | 88 | globlastp |
| 1221 | LYM543 | cowpea\|gb166\|FC459154_P1 | 5483 | 500 | 88 | globlastp |
| 1222 | LYM543 | eucalyptus\|11v1\|CU396236 | 5469 | 500 | 88 | globlastp |
| 1223 | LYM543 | fern\|gb171\|DK950017_P1 | 5484 | 500 | 88 | globlastp |
| 1224 | LYM543 | grape\|gb160\|BQ793957 | 5485 | 500 | 88 | globlastp |
| 1225 | LYM543 | grape\|11v1\|GSVIVT01033841001_P1 | 5486 | 500 | 88 | globlastp |
| 1226 | LYM543 | grape\|gb160\|BQ796293 | 5486 | 500 | 88 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1227 | LYM543 | heritiera\|10v1\|SRR005794S0003479_P1 | 5487 | 500 | 88 | globlastp |
| 1228 | LYM543 | lolium\|10v1\|AU249969_P1 | 5488 | 500 | 88 | globlastp |
| 1229 | LYM543 | orange\|11v1\|CB304385_P1 | 5481 | 500 | 88 | globlastp |
| 1230 | LYM543 | peanut\|10v1\|CX128153_P1 | 5489 | 500 | 88 | globlastp |
| 1231 | LYM543 | peanut\|10v1\|ES490866_P1 | 5489 | 500 | 88 | globlastp |
| 1232 | LYM543 | petunia\|gb171\|CV298098_P1 | 5490 | 500 | 88 | globlastp |
| 1233 | LYM543 | podocarpus\|10v1\|SRR065014S0012085_P1 | 5491 | 500 | 88 | globlastp |
| 1234 | LYM543 | poppy\|gb166\|FE964490 | 5473 | 500 | 88 | globlastp |
| 1235 | LYM543 | radish\|gb164\|EV525197 | 5492 | 500 | 88 | globlastp |
| 1236 | LYM543 | thellungiella\|gb167\|DN774728 | 5476 | 500 | 88 | globlastp |
| 1237 | LYM543 | fraxinus\|11v1\|SRR058827.142875_T1 | 5493 | 500 | 87.96 | glotblastn |
| 1238 | LYM543 | monkeyflower\|10v1\|DV206223_T1 | 5494 | 500 | 87.96 | glotblastn |
| 1239 | LYM543 | coffea\|10v1\|DV663604_P1 | 5495 | 500 | 87.6 | globlastp |
| 1240 | LYM543 | radish\|gb164\|EV526659 | 5496 | 500 | 87.6 | globlastp |
| 1241 | LYM543 | cotton\|11v1\|DW226888_P1 | 5497 | 500 | 87.5 | globlastp |
| 1242 | LYM543 | euonymus\|11v1\|SRR070038X114371_P1 | 5498 | 500 | 87.5 | globlastp |
| 1243 | LYM543 | euonymus\|11v1\|SRR070038X190637_P1 | 5498 | 500 | 87.5 | globlastp |
| 1244 | LYM543 | foxtail_millet\|11v3\|EC613830_P1 | 5499 | 500 | 87.5 | globlastp |
| 1245 | LYM543 | primula\|11v1\|SRR098679X113048_P1 | 5500 | 500 | 87.5 | globlastp |
| 1246 | LYM543 | rye\|12v1\|DRR001012.383124_T1 | 5501 | 500 | 87.5 | glotblastn |
| 1247 | LYM543 | thellungiella_halophilum\|11v1\|DN774951_P1 | 5502 | 500 | 87.5 | globlastp |
| 1248 | LYM543 | tripterygium\|11v1\|SRR098677X110207_P1 | 5503 | 500 | 87.5 | globlastp |
| 1249 | LYM543 | utricularia\|11v1\|SRR094438.102473_T1 | 5504 | 500 | 87.5 | glotblastn |
| 1250 | LYM543 | bean\|12v1\|AF293406_P1 | 5505 | 500 | 87.5 | globlastp |
| 1251 | LYM543 | bean\|gb167\|AF293406 | 5505 | 500 | 87.5 | globlastp |
| 1252 | LYM543 | cenchrus\|gb166\|BQ479113_P1 | 5506 | 500 | 87.5 | globlastp |
| 1253 | LYM543 | cotton\|10v2\|BG441535 | 5497 | 500 | 87.5 | globlastp |
| 1254 | LYM543 | cucumber\|09v1\|CK085743_P1 | 5507 | 500 | 87.5 | globlastp |
| 1255 | LYM543 | ipomoea_nil\|10v1\|BJ559365_P1 | 5508 | 500 | 87.5 | globlastp |
| 1256 | LYM543 | leymus\|gb166\|EG376201_P1 | 5509 | 500 | 87.5 | globlastp |
| 1257 | LYM543 | maize\|10v1\|AI619095_P1 | 5510 | 500 | 87.5 | globlastp |
| 1258 | LYM543 | melon\|10v1\|DV631956_P1 | 5507 | 500 | 87.5 | globlastp |
| 1259 | LYM543 | millet\|10v1\|EVO454PM022936_P1 | 5511 | 500 | 87.5 | globlastp |
| 1260 | LYM543 | momordica\|10v1\|SRR071315S0005611_P1 | 5512 | 500 | 87.5 | globlastp |
| 1261 | LYM543 | monkeyflower\|10v1\|DV206299_P1 | 5513 | 500 | 87.5 | globlastp |
| 1262 | LYM543 | nasturtium\|10v1\|SRR032558S0007114 | 5514 | 500 | 87.5 | globlastp |
| 1263 | LYM543 | nasturtium\|11v1\|SRR032558.101084_P1 | 5514 | 500 | 87.5 | globlastp |
| 1264 | LYM543 | orobanche\|10v1\|SRR023189S0001673_P1 | 5515 | 500 | 87.5 | globlastp |
| 1265 | LYM543 | petunia\|gb171\|CV294332_P1 | 5516 | 500 | 87.5 | globlastp |
| 1266 | LYM543 | petunia\|gb171\|CV299939_P1 | 5517 | 500 | 87.5 | globlastp |
| 1267 | LYM543 | sequoia\|10v1\|SRR065044S0003631 | 5518 | 500 | 87.5 | globlastp |
| 1268 | LYM543 | taxus\|10v1\|SRR032523S0015691 | 5519 | 500 | 87.5 | glotblastn |
| 1269 | LYM543 | thellungiella\|gb167\|DN774951 | 5502 | 500 | 87.5 | globlastp |
| 1270 | LYM543 | amsonia\|11v1\|SRR098688X106132_P1 | 5520 | 500 | 87.3 | globlastp |
| 1271 | LYM543 | vinca\|11v1\|SRR098690X102336_P1 | 5521 | 500 | 87.2 | globlastp |
| 1272 | LYM543 | vinca\|11v1\|SRR098690X107812_P1 | 5521 | 500 | 87.2 | globlastp |
| 1273 | LYM543 | valeriana\|11v1\|SRR099039X101941_P1 | 5522 | 500 | 87.1 | globlastp |
| 1274 | LYM543 | valeriana\|11v1\|SRR099039X111375_P1 | 5522 | 500 | 87.1 | globlastp |
| 1275 | LYM543 | b_juncea\|10v2\|E6ANDIZ01APK40_P1 | 5523 | 500 | 87.1 | globlastp |
| 1276 | LYM543 | b_juncea\|10v2\|E6ANDIZ01BBR0O_P1 | 5524 | 500 | 87.1 | globlastp |
| 1277 | LYM543 | b_oleracea\|gb161\|DY025831_P1 | 5525 | 500 | 87.1 | globlastp |
| 1278 | LYM543 | b_rapa\|gb162\|ES937363 | 5526 | 500 | 87.1 | globlastp |
| 1279 | LYM543 | canola\|10v1\|CD816651 | 5526 | 500 | 87.1 | globlastp |
| 1280 | LYM543 | canola\|11v1\|EE464344_P1 | 5526 | 500 | 87.1 | globlastp |
| 1281 | LYM543 | canola\|10v1\|CD832888 | 5526 | 500 | 87.1 | globlastp |
| 1282 | LYM543 | canola\|11v1\|CN726379_P1 | 5526 | 500 | 87.1 | globlastp |
| 1283 | LYM543 | b_rapa\|11v1\|CD832888_P1 | 5526 | 500 | 87.1 | globlastp |
| 1284 | LYM543 | cucurbita\|11v1\|SRR091276X105908_T1 | 5527 | 500 | 87.04 | glotblastn |
| 1285 | LYM543 | rye\|12v1\|DRR001012.509646_T1 | 5528 | 500 | 87.04 | glotblastn |
| 1286 | LYM543 | spruce\|11v1\|SRR064180X566232_T1 | 5529 | 500 | 87.04 | glotblastn |
| 1287 | LYM543 | curcuma\|10v1\|DY394111_T1 | 5530 | 500 | 87.04 | glotblastn |
| 1288 | LYM543 | aquilegia\|10v1\|DR919077_P1 | 5531 | 500 | 87 | globlastp |
| 1289 | LYM543 | cucurbita\|11v1\|FG227425_P1 | 5532 | 500 | 87 | globlastp |
| 1290 | LYM543 | cucurbita\|11v1\|SRR091276X104899_P1 | 5533 | 500 | 87 | globlastp |
| 1291 | LYM543 | euonymus\|11v1\|SRR070038X130859_P1 | 5534 | 500 | 87 | globlastp |
| 1292 | LYM543 | fagopyrum\|11v1\|SRR063703X113606_P1 | 5535 | 500 | 87 | globlastp |
| 1293 | LYM543 | humulus\|11v1\|ES654690_P1 | 5536 | 500 | 87 | globlastp |
| 1294 | LYM543 | olea\|11v1\|SRR014463.20541_P1 | 5537 | 500 | 87 | globlastp |
| 1295 | LYM543 | plantago\|11v2\|SRR066373X100572_P1 | 5538 | 500 | 87 | globlastp |
| 1296 | LYM543 | poppy\|11v1\|SRR030259.104279_P1 | 5539 | 500 | 87 | globlastp |
| 1297 | LYM543 | poppy\|11v1\|SRR030263.377362_P1 | 5539 | 500 | 87 | globlastp |
| 1298 | LYM543 | pteridium\|11v1\|GW575187_P1 | 5540 | 500 | 87 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1299 | LYM543 | rye\|12v1\|BE587503_P1 | 5541 | 500 | 87 | globlastp |
| 1300 | LYM543 | rye\|12v1\|BF145998_P1 | 5542 | 500 | 87 | globlastp |
| 1301 | LYM543 | tripterygium\|11v1\|SRR098677X111812_P1 | 5543 | 500 | 87 | globlastp |
| 1302 | LYM543 | watermelon\|11v1\|DV632976_P1 | 5544 | 500 | 87 | globlastp |
| 1303 | LYM543 | antirrhinum\|gb166\|AJ789157_P1 | 5545 | 500 | 87 | globlastp |
| 1304 | LYM543 | aquilegia\|10v2\|DR919077 | 5531 | 500 | 87 | globlastp |
| 1305 | LYM543 | aquilegia\|10v2\|DR921801 | 5531 | 500 | 87 | globlastp |
| 1306 | LYM543 | barley\|10v2\|AV833308_P1 | 5546 | 500 | 87 | globlastp |
| 1307 | LYM543 | cleome_spinosa\|10v1\|GR932294_P1 | 5547 | 500 | 87 | globlastp |
| 1308 | LYM543 | cleome_spinosa\|10v1\|SRR015531S0001904_P1 | 5548 | 500 | 87 | globlastp |
| 1309 | LYM543 | eggplant\|10v1\|FS002982_P1 | 5549 | 500 | 87 | globlastp |
| 1310 | LYM543 | kiwi\|gb166\|FG396759_P1 | 5550 | 500 | 87 | globlastp |
| 1311 | LYM543 | lotus\|09v1\|AW719561_P1 | 5551 | 500 | 87 | globlastp |
| 1312 | LYM543 | marchantia\|gb166\|BJ841118_P1 | 5552 | 500 | 87 | globlastp |
| 1313 | LYM543 | marchantia\|gb166\|C96032_P1 | 5552 | 500 | 87 | globlastp |
| 1314 | LYM543 | pepper\|gb171\|BM066423_P1 | 5553 | 500 | 87 | globlastp |
| 1315 | LYM543 | pigeonpea\|10v1\|SRR054580S0021257 | 5554 | 500 | 87 | globlastp |
| 1316 | LYM543 | pigeonpea\|11v1\|SRR054580X10220_P1 | 5554 | 500 | 87 | globlastp |
| 1317 | LYM543 | pseudoroegneria\|gb167\|FF340018 | 5546 | 500 | 87 | globlastp |
| 1318 | LYM543 | salvia\|10v1\|CV168785 | 5555 | 500 | 87 | globlastp |
| 1319 | LYM543 | soybean\|11v1\|GLYMA11G35450 | 5556 | 500 | 87 | globlastp |
| 1320 | LYM543 | soybean\|11v1\|GLYMA18G02970 | 5554 | 500 | 87 | globlastp |
| 1321 | LYM543 | tobacco\|gb162\|CV017229 | 5557 | 500 | 87 | globlastp |
| 1322 | LYM543 | tobacco\|gb162\|CV021769 | 5558 | 500 | 87 | globlastp |
| 1323 | LYM543 | tobacco\|gb162\|EB443361 | 5559 | 500 | 87 | globlastp |
| 1324 | LYM543 | wheat\|10v2\|BF199580 | 5541 | 500 | 87 | globlastp |
| 1325 | LYM543 | aquilegia\|10v1\|DR925946_P1 | 5560 | 500 | 86.6 | globlastp |
| 1326 | LYM543 | chickpea\|11v1\|SRR133517.100467XX1_P1 | 5561 | 500 | 86.6 | globlastp |
| 1327 | LYM543 | cirsium\|11v1\|SRR346952.115429_P1 | 5562 | 500 | 86.6 | globlastp |
| 1328 | LYM543 | cucurbita\|11v1\|SRR091276X104110_P1 | 5563 | 500 | 86.6 | globlastp |
| 1329 | LYM543 | euonymus\|11v1\|SRR070038X106585_P1 | 5564 | 500 | 86.6 | globlastp |
| 1330 | LYM543 | euonymus\|11v1\|SRR070038X127546_P1 | 5564 | 500 | 86.6 | globlastp |
| 1331 | LYM543 | fraxinus\|11v1\|SRR058827.101271_P1 | 5565 | 500 | 86.6 | globlastp |
| 1332 | LYM543 | hornbeam\|12v1\|SRR364455.100150_P1 | 5566 | 500 | 86.6 | globlastp |
| 1333 | LYM543 | platanus\|11v1\|SRR096786X10321_P1 | 5567 | 500 | 86.6 | globlastp |
| 1334 | LYM543 | thellungiella_parvulum\|11v1\|DN774728_P1 | 5568 | 500 | 86.6 | globlastp |
| 1335 | LYM543 | watermelon\|11v1\|AM716682_P1 | 5569 | 500 | 86.6 | globlastp |
| 1336 | LYM543 | aquilegia\|10v2\|DR925946 | 5560 | 500 | 86.6 | globlastp |
| 1337 | LYM543 | arabidopsis\|10v1\|AT5G22440_P1 | 5570 | 500 | 86.6 | globlastp |
| 1338 | LYM543 | b_juncea\|10v2\|E6ANDIZ01A0HZZ_P1 | 5571 | 500 | 86.6 | globlastp |
| 1339 | LYM543 | b_oleracea\|gb161\|DY026000_P1 | 5571 | 500 | 86.6 | globlastp |
| 1340 | LYM543 | b_rapa\|gb162\|CV432641 | 5571 | 500 | 86.6 | globlastp |
| 1341 | LYM543 | b_rapa\|gb162\|CX271881 | 5571 | 500 | 86.6 | globlastp |
| 1342 | LYM543 | bean\|12v1\|CA897536_P1 | 5572 | 500 | 86.6 | globlastp |
| 1343 | LYM543 | bean\|gb167\|CA897536 | 5572 | 500 | 86.6 | globlastp |
| 1344 | LYM543 | canola\|10v1\|CD816761 | 5573 | 500 | 86.6 | globlastp |
| 1345 | LYM543 | canola\|11v1\|CN730569_P1 | 5573 | 500 | 86.6 | globlastp |
| 1346 | LYM543 | canola\|10v1\|CD820505 | 5571 | 500 | 86.6 | globlastp |
| 1347 | LYM543 | canola\|10v1\|CD829083 | 5571 | 500 | 86.6 | globlastp |
| 1348 | LYM543 | canola\|10v1\|CN730444 | 5571 | 500 | 86.6 | globlastp |
| 1349 | LYM543 | cleome_gynandra\|10v1\|SRR015532S0001052_P1 | 5574 | 500 | 86.6 | globlastp |
| 1350 | LYM543 | cowpea\|gb166\|FF385658_P1 | 5572 | 500 | 86.6 | globlastp |
| 1351 | LYM543 | cynara\|gb167\|GE597248_P1 | 5562 | 500 | 86.6 | globlastp |
| 1352 | LYM543 | fescue\|gb161\|DT685613_P1 | 5575 | 500 | 86.6 | globlastp |
| 1353 | LYM543 | ipomoea_batatas\|10v1\|BM878842_P1 | 5576 | 500 | 86.6 | globlastp |
| 1354 | LYM543 | kiwi\|gb166\|FG416189_P1 | 5577 | 500 | 86.6 | globlastp |
| 1355 | LYM543 | nasturtium\|10v1\|GH162041 | 5578 | 500 | 86.6 | globlastp |
| 1356 | LYM543 | nasturtium\|11v1\|GH162041_P1 | 5578 | 500 | 86.6 | globlastp |
| 1357 | LYM543 | oat\|10v2\|GO589234 | 5579 | 500 | 86.6 | globlastp |
| 1358 | LYM543 | oat\|11v1\|GO589234_P1 | 5579 | 500 | 86.6 | globlastp |
| 1359 | LYM543 | pigeonpea\|10v1\|GW353422 | 5580 | 500 | 86.6 | globlastp |
| 1360 | LYM543 | radish\|gb164\|EV525236 | 5581 | 500 | 86.6 | globlastp |
| 1361 | LYM543 | radish\|gb164\|EV526900 | 5582 | 500 | 86.6 | globlastp |
| 1362 | LYM543 | radish\|gb164\|EV527619 | 5582 | 500 | 86.6 | globlastp |
| 1363 | LYM543 | radish\|gb164\|EV538757 | 5582 | 500 | 86.6 | globlastp |
| 1364 | LYM543 | taxus\|10v1\|SRR032523S0003326 | 5583 | 500 | 86.6 | globlastp |
| 1365 | LYM543 | tobacco\|gb162\|CV020196 | 5584 | 500 | 86.6 | globlastp |
| 1366 | LYM543 | tobacco\|gb162\|CV021457 | 5585 | 500 | 86.6 | globlastp |
| 1367 | LYM543 | b_rapa\|11v1\|H74539_P1 | 5571 | 500 | 86.6 | globlastp |
| 1368 | LYM543 | canola\|11v1\|CN730444_P1 | 5571 | 500 | 86.6 | globlastp |
| 1369 | LYM543 | pigeonpea\|11v1\|GW349485_P1 | 5580 | 500 | 86.6 | globlastp |
| 1370 | LYM543 | phyla\|11v2\|SRR099037X193979_T1 | 5586 | 500 | 86.57 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1371 | LYM543 | rye\|gb164\|BE587503 | 5587 | 500 | 86.57 | glotblastn |
| 1372 | LYM543 | cannabis\|12v1\|GR221542_P1 | 5588 | 500 | 86.4 | globlastp |
| 1373 | LYM543 | rice\|11v1\|AU068303_T1 | 5589 | 500 | 86.32 | glotblastn |
| 1374 | LYM543 | vinca\|11v1\|SRR098690X100190_P1 | 5590 | 500 | 86.2 | globlastp |
| 1375 | LYM543 | arabidopsis_lyrata\|09v1\|JGIAL021924_P1 | 5591 | 500 | 86.2 | globlastp |
| 1376 | LYM543 | b_rapa\|11v1\|BG543378_P1 | 5592 | 500 | 86.2 | globlastp |
| 1377 | LYM543 | b_rapa\|gb162\|BG543378 | 5592 | 500 | 86.2 | globlastp |
| 1378 | LYM543 | canola\|10v1\|CD813152 | 5592 | 500 | 86.2 | globlastp |
| 1379 | LYM543 | canola\|11v1\|CN730954_P1 | 5592 | 500 | 86.2 | globlastp |
| 1380 | LYM543 | radish\|gb164\|EV528573 | 5593 | 500 | 86.2 | globlastp |
| 1381 | LYM543 | radish\|gb164\|EV546032 | 5593 | 500 | 86.2 | globlastp |
| 1382 | LYM543 | rye\|12v1\|DRR001012.426022_T1 | 5594 | 500 | 86.11 | glotblastn |
| 1383 | LYM543 | cryptomeria\|gb166\|BP174254_T1 | 5595 | 500 | 86.11 | glotblastn |
| 1384 | LYM543 | salvia\|10v1\|SRR014553S0014817 | 5596 | 500 | 86.11 | glotblastn |
| 1385 | LYM543 | cannabis\|12v1\|EW701238_P1 | 5597 | 500 | 86.1 | globlastp |
| 1386 | LYM543 | chickpea\|11v1\|ES560310_P1 | 5598 | 500 | 86.1 | globlastp |
| 1387 | LYM543 | chickpea\|11v1\|GR916830_P1 | 5599 | 500 | 86.1 | globlastp |
| 1388 | LYM543 | fagopyrum\|11v1\|SRR063689X108738_P1 | 5600 | 500 | 86.1 | globlastp |
| 1389 | LYM543 | amaranthus\|10v1\|SRR039411S0000047_P1 | 5601 | 500 | 86.1 | globlastp |
| 1390 | LYM543 | cichorium\|gb171\|DT213592_P1 | 5602 | 500 | 86.1 | globlastp |
| 1391 | LYM543 | eggplant\|10v1\|FS002308_P1 | 5603 | 500 | 86.1 | globlastp |
| 1392 | LYM543 | eggplant\|10v1\|FS002812_P1 | 5604 | 500 | 86.1 | globlastp |
| 1393 | LYM543 | eschscholzia\|10v1\|CK750888 | 5605 | 500 | 86.1 | globlastp |
| 1394 | LYM543 | pepper\|gb171\|BM060429_P1 | 5606 | 500 | 86.1 | globlastp |
| 1395 | LYM543 | pepper\|gb171\|BM062303_P1 | 5607 | 500 | 86.1 | globlastp |
| 1396 | LYM543 | radish\|gb164\|EX757054 | 5608 | 500 | 86.1 | globlastp |
| 1397 | LYM543 | foxtail_millet\|11v3\|EC613810_P1 | 5609 | 500 | 86 | globlastp |
| 1398 | LYM543 | rye\|12v1\|DRR001012.223688_T1 | 5610 | 500 | 85.65 | glotblastn |
| 1399 | LYM543 | antirrhinum\|gb166\|AJ789134_T1 | 5611 | 500 | 85.65 | glotblastn |
| 1400 | LYM543 | foxtail_millet\|10v2\|OXEC613830_T1 | 5612 | 500 | 85.65 | glotblastn |
| 1401 | LYM543 | amborella\|12v2\|CK757481_P1 | 5613 | 500 | 85.6 | globlastp |
| 1402 | LYM543 | arnica\|11v1\|SRR099034X106235_P1 | 5614 | 500 | 85.6 | globlastp |
| 1403 | LYM543 | arnica\|11v1\|SRR099034X117709_P1 | 5615 | 500 | 85.6 | globlastp |
| 1404 | LYM543 | canola\|11v1\|CN735991_P1 | 5616 | 500 | 85.6 | globlastp |
| 1405 | LYM543 | cirsium\|11v1\|SRR346952.1020901_P1 | 5617 | 500 | 85.6 | globlastp |
| 1406 | LYM543 | epimedium\|11v1\|SRR013502.10782_P1 | 5618 | 500 | 85.6 | globlastp |
| 1407 | LYM543 | eucalyptus\|11v2\|DR410017_P1 | 5619 | 500 | 85.6 | globlastp |
| 1408 | LYM543 | hornbeam\|12v1\|SRR364455.134704_P1 | 5620 | 500 | 85.6 | globlastp |
| 1409 | LYM543 | thellungiella_halophilum\|11v1\|EC599536_P1 | 5621 | 500 | 85.6 | globlastp |
| 1410 | LYM543 | thellungiella_parvulum\|11v1\|DN774951_P1 | 5622 | 500 | 85.6 | globlastp |
| 1411 | LYM543 | trigonella\|11v1\|SRR066194X109093_P1 | 5623 | 500 | 85.6 | globlastp |
| 1412 | LYM543 | b_oleracea\|gb161\|DY026477_P1 | 5616 | 500 | 85.6 | globlastp |
| 1413 | LYM543 | brachypodium\|09v1\|DV475206 | 5624 | 500 | 85.6 | globlastp |
| 1414 | LYM543 | brachypodium\|12v1\|BRADI2G55600_P1 | 5624 | 500 | 85.6 | globlastp |
| 1415 | LYM543 | canola\|10v1\|CX193827 | 5616 | 500 | 85.6 | globlastp |
| 1416 | LYM543 | centaurea\|gb166\|EH755136_P1 | 5625 | 500 | 85.6 | globlastp |
| 1417 | LYM543 | chestnut\|gb170\|SRR006295S0014019_P1 | 5626 | 500 | 85.6 | globlastp |
| 1418 | LYM543 | cucumber\|09v1\|CK085995_P1 | 5627 | 500 | 85.6 | globlastp |
| 1419 | LYM543 | dandelion\|10v1\|DR398518_P1 | 5628 | 500 | 85.6 | globlastp |
| 1420 | LYM543 | eucalyptus\|11v1\|DR410017 | 5619 | 500 | 85.6 | globlastp |
| 1421 | LYM543 | kiwi\|gb166\|FG397268_P1 | 5629 | 500 | 85.6 | globlastp |
| 1422 | LYM543 | medicago\|09v1\|AA660463 | 5630 | 500 | 85.6 | globlastp |
| 1423 | LYM543 | medicago\|12v1\|AA660463_P1 | 5630 | 500 | 85.6 | globlastp |
| 1424 | LYM543 | medicago\|09v1\|LLBG644354 | 5631 | 500 | 85.6 | globlastp |
| 1425 | LYM543 | melon\|10v1\|AM716682_P1 | 5627 | 500 | 85.6 | globlastp |
| 1426 | LYM543 | oak\|10v1\|DB998778_P1 | 5626 | 500 | 85.6 | globlastp |
| 1427 | LYM543 | potato\|10v1\|BF153577_P1 | 5632 | 500 | 85.6 | globlastp |
| 1428 | LYM543 | potato\|10v1\|BG350267_P1 | 5631 | 500 | 85.6 | globlastp |
| 1429 | LYM543 | safflower\|gb162\|EL389709 | 5625 | 500 | 85.6 | globlastp |
| 1430 | LYM543 | solanum_phureja\|09v1\|SPHBG123290 | 5631 | 500 | 85.6 | globlastp |
| 1431 | LYM543 | solanum_phureja\|09v1\|SPHBG123407 | 5632 | 500 | 85.6 | globlastp |
| 1432 | LYM543 | strawberry\|11v1\|DV440222 | 5633 | 500 | 85.6 | globlastp |
| 1433 | LYM543 | thellungiella\|gb167\|EC599536 | 5621 | 500 | 85.6 | globlastp |
| 1434 | LYM543 | tomato\|09v1\|BG123290 | 5631 | 500 | 85.6 | globlastp |
| 1435 | LYM543 | tomato\|11v1\|BG123290_P1 | 5631 | 500 | 85.6 | globlastp |
| 1436 | LYM543 | tomato\|09v1\|BG123407 | 5634 | 500 | 85.6 | globlastp |
| 1437 | LYM543 | tomato\|11v1\|BG123407_P1 | 5634 | 500 | 85.6 | globlastp |
| 1438 | LYM543 | tomato\|09v1\|BG126695 | 5635 | 500 | 85.6 | globlastp |
| 1439 | LYM543 | tomato\|11v1\|BG126695_P1 | 5635 | 500 | 85.6 | globlastp |
| 1440 | LYM543 | tragopogon\|10v1\|SRR020205S0005773 | 5636 | 500 | 85.6 | globlastp |
| 1441 | LYM543 | tragopogon\|10v1\|SRR020205S0054300 | 5637 | 500 | 85.6 | globlastp |
| 1442 | LYM543 | triphysaria\|10v1\|BE574961 | 5638 | 500 | 85.6 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1443 | LYM543 | fraxinus\|11v1\|SRR058827.149429_T1 | 5639 | 500 | 85.25 | glotblastn |
| 1444 | LYM543 | amborella\|12v2\|CK754386_P1 | 5640 | 500 | 85.2 | globlastp |
| 1445 | LYM543 | ambrosia\|11v1\|GR935615_P1 | 5641 | 500 | 85.2 | globlastp |
| 1446 | LYM543 | ambrosia\|11v1\|SRR346935.197056_P1 | 5642 | 500 | 85.2 | globlastp |
| 1447 | LYM543 | ambrosia\|11v1\|SRR346935.207821_P1 | 5641 | 500 | 85.2 | globlastp |
| 1448 | LYM543 | ambrosia\|11v1\|SRR346943.100852_P1 | 5643 | 500 | 85.2 | globlastp |
| 1449 | LYM543 | ambrosia\|11v1\|SRR346943.103647_P1 | 5644 | 500 | 85.2 | globlastp |
| 1450 | LYM543 | ambrosia\|11v1\|SRR346943.104242_P1 | 5645 | 500 | 85.2 | globlastp |
| 1451 | LYM543 | arnica\|11v1\|SRR099034X102057_P1 | 5646 | 500 | 85.2 | globlastp |
| 1452 | LYM543 | canola\|11v1\|EE476773_P1 | 5647 | 500 | 85.2 | globlastp |
| 1453 | LYM543 | cirsium\|11v1\|DV175371_P1 | 5648 | 500 | 85.2 | globlastp |
| 1454 | LYM543 | cirsium\|11v1\|SRR346952.100637_P1 | 5648 | 500 | 85.2 | globlastp |
| 1455 | LYM543 | flaveria\|11v1\|SRR149229.100897_P1 | 5649 | 500 | 85.2 | globlastp |
| 1456 | LYM543 | flaveria\|11v1\|SRR149229.105912_P1 | 5650 | 500 | 85.2 | globlastp |
| 1457 | LYM543 | flaveria\|11v1\|SRR149229.106781_P1 | 5650 | 500 | 85.2 | globlastp |
| 1458 | LYM543 | flaveria\|11v1\|SRR149229.106867_P1 | 5649 | 500 | 85.2 | globlastp |
| 1459 | LYM543 | flaveria\|11v1\|SRR149229.112923_P1 | 5650 | 500 | 85.2 | globlastp |
| 1460 | LYM543 | flaveria\|11v1\|SRR149229.416813_P1 | 5650 | 500 | 85.2 | globlastp |
| 1461 | LYM543 | flaveria\|11v1\|SRR149232.102816_P1 | 5650 | 500 | 85.2 | globlastp |
| 1462 | LYM543 | flaveria\|11v1\|SRR149232.115803_P1 | 5650 | 500 | 85.2 | globlastp |
| 1463 | LYM543 | flaveria\|11v1\|SRR149232.115954_P1 | 5650 | 500 | 85.2 | globlastp |
| 1464 | LYM543 | flaveria\|11v1\|SRR149232.120376_P1 | 5650 | 500 | 85.2 | globlastp |
| 1465 | LYM543 | sunflower\|12v1\|CD847389_P1 | 5646 | 500 | 85.2 | globlastp |
| 1466 | LYM543 | sunflower\|12v1\|CD851020_P1 | 5646 | 500 | 85.2 | globlastp |
| 1467 | LYM543 | sunflower\|12v1\|CD851044_P1 | 5646 | 500 | 85.2 | globlastp |
| 1468 | LYM543 | sunflower\|12v1\|CD855240_P1 | 5646 | 500 | 85.2 | globlastp |
| 1469 | LYM543 | sunflower\|12v1\|CX946517_P1 | 5646 | 500 | 85.2 | globlastp |
| 1470 | LYM543 | sunflower\|12v1\|DY906251_P1 | 5646 | 500 | 85.2 | globlastp |
| 1471 | LYM543 | sunflower\|12v1\|DY910888_P1 | 5646 | 500 | 85.2 | globlastp |
| 1472 | LYM543 | sunflower\|12v1\|DY915779_P1 | 5646 | 500 | 85.2 | globlastp |
| 1473 | LYM543 | sunflower\|12v1\|DY957371_P1 | 5646 | 500 | 85.2 | globlastp |
| 1474 | LYM543 | arabidopsis_lyrata\|09v1\|JGIAL000800_P1 | 5651 | 500 | 85.2 | globlastp |
| 1475 | LYM543 | arabidopsis_lyrata\|09v1\|JGIAL013873_P1 | 5652 | 500 | 85.2 | globlastp |
| 1476 | LYM543 | b_juncea\|10v2\|E6ANDIZ01A7SAU_P1 | 5647 | 500 | 85.2 | globlastp |
| 1477 | LYM543 | b_rapa\|11v1\|L47936_P1 | 5647 | 500 | 85.2 | globlastp |
| 1478 | LYM543 | b_rapa\|gb162\|L47936 | 5647 | 500 | 85.2 | globlastp |
| 1479 | LYM543 | canola\|10v1\|CX195592 | 5647 | 500 | 85.2 | globlastp |
| 1480 | LYM543 | centaurea\|gb166\|EH726717_P1 | 5648 | 500 | 85.2 | globlastp |
| 1481 | LYM543 | centaurea\|gb166\|EH729121_P1 | 5648 | 500 | 85.2 | globlastp |
| 1482 | LYM543 | cichorium\|gb171\|DT211948_P1 | 5646 | 500 | 85.2 | globlastp |
| 1483 | LYM543 | cynara\|gb167\|GE585793_P1 | 5648 | 500 | 85.2 | globlastp |
| 1484 | LYM543 | dandelion\|10v1\|DY812444_P1 | 5646 | 500 | 85.2 | globlastp |
| 1485 | LYM543 | gerbera\|09v1\|AJ752617_P1 | 5648 | 500 | 85.2 | globlastp |
| 1486 | LYM543 | lettuce\|10v1\|DW044045_P1 | 5646 | 500 | 85.2 | globlastp |
| 1487 | LYM543 | lettuce\|10v1\|DW044239_P1 | 5646 | 500 | 85.2 | globlastp |
| 1488 | LYM543 | lettuce\|10v1\|DW074550_P1 | 5653 | 500 | 85.2 | globlastp |
| 1489 | LYM543 | lettuce\|10v1\|DW076627_P1 | 5646 | 500 | 85.2 | globlastp |
| 1490 | LYM543 | lettuce\|10v1\|DY968057_P1 | 5646 | 500 | 85.2 | globlastp |
| 1491 | LYM543 | parthenium\|10v1\|GW776856_P1 | 5654 | 500 | 85.2 | globlastp |
| 1492 | LYM543 | potato\|10v1\|BF459989_P1 | 5655 | 500 | 85.2 | globlastp |
| 1493 | LYM543 | radish\|gb164\|EV534979 | 5656 | 500 | 85.2 | globlastp |
| 1494 | LYM543 | radish\|gb164\|EW721761 | 5656 | 500 | 85.2 | globlastp |
| 1495 | LYM543 | safflower\|gb162\|EL380734 | 5648 | 500 | 85.2 | globlastp |
| 1496 | LYM543 | solanum_phureja\|09v1\|SPHBG126695 | 5655 | 500 | 85.2 | globlastp |
| 1497 | LYM543 | sunflower\|10v1\|CD847389 | 5646 | 500 | 85.2 | globlastp |
| 1498 | LYM543 | sunflower\|12v1\|AJ437818_P1 | 5646 | 500 | 85.2 | globlastp |
| 1499 | LYM543 | sunflower\|10v1\|CD851020 | 5646 | 500 | 85.2 | globlastp |
| 1500 | LYM543 | sunflower\|12v1\|DY915698_P1 | 5646 | 500 | 85.2 | globlastp |
| 1501 | LYM543 | sunflower\|10v1\|CD853149 | 5646 | 500 | 85.2 | globlastp |
| 1502 | LYM543 | sunflower\|12v1\|DY938198_P1 | 5646 | 500 | 85.2 | globlastp |
| 1503 | LYM543 | sunflower\|10v1\|CX946517 | 5646 | 500 | 85.2 | globlastp |
| 1504 | LYM543 | sunflower\|12v1\|EE641606_P1 | 5646 | 500 | 85.2 | globlastp |
| 1505 | LYM543 | sunflower\|10v1\|DY910888 | 5646 | 500 | 85.2 | globlastp |
| 1506 | LYM543 | sunflower\|12v1\|CD853149_P1 | 5646 | 500 | 85.2 | globlastp |
| 1507 | LYM543 | triphysaria\|10v1\|BM356583 | 5657 | 500 | 85.2 | globlastp |
| 1508 | LYM543 | walnuts\|gb166\|CV198171 | 5658 | 500 | 85.2 | globlastp |
| 1509 | LYM543 | medicago\|12v1\|AL366013_P1 | 5659 | 500 | 85.2 | globlastp |
| 1510 | LYM543 | canola\|11v1\|CN735729_P1 | 5647 | 500 | 85.2 | globlastp |
| 1511 | LYM543 | canola\|11v1\|DY005869_T1 | 5660 | 500 | 85.19 | glotblastn |
| 1512 | LYM543 | peanut\|10v1\|SRR042413S0058358_T1 | 5661 | 500 | 85.19 | glotblastn |
| 1513 | LYM543 | prunus\|10v1\|CB819399 | 5662 | 500 | 85.19 | glotblastn |
| 1514 | LYM543 | plantago\|11v2\|SRR066373X105277_P1 | 5663 | 500 | 84.9 | globlastp |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1515 | LYM543 | lovegrass\|gb167\|DN480083_P1 | 5664 | 500 | 84.9 | globlastp |
| 1516 | LYM543 | cacao\|10v1\|CU484457_T1 | 5665 | 500 | 84.79 | glotblastn |
| 1517 | LYM543 | ambrosia\|11v1\|SRR346935.167042_T1 | 5666 | 500 | 84.72 | glotblastn |
| 1518 | LYM543 | ambrosia\|11v1\|SRR346943.459404_T1 | 5667 | 500 | 84.72 | glotblastn |
| 1519 | LYM543 | arnica\|11v1\|SRR099034X109759_T1 | 5668 | 500 | 84.72 | glotblastn |
| 1520 | LYM543 | b_rapa\|11v1\|ES944278_T1 | 5669 | 500 | 84.72 | glotblastn |
| 1521 | LYM543 | flaveria\|11v1\|SRR149229.447389_T1 | 5670 | 500 | 84.72 | glotblastn |
| 1522 | LYM543 | thellungiella_parvulum\|11v1\|EC599536_T1 | 5671 | 500 | 84.72 | glotblastn |
| 1523 | LYM543 | amborella\|gb166\|CK757481 | 5672 | 500 | 84.72 | glotblastn |
| 1524 | LYM543 | radish\|gb164\|EW718139 | 5673 | 500 | 84.72 | glotblastn |
| 1525 | LYM543 | ambrosia\|11v1\|SRR346935.155011_P1 | 5674 | 500 | 84.7 | globlastp |
| 1526 | LYM543 | beech\|11v1\|SRR006293.11211_P1 | 5675 | 500 | 84.7 | globlastp |
| 1527 | LYM543 | castorbean\|11v1\|EV520609_P1 | 5676 | 500 | 84.7 | globlastp |
| 1528 | LYM543 | epimedium\|11v1\|SRR013502.10210_P1 | 5677 | 500 | 84.7 | globlastp |
| 1529 | LYM543 | sunflower\|12v1\|EL466589_P1 | 5678 | 500 | 84.7 | globlastp |
| 1530 | LYM543 | thalictrum\|11v1\|SRR096787X107013_P1 | 5679 | 500 | 84.7 | globlastp |
| 1531 | LYM543 | trigonella\|11v1\|SRR066194X100308_P1 | 5680 | 500 | 84.7 | globlastp |
| 1532 | LYM543 | arabidopsis\|10v1\|AT1G08360_P1 | 5681 | 500 | 84.7 | globlastp |
| 1533 | LYM543 | arabidopsis\|10v1\|AT2G27530_P1 | 5682 | 500 | 84.7 | globlastp |
| 1534 | LYM543 | cassava\|09v1\|CK643284_P1 | 5683 | 500 | 84.7 | globlastp |
| 1535 | LYM543 | castorbean\|09v1\|EV519873 | 5684 | 500 | 84.7 | globlastp |
| 1536 | LYM543 | castorbean\|11v1\|EV519873_P1 | 5684 | 500 | 84.7 | globlastp |
| 1537 | LYM543 | cichorium\|gb171\|DT211200_P1 | 5685 | 500 | 84.7 | globlastp |
| 1538 | LYM543 | clover\|gb162\|BB918218_P1 | 5686 | 500 | 84.7 | globlastp |
| 1539 | LYM543 | cynara\|gb167\|GE589205_P1 | 5687 | 500 | 84.7 | globlastp |
| 1540 | LYM543 | lotus\|09v1\|BF177566_P1 | 5688 | 500 | 84.7 | globlastp |
| 1541 | LYM543 | medicago\|09v1\|AW698717 | 5689 | 500 | 84.7 | globlastp |
| 1542 | LYM543 | medicago\|12v1\|AJ389005_P1 | 5689 | 500 | 84.7 | globlastp |
| 1543 | LYM543 | parthenium\|10v1\|GW779249_P1 | 5690 | 500 | 84.7 | globlastp |
| 1544 | LYM543 | rose\|10v1\|EC586926 | 5691 | 500 | 84.7 | globlastp |
| 1545 | LYM543 | rose\|12v1\|EC586926_P1 | 5691 | 500 | 84.7 | globlastp |
| 1546 | LYM543 | sequoia\|10v1\|SRR065044S0005324 | 5692 | 500 | 84.7 | globlastp |
| 1547 | LYM543 | strawberry\|11v1\|CO379723 | 5693 | 500 | 84.7 | globlastp |
| 1548 | LYM543 | euphorbia\|11v1\|BE095315_P1 | 5694 | 500 | 84.3 | globlastp |
| 1549 | LYM543 | fagopyrum\|11v1\|SRR063689X100987_P1 | 5695 | 500 | 84.3 | globlastp |
| 1550 | LYM543 | flaveria\|11v1\|SRR149232.135928_P1 | 5696 | 500 | 84.3 | globlastp |
| 1551 | LYM543 | rose\|12v1\|EC587592_P1 | 5697 | 500 | 84.3 | globlastp |
| 1552 | LYM543 | sunflower\|12v1\|CD853307_P1 | 5698 | 500 | 84.3 | globlastp |
| 1553 | LYM543 | b_rapa\|gb162\|CX268507 | 5699 | 500 | 84.3 | globlastp |
| 1554 | LYM543 | catharanthus\|gb166\|EG562566 | 5700 | 500 | 84.3 | globlastp |
| 1555 | LYM543 | hevea\|10v1\|EC602536_P1 | 5701 | 500 | 84.3 | globlastp |
| 1556 | LYM543 | iceplant\|gb164\|BE035816_P1 | 5702 | 500 | 84.3 | globlastp |
| 1557 | LYM543 | jatropha\|09v1\|FM892483_P1 | 5703 | 500 | 84.3 | globlastp |
| 1558 | LYM543 | pea\|11v1\|AM161930_P1 | 5704 | 500 | 84.3 | globlastp |
| 1559 | LYM543 | spurge\|gb161\|BG354971 | 5694 | 500 | 84.3 | globlastp |
| 1560 | LYM543 | triphysaria\|10v1\|BE574747 | 5705 | 500 | 84.3 | globlastp |
| 1561 | LYM543 | ambrosia\|11v1\|SRR346935.124048_T1 | 5706 | 500 | 84.26 | glotblastn |
| 1562 | LYM543 | flaveria\|11v1\|SRR149241.2888_T1 | 5707 | 500 | 84.26 | glotblastn |
| 1563 | LYM543 | cassava\|09v1\|CK646659_T1 | 5708 | 500 | 84.26 | glotblastn |
| 1564 | LYM543 | gerbera\|09v1\|AJ752767_T1 | 5709 | 500 | 84.26 | glotblastn |
| 1565 | LYM543 | ipomoea_nil\|10v1\|BJ563006_T1 | 5710 | 500 | 84.26 | glotblastn |
| 1566 | LYM543 | lotus\|09v1\|LLBW598038_T1 | 5711 | 500 | 84.26 | glotblastn |
| 1567 | LYM543 | pigeonpea\|10v1\|SRR054580S0101999 | 5712 | 500 | 84.26 | glotblastn |
| 1568 | LYM543 | tea\|10v1\|CV014124 | 5713 | 500 | 83.9 | globlastp |
| 1569 | LYM543 | ambrosia\|11v1\|SRR346947.105064_T1 | 5714 | 500 | 83.87 | glotblastn |
| 1570 | LYM543 | orange\|11v1\|CX290604_T1 | 5715 | 500 | 83.87 | glotblastn |
| 1571 | LYM543 | ambrosia\|11v1\|SRR346943.102888_T1 | 5716 | 500 | 83.8 | glotblastn |
| 1572 | LYM543 | apple\|11v1\|CN444544_P1 | 5717 | 500 | 83.8 | globlastp |
| 1573 | LYM543 | apple\|11v1\|CN493453_P1 | 5718 | 500 | 83.8 | globlastp |
| 1574 | LYM543 | beech\|11v1\|FR596070_T1 | 5719 | 500 | 83.8 | globlastp |
| 1575 | LYM543 | beech\|11v1\|SRR006293.19342_T1 | 5719 | 500 | 83.8 | glotblastn |
| 1576 | LYM543 | cephalotaxus\|11v1\|SRR064395X116623_P1 | 5720 | 500 | 83.8 | globlastp |
| 1577 | LYM543 | fagopyrum\|11v1\|SRR063703X113882_T1 | 5721 | 500 | 83.8 | glotblastn |
| 1578 | LYM543 | flaveria\|11v1\|SRR149244.11798_P1 | 5722 | 500 | 83.8 | globlastp |
| 1579 | LYM543 | flax\|11v1\|JG081784_P1 | 5723 | 500 | 83.8 | globlastp |
| 1580 | LYM543 | fraxinus\|11v1\|SRR058827.114519_T1 | 5724 | 500 | 83.8 | glotblastn |
| 1581 | LYM543 | silene\|11v1\|GH293964_P1 | 5725 | 500 | 83.8 | globlastp |
| 1582 | LYM543 | sunflower\|12v1\|EE626584_P1 | 5726 | 500 | 83.8 | globlastp |
| 1583 | LYM543 | apple\|gb171\|CN444544 | 5717 | 500 | 83.8 | globlastp |
| 1584 | LYM543 | apple\|gb171\|CN490874 | 5717 | 500 | 83.8 | globlastp |
| 1585 | LYM543 | ceratodon\|10v1\|SRR074890S0000846_P1 | 5727 | 500 | 83.8 | globlastp |
| 1586 | LYM543 | iceplant\|gb164\|BE035700_T1 | 5728 | 500 | 83.8 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1587 | LYM543 | oak\|10v1\|DN950333_P1 | 5729 | 500 | 83.8 | globlastp |
| 1588 | LYM543 | physcomitrella\|10v1\|AW126854_P1 | 5730 | 500 | 83.8 | globlastp |
| 1589 | LYM543 | artemisia\|10v1\|EY043816_P1 | 5731 | 500 | 83.4 | globlastp |
| 1590 | LYM543 | guizotia\|10v1\|GE552355_T1 | 5732 | 500 | 83.33 | glotblastn |
| 1591 | LYM543 | pine\|10v2\|SRR063935S0108204_T1 | 5733 | 500 | 83.33 | glotblastn |
| 1592 | LYM543 | flax\|11v1\|EU828962_P1 | 5734 | 500 | 83.3 | globlastp |
| 1593 | LYM543 | flax\|11v1\|JG019452_P1 | 5735 | 500 | 83.3 | globlastp |
| 1594 | LYM543 | basilicum\|10v1\|DY336374_P1 | 5736 | 500 | 83.3 | globlastp |
| 1595 | LYM543 | chestnut\|gb170\|SRR006295S0001232_P1 | 5737 | 500 | 83.3 | globlastp |
| 1596 | LYM543 | prunus\|10v1\|CB822822 | 5738 | 500 | 83.3 | globlastp |
| 1597 | LYM543 | flax\|11v1\|JG083051_P1 | 5739 | 500 | 83.3 | globlastp |
| 1598 | LYM543 | euphorbia\|11v1\|SRR098678X101209_P1 | 5740 | 500 | 82.9 | globlastp |
| 1599 | LYM543 | flax\|11v1\|EU829030_P1 | 5741 | 500 | 82.9 | globlastp |
| 1600 | LYM543 | amborella\|gb166\|CK762906 | 5742 | 500 | 82.9 | globlastp |
| 1601 | LYM543 | banana\|10v1\|FF557809_P1 | 5743 | 500 | 82.9 | globlastp |
| 1602 | LYM543 | fern\|gb171\|DK953007_P1 | 5744 | 500 | 82.9 | globlastp |
| 1603 | LYM543 | physcomitrella\|10v1\|Z98058_P1 | 5745 | 500 | 82.9 | globlastp |
| 1604 | LYM543 | flax\|09v1\|EU829030 | 5746 | 500 | 82.87 | glotblastn |
| 1605 | LYM543 | rice\|gb170\|OS01G64090 | 5747 | 500 | 82.8 | globlastp |
| 1606 | LYM543 | sarracenia\|11v1\|SRR192669.11631_P1 | 5748 | 500 | 82.5 | globlastp |
| 1607 | LYM543 | artemisia\|10v1\|EY044623_T1 | 5749 | 500 | 82.49 | glotblastn |
| 1608 | LYM543 | wheat\|10v2\|CA616880 | 5750 | 500 | 82.41 | glotblastn |
| 1609 | LYM543 | b_rapa\|11v1\|EH425238_P1 | 5751 | 500 | 82.4 | globlastp |
| 1610 | LYM543 | physcomitrella\|10v1\|AW497015_P1 | 5752 | 500 | 82.4 | globlastp |
| 1611 | LYM543 | clementine\|11v1\|CX290604_T1 | 5753 | 500 | 82.03 | glotblastn |
| 1612 | LYM543 | ginger\|gb164\|DY349497_P1 | 5754 | 500 | 81.9 | globlastp |
| 1613 | LYM543 | parthenium\|10v1\|GW780345_P1 | 5755 | 500 | 81.9 | globlastp |
| 1614 | LYM543 | euphorbia\|11v1\|SRR098678X101198_P1 | 5756 | 500 | 81.5 | globlastp |
| 1615 | LYM543 | silene\|11v1\|SRR096785X100437_P1 | 5757 | 500 | 81.5 | globlastp |
| 1616 | LYM543 | medicago\|09v1\|AL366014 | 5758 | 500 | 81.5 | globlastp |
| 1617 | LYM543 | lovegrass\|gb167\|EH190969_T1 | 5759 | 500 | 81 | glotblastn |
| 1618 | LYM543 | watermelon\|11v1\|CO998703_T1 | 5760 | 500 | 80.91 | glotblastn |
| 1619 | LYM543 | b_juncea\|10v2\|E6ANDIZ01AGJZF_P1 | 5761 | 500 | 80.6 | globlastp |
| 1620 | LYM543 | eschscholzia\|10v1\|CK766388 | 5762 | 500 | 80.6 | globlastp |
| 1621 | LYM543 | poplar\|10v1\|AI162305_P1 | 5763 | 500 | 80.6 | globlastp |
| 1622 | LYM543 | ambrosia\|11v1\|SRR346935.5183_T1 | 5667 | 500 | 80.44 | glotblastn |
| 1623 | LYM543 | flaveria\|11v1\|SRR149241.110115_P1 | 5764 | 500 | 80.1 | globlastp |
| 1624 | LYM543 | b_oleracea\|gb161\|DY026267_P1 | 5765 | 500 | 80.1 | globlastp |
| 1625 | LYM543 | poplar\|10v1\|AI162200_P1 | 5766 | 500 | 80.1 | globlastp |
| 1626 | LYM545 | sorghum\|12v1\|SB04G030700_P1 | 5767 | 502 | 95.9 | globlastp |
| 1627 | LYM545 | sorghum\|09v1\|SB04G030700 | 5768 | 502 | 95.75 | glotblastn |
| 1628 | LYM545 | maize\|10v1\|BE552884_P1 | 5769 | 502 | 93.7 | globlastp |
| 1629 | LYM545 | millet\|10v1\|EVO454PM057362_T1 | 5770 | 502 | 93.35 | glotblastn |
| 1630 | LYM545 | switchgrass\|gb167\|FE611636 | 5771 | 502 | 92.24 | glotblastn |
| 1631 | LYM545 | maize\|10v1\|DN207302_P1 | 5772 | 502 | 91.5 | globlastp |
| 1632 | LYM545 | rice\|11v1\|AU031668_P1 | 5773 | 502 | 86.7 | globlastp |
| 1633 | LYM545 | rice\|gb170\|OS02G47420 | 5773 | 502 | 86.7 | globlastp |
| 1634 | LYM545 | rye\|12v1\|DRR001012.131020_P1 | 5774 | 502 | 85.5 | globlastp |
| 1635 | LYM545 | barley\|10v2\|BG309774_P1 | 5775 | 502 | 85.3 | globlastp |
| 1636 | LYM545 | brachypodium\|09v1\|GT783994 | 5776 | 502 | 85.1 | globlastp |
| 1637 | LYM545 | brachypodium\|12v1\|BRADI3G52620_P1 | 5776 | 502 | 85.1 | globlastp |
| 1638 | LYM549 | switchgrass\|gb167\|FE625533 | 5777 | 506 | 89.5 | globlastp |
| 1639 | LYM549 | switchgrass\|gb167\|FL852134 | 5778 | 506 | 87.86 | glotblastn |
| 1640 | LYM550 | switchgrass\|gb167\|FE643278 | 5779 | 507 | 94.8 | globlastp |
| 1641 | LYM550 | millet\|10v1\|EVO454PM215501_P1 | 5780 | 507 | 92.9 | globlastp |
| 1642 | LYM550 | sorghum\|09v1\|SB04G031540 | 5781 | 507 | 90.9 | globlastp |
| 1643 | LYM550 | sorghum\|12v1\|SB04G031540_P1 | 5781 | 507 | 90.9 | globlastp |
| 1644 | LYM550 | sugarcane\|10v1\|CA118190 | 5782 | 507 | 90.9 | globlastp |
| 1645 | LYM550 | maize\|10v1\|AW258099_P1 | 5783 | 507 | 90.2 | globlastp |
| 1646 | LYM552 | sorghum\|12v1\|SB06G025390_P1 | 5784 | 508 | 82.6 | globlastp |
| 1647 | LYM553 | switchgrass\|gb167\|FL709136 | 5785 | 509 | 84 | globlastp |
| 1648 | LYM553 | sorghum\|09v1\|SB02G035940 | 5786 | 509 | 83.8 | globlastp |
| 1649 | LYM553 | sorghum\|12v1\|SB02G035940_P1 | 5786 | 509 | 83.8 | globlastp |
| 1650 | LYM553 | maize\|10v1\|AI783093_P1 | 5787 | 509 | 82.6 | globlastp |
| 1651 | LYM555 | millet\|10v1\|EVO454PM013045_P1 | 5788 | 511 | 96.5 | globlastp |
| 1652 | LYM555 | sugarcane\|10v1\|CA099222 | 5789 | 511 | 96.2 | globlastp |
| 1653 | LYM555 | sorghum\|09v1\|SB03G025740 | 5790 | 511 | 95.9 | globlastp |
| 1654 | LYM555 | sorghum\|12v1\|SB03G025740_P1 | 5790 | 511 | 95.9 | globlastp |
| 1655 | LYM555 | switchgrass\|gb167\|DN146315 | 5791 | 511 | 95.3 | globlastp |
| 1656 | LYM555 | maize\|10v1\|AI622613_P1 | 5792 | 511 | 94.4 | globlastp |
| 1657 | LYM555 | rice\|11v1\|D39392_P1 | 5793 | 511 | 91.8 | globlastp |
| 1658 | LYM555 | brachypodium\|09v1\|GT758302 | 5794 | 511 | 91.8 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1659 | LYM555 | brachypodium\|12v1\|BRADI2G41500_P1 | 5794 | 511 | 91.8 | globlastp |
| 1660 | LYM555 | wheat\|10v2\|BE414525XX2 | 5795 | 511 | 88.6 | globlastp |
| 1661 | LYM556 | foxtail_millet\|11v3\|PHY7SI013140M_P1 | 5796 | 512 | 96.8 | globlastp |
| 1662 | LYM556 | sorghum\|09v1\|SB07G019240 | 5797 | 512 | 89.4 | globlastp |
| 1663 | LYM556 | sorghum\|12v1\|SB07G019240_P1 | 5797 | 512 | 89.4 | globlastp |
| 1664 | LYM556 | maize\|10v1\|CD946745_P1 | 5798 | 512 | 89 | globlastp |
| 1665 | LYM556 | brachypodium\|09v1\|GT772760 | 5799 | 512 | 82.9 | globlastp |
| 1666 | LYM556 | brachypodium\|12v1\|BRADI3G35000_P1 | 5799 | 512 | 82.9 | globlastp |
| 1667 | LYM556 | rice\|11v1\|CA761057_P1 | 5800 | 512 | 80.9 | globlastp |
| 1668 | LYM556 | rice\|gb170\|OS08G29150 | 5800 | 512 | 80.9 | globlastp |
| 1669 | LYM557 | switchgrass\|gb167\|DN145513 | 5801 | 513 | 95.3 | globlastp |
| 1670 | LYM557 | switchgrass\|gb167\|DN143225 | 5802 | 513 | 94 | globlastp |
| 1671 | LYM557 | oil_palm\|11v1\|SRR190702.278168_T1 | 5803 | 513 | 93.33 | glotblastn |
| 1672 | LYM557 | cynodon\|10v1\|ES291891_P1 | 5804 | 513 | 91.9 | globlastp |
| 1673 | LYM557 | lovegrass\|gb167\|DN480936_P1 | 5805 | 513 | 90.7 | globlastp |
| 1674 | LYM557 | maize\|10v1\|T12659_P1 | 5806 | 513 | 90 | globlastp |
| 1675 | LYM557 | foxtail_millet\|10v2\|OXEC613026_T1 | 5807 | 513 | 89.1 | globlastp |
| 1676 | LYM557 | wheat\|10v2\|CA484105 | 5808 | 513 | 87 | globlastp |
| 1677 | LYM557 | sorghum\|09v1\|SB08G005300 | 5809 | 513 | 86.6 | globlastp |
| 1678 | LYM557 | sorghum\|12v1\|SB08G005300_P1 | 5809 | 513 | 86.6 | globlastp |
| 1679 | LYM557 | rice\|11v1\|AA753190_P1 | 5810 | 513 | 86.1 | globlastp |
| 1680 | LYM557 | rice\|gb170\|OS12G08770 | 5810 | 513 | 86.1 | globlastp |
| 1681 | LYM557 | oat\|11v1\|CN817367_P1 | 5811 | 513 | 83.4 | globlastp |
| 1682 | LYM557 | oat\|11v1\|GR319490_P1 | 5811 | 513 | 83.4 | globlastp |
| 1683 | LYM557 | fescue\|gb161\|DT683395_P1 | 5812 | 513 | 83.4 | globlastp |
| 1684 | LYM557 | fescue\|gb161\|DT696789_P1 | 5812 | 513 | 83.4 | globlastp |
| 1685 | LYM557 | lolium\|10v1\|AU246931_P1 | 5812 | 513 | 83.4 | globlastp |
| 1686 | LYM557 | oat\|10v2\|CN817367 | 5811 | 513 | 83.4 | globlastp |
| 1687 | LYM557 | rye\|gb164\|BE494977 | 5813 | 513 | 83.33 | glotblastn |
| 1688 | LYM557 | rye\|12v1\|BE494977_P1 | 5814 | 513 | 83.3 | globlastp |
| 1689 | LYM557 | rye\|12v1\|BE704643_P1 | 5814 | 513 | 83.3 | globlastp |
| 1690 | LYM557 | leymus\|gb166\|CD809087_P1 | 5815 | 513 | 83.3 | globlastp |
| 1691 | LYM557 | pseudoroegneria\|gb167\|FF340056 | 5814 | 513 | 83.3 | globlastp |
| 1692 | LYM557 | oat\|11v1\|CN817438_T1 | 5816 | 513 | 82.78 | glotblastn |
| 1693 | LYM557 | wheat\|10v2\|BE401605 | 5817 | 513 | 82.7 | globlastp |
| 1694 | LYM557 | brachypodium\|09v1\|DV475775 | 5818 | 513 | 82 | globlastp |
| 1695 | LYM557 | brachypodium\|12v1\|BRADI4G40780_P1 | 5818 | 513 | 82 | globlastp |
| 1696 | LYM557 | wheat\|10v2\|BI751261 | 5819 | 513 | 82 | globlastp |
| 1697 | LYM557 | barley\|10v2\|X66428_P1 | 5820 | 513 | 81.3 | globlastp |
| 1698 | LYM558 | switchgrass\|gb167\|FL711630 | 5821 | 514 | 86.8 | globlastp |
| 1699 | LYM558 | sorghum\|09v1\|SB09G028990 | 5822 | 514 | 83.8 | globlastp |
| 1700 | LYM558 | sorghum\|12v1\|SB09G028990_P1 | 5822 | 514 | 83.8 | globlastp |
| 1701 | LYM558 | sugarcane\|10v1\|BU103681 | 5823 | 514 | 82.8 | globlastp |
| 1702 | LYM559 | foxtail_millet\|10v2\|SICRP003418 | 5824 | 515 | 92.08 | glotblastn |
| 1703 | LYM559 | sorghum\|09v1\|SB02G026450 | 5825 | 515 | 87.8 | globlastp |
| 1704 | LYM559 | sorghum\|12v1\|SB02G026450_P1 | 5825 | 515 | 87.8 | globlastp |
| 1705 | LYM559 | maize\|10v1\|BM350744_P1 | 5826 | 515 | 86.3 | globlastp |
| 1706 | LYM559 | foxtail_millet\|10v2\|FXTRMSLX01366155D1 | 5827 | 515 | 83.05 | glotblastn |
| 1707 | LYM560 | foxtail_millet\|10v2\|SICRP015240 | 5828 | 516 | 94.42 | glotblastn |
| 1708 | LYM560 | switchgrass\|gb167\|DN141011 | 5829 | 516 | 83 | globlastp |
| 1709 | LYM561 | foxtail_millet\|11v3\|PHY7SI025849M_T1 | 5830 | 517 | 89.55 | glotblastn |
| 1710 | LYM561 | sorghum\|09v1\|SB02G039350 | 5831 | 517 | 80.16 | glotblastn |
| 1711 | LYM562 | foxtail_millet\|10v2\|FXTRMSLX06600357D1 | 5832 | 518 | 82 | globlastp |
| 1712 | LYM563 | foxtail_millet\|10v2\|SICRP004257 | 5833 | 519 | 97.4 | globlastp |
| 1713 | LYM563 | maize\|10v1\|AW267479_P1 | 5834 | 519 | 85.8 | globlastp |
| 1714 | LYM563 | sorghum\|09v1\|SB05G004540 | 5835 | 519 | 85.6 | globlastp |
| 1715 | LYM563 | switchgrass\|gb167\|FL711224 | 5836 | 519 | 80.81 | glotblastn |
| 1716 | LYM563 | rice\|11v1\|BI805043_P1 | 5837 | 519 | 80 | globlastp |
| 1717 | LYM563 | rice\|gb170\|OS11G06900 | 5837 | 519 | 80 | globlastp |
| 1718 | LYM564 | foxtail_millet\|11v3\|SOLX00016276_P1 | 5838 | 520 | 95.7 | globlastp |
| 1719 | LYM564 | foxtail_millet\|11v3\|EC613248_P1 | 5839 | 520 | 92.3 | globlastp |
| 1720 | LYM564 | switchgrass\|gb167\|FE632843 | 5840 | 520 | 88.5 | globlastp |
| 1721 | LYM564 | switchgrass\|gb167\|FE637402 | 5841 | 520 | 87.1 | globlastp |
| 1722 | LYM564 | sugarcane\|10v1\|CA134086 | 5842 | 520 | 84.3 | globlastp |
| 1723 | LYM564 | sorghum\|09v1\|SB08G001140 | 5843 | 520 | 84.13 | glotblastn |
| 1724 | LYM564 | sorghum\|12v1\|SB08G001140_T1 | 5843 | 520 | 84.13 | glotblastn |
| 1725 | LYM564 | sugarcane\|10v1\|CA150206 | 5844 | 520 | 84.13 | glotblastn |
| 1726 | LYM564 | sorghum\|09v1\|SB05G002590 | 5845 | 520 | 83.5 | globlastp |
| 1727 | LYM564 | sorghum\|12v1\|SB05G002590_P1 | 5846 | 520 | 83 | globlastp |
| 1728 | LYM565 | foxtail_millet\|11v3\|PHY7SI036120M_P1 | 5847 | 521 | 86.3 | globlastp |
| 1729 | LYM567 | maize\|10v1\|AI711933_P1 | 5848 | 523 | 98.9 | globlastp |
| 1730 | LYM567 | maize\|10v1\|AI649845_P1 | 5849 | 523 | 89 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1731 | LYM567 | maize\|10v1\|AW562839_T1 | 5850 | 523 | 83.15 | glotblastn |
| 1732 | LYM567 | sugarcane\|10v1\|AY093807 | 5851 | 523 | 82 | globlastp |
| 1733 | LYM567 | sugarcane\|10v1\|CF570865 | 5851 | 523 | 82 | globlastp |
| 1734 | LYM568 | sorghum\|09v1\|SB10G024430 | 5852 | 524 | 88.2 | globlastp |
| 1735 | LYM568 | sorghum\|12v1\|SB10G024430_P1 | 5852 | 524 | 88.2 | globlastp |
| 1736 | LYM568 | foxtail_millet\|11v3\|EC613377_P1 | 5853 | 524 | 84.5 | globlastp |
| 1737 | LYM568 | foxtail_millet\|10v2\|SICRP023543 | 5853 | 524 | 84.5 | globlastp |
| 1738 | LYM568 | switchgrass\|gb167\|FL856967 | 5854 | 524 | 81.9 | globlastp |
| 1739 | LYM569 | sorghum\|09v1\|SB10G001000 | 5855 | 525 | 99.1 | globlastp |
| 1740 | LYM569 | sorghum\|12v1\|SB10G001000_P1 | 5855 | 525 | 99.1 | globlastp |
| 1741 | LYM569 | sugarcane\|10v1\|CA102886 | 5855 | 525 | 99.1 | globlastp |
| 1742 | LYM569 | rice\|11v1\|AA751733_P1 | 5856 | 525 | 97.4 | globlastp |
| 1743 | LYM569 | rice\|gb170\|OS04G32550 | 5856 | 525 | 97.4 | globlastp |
| 1744 | LYM569 | foxtail_millet\|11v3\|PHY7SI007563M_P1 | 5857 | 525 | 96.5 | globlastp |
| 1745 | LYM569 | millet\|10v1\|CD724342_T1 | 5858 | 525 | 96.49 | glotblastn |
| 1746 | LYM569 | millet\|10v1\|EVO454PM061583_P1 | 5859 | 525 | 95.6 | globlastp |
| 1747 | LYM569 | switchgrass\|gb167\|FL731047 | 5860 | 525 | 95.6 | globlastp |
| 1748 | LYM569 | switchgrass\|gb167\|FL737252 | 5861 | 525 | 95.6 | globlastp |
| 1749 | LYM569 | switchgrass\|gb167\|DN152051 | 5862 | 525 | 93.9 | globlastp |
| 1750 | LYM569 | switchgrass\|gb167\|FL847271 | 5863 | 525 | 93.9 | globlastp |
| 1751 | LYM569 | lovegrass\|gb167\|EH186168_P1 | 5864 | 525 | 93 | globlastp |
| 1752 | LYM569 | foxtail_millet\|10v2\|SICRP022725 | 5865 | 525 | 92.98 | glotblastn |
| 1753 | LYM569 | rye\|12v1\|DRR001012.135665_P1 | 5866 | 525 | 92.1 | globlastp |
| 1754 | LYM569 | rye\|12v1\|DRR001012.166400_P1 | 5867 | 525 | 92.1 | globlastp |
| 1755 | LYM569 | rye\|12v1\|DRR001012.433699_P1 | 5867 | 525 | 92.1 | globlastp |
| 1756 | LYM569 | rye\|12v1\|DRR001012.57130_P1 | 5867 | 525 | 92.1 | globlastp |
| 1757 | LYM569 | rye\|12v1\|DRR001013.84512_P1 | 5867 | 525 | 92.1 | globlastp |
| 1758 | LYM569 | cynodon\|10v1\|ES293242_P1 | 5868 | 525 | 92.1 | globlastp |
| 1759 | LYM569 | oat\|10v2\|GO595608 | 5869 | 525 | 92.1 | globlastp |
| 1760 | LYM569 | oat\|11v1\|GO595608_P1 | 5869 | 525 | 92.1 | globlastp |
| 1761 | LYM569 | pseudoroegneria\|gb167\|FF352787 | 5870 | 525 | 92.1 | globlastp |
| 1762 | LYM569 | barley\|10v2\|AJ133277_P1 | 5871 | 525 | 91.2 | globlastp |
| 1763 | LYM569 | brachypodium\|09v1\|DV478300 | 5872 | 525 | 91.2 | globlastp |
| 1764 | LYM569 | brachypodium\|12v1\|BRADI1G50180_P1 | 5872 | 525 | 91.2 | globlastp |
| 1765 | LYM569 | oat\|10v2\|GO589295 | 5873 | 525 | 91.2 | globlastp |
| 1766 | LYM569 | oat\|11v1\|GR332022_P1 | 5873 | 525 | 91.2 | globlastp |
| 1767 | LYM569 | wheat\|10v2\|BG274246 | 5874 | 525 | 91.2 | globlastp |
| 1768 | LYM569 | wheat\|10v2\|CA678648 | 5875 | 525 | 91.2 | globlastp |
| 1769 | LYM569 | barley\|10v2\|AJ133276_P1 | 5876 | 525 | 90.4 | globlastp |
| 1770 | LYM569 | lovegrass\|gb167\|DN480812_P1 | 5877 | 525 | 90.4 | globlastp |
| 1771 | LYM569 | oat\|11v1\|CN815213_P1 | 5878 | 525 | 90.4 | globlastp |
| 1772 | LYM569 | oat\|11v1\|GO589295_T1 | 5879 | 525 | 90.35 | glotblastn |
| 1773 | LYM569 | rye\|12v1\|DRR001018.26070_P1 | 5880 | 525 | 89.5 | globlastp |
| 1774 | LYM569 | rye\|12v1\|DRR001012.112809_P1 | 5881 | 525 | 88.6 | globlastp |
| 1775 | LYM569 | rye\|12v1\|DRR001012.236543_P1 | 5882 | 525 | 88.6 | globlastp |
| 1776 | LYM569 | wheat\|10v2\|AL824839 | 5883 | 525 | 88.6 | globlastp |
| 1777 | LYM569 | cleome_spinosa\|10v1\|GR934275_P1 | 5884 | 525 | 87.8 | globlastp |
| 1778 | LYM569 | castorbean\|09v1\|XM002518942 | 5885 | 525 | 87 | globlastp |
| 1779 | LYM569 | nasturtium\|10v1\|SRR032558S0002326 | 5886 | 525 | 87 | globlastp |
| 1780 | LYM569 | nasturtium\|11v1\|SRR032558.11557_P1 | 5886 | 525 | 87 | globlastp |
| 1781 | LYM569 | beech\|11v1\|SRR006293.23795_P1 | 5887 | 525 | 87 | globlastp |
| 1782 | LYM569 | castorbean\|11v1\|XM_002518942_T1 | 5888 | 525 | 86.96 | glotblastn |
| 1783 | LYM569 | rye\|12v1\|DRR001013.178697_P1 | 5889 | 525 | 86.3 | globlastp |
| 1784 | LYM569 | hornbeam\|12v1\|SRR364455.100879_P1 | 5890 | 525 | 86.1 | globlastp |
| 1785 | LYM569 | thellungiella_halophilum\|11v1\|EHJGI11000488_P1 | 5891 | 525 | 86.1 | globlastp |
| 1786 | LYM569 | amaranthus\|10v1\|SRR039411S0053406_P1 | 5892 | 525 | 86.1 | globlastp |
| 1787 | LYM569 | cassava\|09v1\|CK645867_P1 | 5893 | 525 | 86.1 | globlastp |
| 1788 | LYM569 | cassava\|09v1\|CK650484_P1 | 5894 | 525 | 86.1 | globlastp |
| 1789 | LYM569 | citrus\|gb166\|AB011799 | 5895 | 525 | 86.1 | globlastp |
| 1790 | LYM569 | clementine\|11v1\|AB011799_P1 | 5895 | 525 | 86.1 | globlastp |
| 1791 | LYM569 | poplar\|10v1\|BI124668_P1 | 5896 | 525 | 86.1 | globlastp |
| 1792 | LYM569 | fagopyrum\|11v1\|SRR063689X101291_T1 | 5897 | 525 | 86.09 | glotblastn |
| 1793 | LYM569 | rye\|12v1\|DRR001015.117089_T1 | 5898 | 525 | 86.09 | glotblastn |
| 1794 | LYM569 | beech\|gb170\|SRR006293S0002706 | 5899 | 525 | 86.09 | glotblastn |
| 1795 | LYM569 | coffea\|10v1\|DV672822_P1 | 5900 | 525 | 85.3 | globlastp |
| 1796 | LYM569 | pepper\|gb171\|BM063546_P1 | 5901 | 525 | 85.3 | globlastp |
| 1797 | LYM569 | eucalyptus\|11v2\|CT980471_P1 | 5902 | 525 | 85.2 | globlastp |
| 1798 | LYM569 | thellungiella_halophilum\|11v1\|EHJGI11005759_P1 | 5903 | 525 | 85.2 | globlastp |
| 1799 | LYM569 | watermelon\|11v1\|CV002048_P1 | 5904 | 525 | 85.2 | globlastp |
| 1800 | LYM569 | arabidopsis_lyrata\|09v1\|JGIAL003345_P1 | 5903 | 525 | 85.2 | globlastp |
| 1801 | LYM569 | arabidopsis\|10v1\|AT2G35520_P1 | 5905 | 525 | 85.2 | globlastp |
| 1802 | LYM569 | aristolochia\|10v1\|FD750442_P1 | 5906 | 525 | 85.2 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1803 | LYM569 | b_juncea|10v2|E6ANDIZ01A8DK2_P1 | 5907 | 525 | 85.2 | globlastp |
| 1804 | LYM569 | banana|10v1|FF557800_P1 | 5908 | 525 | 85.2 | globlastp |
| 1805 | LYM569 | castorbean|09v1|XM002521492 | 5909 | 525 | 85.2 | globlastp |
| 1806 | LYM569 | castorbean|11v1|XM_002521492_P1 | 5909 | 525 | 85.2 | globlastp |
| 1807 | LYM569 | chestnut|gb170|SRR006295S0004082_P1 | 5910 | 525 | 85.2 | globlastp |
| 1808 | LYM569 | cucumber|09v1|CV002048_P1 | 5911 | 525 | 85.2 | globlastp |
| 1809 | LYM569 | eucalyptus|11v1|CT980471 | 5902 | 525 | 85.2 | globlastp |
| 1810 | LYM569 | melon|10v1|AM715563_P1 | 5912 | 525 | 85.2 | globlastp |
| 1811 | LYM569 | momordica|10v1|SRR071315S0004489_P1 | 5913 | 525 | 85.2 | globlastp |
| 1812 | LYM569 | papaya|gb165|EX259202_P1 | 5914 | 525 | 85.2 | globlastp |
| 1813 | LYM569 | radish|gb164|EV544740 | 5907 | 525 | 85.2 | globlastp |
| 1814 | LYM569 | radish|gb164|EW716733 | 5907 | 525 | 85.2 | globlastp |
| 1815 | LYM569 | radish|gb164|EX775751 | 5907 | 525 | 85.2 | globlastp |
| 1816 | LYM569 | aquilegia|10v2|JGIAC001698 | 5915 | 525 | 85.09 | glotblastn |
| 1817 | LYM569 | bupleurum|11v1|SRR301254.10188_P1 | 5916 | 525 | 84.6 | globlastp |
| 1818 | LYM569 | bupleurum|11v1|SRR301254.103177_P1 | 5916 | 525 | 84.6 | globlastp |
| 1819 | LYM569 | bupleurum|11v1|SRR301254.116549_P1 | 5916 | 525 | 84.6 | globlastp |
| 1820 | LYM569 | arabidopsis_lyrata|09v1|JGIAL014691_P1 | 5917 | 525 | 84.5 | globlastp |
| 1821 | LYM569 | potato|10v1|BG591267_P1 | 5918 | 525 | 84.5 | globlastp |
| 1822 | LYM569 | canola|11v1|SRR329661.114307_T1 | 5919 | 525 | 84.35 | glotblastn |
| 1823 | LYM569 | cucurbita|11v1|SRR091276X112807_T1 | 5920 | 525 | 84.35 | glotblastn |
| 1824 | LYM569 | cucurbita|11v1|SRR091276X116524_T1 | 5921 | 525 | 84.35 | glotblastn |
| 1825 | LYM569 | cucurbita|11v1|SRR091276X130274XX1_T1 | 5921 | 525 | 84.35 | glotblastn |
| 1826 | LYM569 | fagopyrum|11v1|SRR063703X10184_T1 | 5922 | 525 | 84.35 | glotblastn |
| 1827 | LYM569 | canola|11v1|CN736367_P1 | 5923 | 525 | 84.3 | globlastp |
| 1828 | LYM569 | euonymus|11v1|SRR070038X105435_P1 | 5924 | 525 | 84.3 | globlastp |
| 1829 | LYM569 | fagopyrum|11v1|SRR063689X100301_P1 | 5925 | 525 | 84.3 | globlastp |
| 1830 | LYM569 | fagopyrum|11v1|SRR063703X102261_P1 | 5925 | 525 | 84.3 | globlastp |
| 1831 | LYM569 | humulus|11v1|GD242916_P1 | 5926 | 525 | 84.3 | globlastp |
| 1832 | LYM569 | phalaenopsis|11v1|SRR125771.100895_P1 | 5927 | 525 | 84.3 | globlastp |
| 1833 | LYM569 | thellungiella_parvulum|11v1|EPPRD000939_P1 | 5928 | 525 | 84.3 | globlastp |
| 1834 | LYM569 | arabidopsis|10v1|AT1G32210_P1 | 5929 | 525 | 84.3 | globlastp |
| 1835 | LYM569 | b_juncea|10v2|E6ANDIZ01A500U_P1 | 5923 | 525 | 84.3 | globlastp |
| 1836 | LYM569 | b_juncea|10v2|E6ANDIZ01DNBNW_P1 | 5930 | 525 | 84.3 | globlastp |
| 1837 | LYM569 | b_rapa|11v1|CD812217_P1 | 5923 | 525 | 84.3 | globlastp |
| 1838 | LYM569 | b_rapa|gb162|DN191621 | 5923 | 525 | 84.3 | globlastp |
| 1839 | LYM569 | b_rapa|11v1|DN191822_P1 | 5930 | 525 | 84.3 | globlastp |
| 1840 | LYM569 | b_rapa|gb162|DN191822 | 5930 | 525 | 84.3 | globlastp |
| 1841 | LYM569 | bean|12v1|CA898853_P1 | 5931 | 525 | 84.3 | globlastp |
| 1842 | LYM569 | bean|gb167|CA898853 | 5931 | 525 | 84.3 | globlastp |
| 1843 | LYM569 | canola|10v1|CD822400 | 5923 | 525 | 84.3 | globlastp |
| 1844 | LYM569 | canola|11v1|CN734981_P1 | 5923 | 525 | 84.3 | globlastp |
| 1845 | LYM569 | cleome_gynandra|10v1|SRR015532S0014291_P1 | 5932 | 525 | 84.3 | globlastp |
| 1846 | LYM569 | cyamopsis|10v1|EG984797_P1 | 5933 | 525 | 84.3 | globlastp |
| 1847 | LYM569 | liquorice|gb171|FS249339_P1 | 5934 | 525 | 84.3 | globlastp |
| 1848 | LYM569 | pigeonpea|10v1|SRR054580S0016324 | 5935 | 525 | 84.3 | globlastp |
| 1849 | LYM569 | pigeonpea|11v1|SRR054580X142008_P1 | 5935 | 525 | 84.3 | globlastp |
| 1850 | LYM569 | poplar|10v1|AI166745_P1 | 5936 | 525 | 84.3 | globlastp |
| 1851 | LYM569 | radish|gb164|EV544449 | 5923 | 525 | 84.3 | globlastp |
| 1852 | LYM569 | cichorium|gb171|EL365522_T1 | 5937 | 525 | 84.21 | glotblastn |
| 1853 | LYM569 | lettuce|10v1|DW044153_T1 | 5938 | 525 | 84.21 | glotblastn |
| 1854 | LYM569 | centaurea|gb166|EH715505_P1 | 5939 | 525 | 83.8 | globlastp |
| 1855 | LYM569 | senecio|gb170|SRR006592S0005216 | 5940 | 525 | 83.6 | globlastp |
| 1856 | LYM569 | solanum_phureja|09v1|SPHBG124835 | 5941 | 525 | 83.6 | globlastp |
| 1857 | LYM569 | tomato|09v1|BG124835 | 5941 | 525 | 83.6 | globlastp |
| 1858 | LYM569 | euonymus|11v1|SRR070038X134639_P1 | 5942 | 525 | 83.5 | globlastp |
| 1859 | LYM569 | flax|11v1|JG022750_P1 | 5943 | 525 | 83.5 | globlastp |
| 1860 | LYM569 | flax|11v1|JG028460_P1 | 5944 | 525 | 83.5 | globlastp |
| 1861 | LYM569 | phalaenopsis|11v1|SRR125771.1011736_P1 | 5945 | 525 | 83.5 | globlastp |
| 1862 | LYM569 | plantago|11v2|AM156929_P1 | 5946 | 525 | 83.5 | globlastp |
| 1863 | LYM569 | b_juncea|10v2|E6ANDIZ01ATXEV_P1 | 5947 | 525 | 83.5 | globlastp |
| 1864 | LYM569 | b_oleracea|gb161|DY026178_P1 | 5948 | 525 | 83.5 | globlastp |
| 1865 | LYM569 | beet|12v1|CK136226_P1 | 5949 | 525 | 83.5 | globlastp |
| 1866 | LYM569 | beet|gb162|BQ585754 | 5949 | 525 | 83.5 | globlastp |
| 1867 | LYM569 | canola|10v1|CD812217 | 5948 | 525 | 83.5 | globlastp |
| 1868 | LYM569 | canola|11v1|CN726552_P1 | 5948 | 525 | 83.5 | globlastp |
| 1869 | LYM569 | clementine|11v1|BQ623910_P1 | 5950 | 525 | 83.5 | globlastp |
| 1870 | LYM569 | cowpea|gb166|FF383181_P1 | 5951 | 525 | 83.5 | globlastp |
| 1871 | LYM569 | peanut|10v1|EE123987_P1 | 5952 | 525 | 83.5 | globlastp |
| 1872 | LYM569 | cucurbita|11v1|SRR091276X109664_T1 | 5953 | 525 | 83.48 | glotblastn |
| 1873 | LYM569 | cleome_spinosa|10v1|SRR015531S0046425_T1 | 5954 | 525 | 83.33 | glotblastn |
| 1874 | LYM569 | prunus|10v1|BU047738 | 5955 | 525 | 83.33 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1875 | LYM569 | heritiera\|10v1\|SRR005795S0011088_P1 | 5956 | 525 | 83.3 | globlastp |
| 1876 | LYM569 | cotton\|10v2\|BF274764 | — | 525 | 82.91 | glotblastn |
| 1877 | LYM569 | bupleurum\|11v1\|SRR301254.22559_P1 | 5957 | 525 | 82.9 | globlastp |
| 1878 | LYM569 | cotton\|11v1\|BE053073_P1 | 5958 | 525 | 82.9 | globlastp |
| 1879 | LYM569 | cotton\|11v1\|DW512115_P1 | 5959 | 525 | 82.9 | globlastp |
| 1880 | LYM569 | gossypium_raimondii\|12v1\|BE053073_P1 | 5958 | 525 | 82.9 | globlastp |
| 1881 | LYM569 | gossypium_raimondii\|12v1\|BF276515_P1 | 5959 | 525 | 82.9 | globlastp |
| 1882 | LYM569 | cotton\|11v1\|BF274764XX1_P1 | 5959 | 525 | 82.9 | globlastp |
| 1883 | LYM569 | tragopogon\|10v1\|SRR020205S0030697 | 5960 | 525 | 82.9 | globlastp |
| 1884 | LYM569 | olea\|11v1\|SRR014463.48353_P1 | 5961 | 525 | 82.8 | globlastp |
| 1885 | LYM569 | scabiosa\|11v1\|SRR063723X100675_P1 | 5962 | 525 | 82.8 | globlastp |
| 1886 | LYM569 | valeriana\|11v1\|SRR099039X102388_P1 | 5963 | 525 | 82.8 | globlastp |
| 1887 | LYM569 | eggplant\|10v1\|FS007622_P1 | 5964 | 525 | 82.8 | globlastp |
| 1888 | LYM569 | heritiera\|10v1\|SRR005794S0000485_P1 | 5965 | 525 | 82.8 | globlastp |
| 1889 | LYM569 | kiwi\|gb166\|FG468889_P1 | 5966 | 525 | 82.8 | globlastp |
| 1890 | LYM569 | kiwi\|gb166\|FG502864_P1 | 5967 | 525 | 82.8 | globlastp |
| 1891 | LYM569 | petunia\|gb171\|AY227437_P1 | 5968 | 525 | 82.8 | globlastp |
| 1892 | LYM569 | tea\|10v1\|GE651415 | 5969 | 525 | 82.8 | globlastp |
| 1893 | LYM569 | platanus\|11v1\|SRR096786X201688_T1 | 5937 | 525 | 82.61 | glotblastn |
| 1894 | LYM569 | tamarix\|gb166\|EH050677 | 5970 | 525 | 82.61 | glotblastn |
| 1895 | LYM569 | amorphophallus\|11v2\|SRR089351X106271_P1 | 5971 | 525 | 82.6 | globlastp |
| 1896 | LYM569 | amorphophallus\|11v2\|SRR089351X109124_P1 | 5972 | 525 | 82.6 | globlastp |
| 1897 | LYM569 | cannabis\|12v1\|SOLX00017739_P1 | 5973 | 525 | 82.6 | globlastp |
| 1898 | LYM569 | oil_palm\|11v1\|EL692917_P1 | 5974 | 525 | 82.6 | globlastp |
| 1899 | LYM569 | oil_palm\|11v1\|EY412992_P1 | 5975 | 525 | 82.6 | globlastp |
| 1900 | LYM569 | banana\|10v1\|FF559065_P1 | 5976 | 525 | 82.6 | globlastp |
| 1901 | LYM569 | lotus\|09v1\|LLCB829384_P1 | 5977 | 525 | 82.6 | globlastp |
| 1902 | LYM569 | oil_palm\|gb166\|EL692917 | 5974 | 525 | 82.6 | globlastp |
| 1903 | LYM569 | eschscholzia\|11v1\|CD478253_T1 | 5978 | 525 | 82.46 | glotblastn |
| 1904 | LYM569 | sarracenia\|11v1\|SRR192669.102986_T1 | 5979 | 525 | 82.46 | glotblastn |
| 1905 | LYM569 | strawberry\|11v1\|DY673771 | 5980 | 525 | 82.46 | glotblastn |
| 1906 | LYM569 | triphysaria\|10v1\|EY131424 | 5981 | 525 | 82.46 | glotblastn |
| 1907 | LYM569 | tabernaemontana\|11v1\|SRR098689X101117_P1 | 5982 | 525 | 82.4 | globlastp |
| 1908 | LYM569 | vinca\|11v1\|SRR098690X222500_P1 | 5983 | 525 | 82.4 | globlastp |
| 1909 | LYM569 | flaveria\|11v1\|SRR149229.10081_P1 | 5984 | 525 | 82.1 | globlastp |
| 1910 | LYM569 | flaveria\|11v1\|SRR149229.230770_P1 | 5985 | 525 | 82.1 | globlastp |
| 1911 | LYM569 | flaveria\|11v1\|SRR149232.118105_P1 | 5984 | 525 | 82.1 | globlastp |
| 1912 | LYM569 | flaveria\|11v1\|SRR149232.123588_P1 | 5986 | 525 | 82.1 | globlastp |
| 1913 | LYM569 | sunflower\|12v1\|CD846762_P1 | 5987 | 525 | 82.1 | globlastp |
| 1914 | LYM569 | dandelion\|10v1\|DY810922_P1 | 5988 | 525 | 82.1 | globlastp |
| 1915 | LYM569 | sunflower\|10v1\|EE657889 | 5989 | 525 | 82.1 | globlastp |
| 1916 | LYM569 | sunflower\|12v1\|DY916109_P1 | 5989 | 525 | 82.1 | globlastp |
| 1917 | LYM569 | flaveria\|11v1\|SRR149229.105886_P1 | 5990 | 525 | 81.9 | globlastp |
| 1918 | LYM569 | fraxinus\|11v1\|SRR058827.103870_P1 | 5991 | 525 | 81.9 | globlastp |
| 1919 | LYM569 | phyla\|11v2\|SRR099037X116212_P1 | 5992 | 525 | 81.9 | globlastp |
| 1920 | LYM569 | soybean\|11v1\|GLYMA14G38220 | 5993 | 525 | 81.9 | globlastp |
| 1921 | LYM569 | tea\|10v1\|GE652807 | 5994 | 525 | 81.9 | globlastp |
| 1922 | LYM569 | tobacco\|gb162\|AB219466 | 5995 | 525 | 81.9 | globlastp |
| 1923 | LYM569 | oak\|10v1\|CR627568_T1 | 5996 | 525 | 81.74 | glotblastn |
| 1924 | LYM569 | safflower\|gb162\|EL400737 | 5997 | 525 | 81.74 | glotblastn |
| 1925 | LYM569 | euphorbia\|11v1\|BP961349_P1 | 5998 | 525 | 81.7 | globlastp |
| 1926 | LYM569 | antirrhinum\|gb166\|AJ559287_P1 | 5999 | 525 | 81.7 | globlastp |
| 1927 | LYM569 | cleome_gynandra\|10v1\|SRR015532S0012292_P1 | 6000 | 525 | 81.7 | globlastp |
| 1928 | LYM569 | ginger\|gb164\|DY362521_P1 | 6001 | 525 | 81.7 | globlastp |
| 1929 | LYM569 | grape\|11v1\|GSVIVT01013064001_P1 | 6002 | 525 | 81.7 | globlastp |
| 1930 | LYM569 | grape\|gb160\|CB340205 | 6002 | 525 | 81.7 | globlastp |
| 1931 | LYM569 | silene\|11v1\|SRR096785X105699_T1 | 6003 | 525 | 81.58 | glotblastn |
| 1932 | LYM569 | prunus\|10v1\|MDU68560 | 6004 | 525 | 81.58 | glotblastn |
| 1933 | LYM569 | soybean\|11v1\|GLYMA09G34100 | 6005 | 525 | 81.58 | glotblastn |
| 1934 | LYM569 | cirsium\|11v1\|SRR346952.118405_P1 | 6006 | 525 | 81.4 | globlastp |
| 1935 | LYM569 | lettuce\|10v1\|DW064197_P1 | 6007 | 525 | 81.4 | globlastp |
| 1936 | LYM569 | lettuce\|10v1\|DW077121_P1 | 6007 | 525 | 81.4 | globlastp |
| 1937 | LYM569 | sunflower\|10v1\|CD853666 | 6008 | 525 | 81.4 | globlastp |
| 1938 | LYM569 | sunflower\|12v1\|CD853666_P1 | 6008 | 525 | 81.4 | globlastp |
| 1939 | LYM569 | arnica\|11v1\|SRR099034X119762_P1 | 6009 | 525 | 81.2 | globlastp |
| 1940 | LYM569 | cirsium\|11v1\|SRR346952.101479_P1 | 6010 | 525 | 81.2 | globlastp |
| 1941 | LYM569 | cirsium\|11v1\|SRR346952.1015198_P1 | 6011 | 525 | 81.2 | globlastp |
| 1942 | LYM569 | flaveria\|11v1\|SRR149232.113067_P1 | 6012 | 525 | 81.2 | globlastp |
| 1943 | LYM569 | flaveria\|11v1\|SRR149232.176507_P1 | 6013 | 525 | 81.2 | globlastp |
| 1944 | LYM569 | flaveria\|11v1\|SRR149244.165800_P1 | 6014 | 525 | 81.2 | globlastp |
| 1945 | LYM569 | sunflower\|12v1\|EE657889_P1 | 6015 | 525 | 81.2 | globlastp |
| 1946 | LYM569 | utricularia\|11v1\|SRR094438.104568_P1 | 6016 | 525 | 81.2 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 1947 | LYM569 | artemisia\|10v1\|EY036948_T1 | 6017 | 525 | 81.2 | glotblastn |
| 1948 | LYM569 | cynara\|gb167\|GE590262_P1 | 6010 | 525 | 81.2 | globlastp |
| 1949 | LYM569 | ginseng\|10v1\|DV554463_P1 | 6018 | 525 | 81.2 | globlastp |
| 1950 | LYM569 | sunflower\|10v1\|AJ828597 | 6015 | 525 | 81.2 | globlastp |
| 1951 | LYM569 | sunflower\|10v1\|CD846762 | 6019 | 525 | 81.2 | globlastp |
| 1952 | LYM569 | sunflower\|12v1\|AJ828597_P1 | 6015 | 525 | 81.2 | globlastp |
| 1953 | LYM569 | sunflower\|12v1\|EL465354_P1 | 6020 | 525 | 81.2 | globlastp |
| 1954 | LYM569 | euphorbia\|11v1\|BP953547_P1 | 6021 | 525 | 81 | globlastp |
| 1955 | LYM569 | olea\|11v1\|SRR014463.1314_P1 | 6022 | 525 | 81 | globlastp |
| 1956 | LYM569 | phyla\|11v2\|SRR099035X134712_P1 | 6023 | 525 | 81 | globlastp |
| 1957 | LYM569 | ipomoea_nil\|10v1\|BJ562169_P1 | 6024 | 525 | 81 | globlastp |
| 1958 | LYM569 | salvia\|10v1\|CV162894 | 6025 | 525 | 81 | globlastp |
| 1959 | LYM569 | salvia\|10v1\|SRR014553S0008302 | 6026 | 525 | 81 | globlastp |
| 1960 | LYM569 | sesame\|10v1\|BU670529 | 6027 | 525 | 81 | globlastp |
| 1961 | LYM569 | ginger\|gb164\|DY359761_P1 | 6028 | 525 | 80.9 | globlastp |
| 1962 | LYM569 | triphysaria\|10v1\|EY016755 | 6029 | 525 | 80.9 | globlastp |
| 1963 | LYM569 | acacia\|10v1\|GR480985_T1 | 6030 | 525 | 80.87 | glotblastn |
| 1964 | LYM569 | catharanthus\|11v1\|EG562088_P1 | 6031 | 525 | 80.8 | globlastp |
| 1965 | LYM569 | ambrosia\|11v1\|SRR346935.378400_P1 | 6032 | 525 | 80.7 | globlastp |
| 1966 | LYM569 | ambrosia\|11v1\|SRR346943.158491_P1 | 6032 | 525 | 80.7 | globlastp |
| 1967 | LYM569 | phyla\|11v2\|SRR099037X119521_T1 | 6033 | 525 | 80.7 | glotblastn |
| 1968 | LYM569 | avocado\|10v1\|DT594689_P1 | 6034 | 525 | 80.7 | globlastp |
| 1969 | LYM569 | tobacco\|gb162\|EB445698 | 6035 | 525 | 80.7 | glotblastn |
| 1970 | LYM569 | triphysaria\|10v1\|EY157452 | 6036 | 525 | 80.7 | glotblastn |
| 1971 | LYM569 | rose\|10v1\|BQ105582 | 6037 | 525 | 80.67 | glotblastn |
| 1972 | LYM569 | rose\|12v1\|BQ105582_T1 | 6038 | 525 | 80.67 | glotblastn |
| 1973 | LYM569 | ambrosia\|11v1\|SRR346943.100571_T1 | 6039 | 525 | 80.51 | glotblastn |
| 1974 | LYM569 | cichorium\|gb171\|EH706520_P1 | 6040 | 525 | 80.5 | globlastp |
| 1975 | LYM569 | cynara\|gb167\|GE586619_P1 | 6041 | 525 | 80.5 | globlastp |
| 1976 | LYM569 | dandelion\|10v1\|DY821857_P1 | 6042 | 525 | 80.5 | globlastp |
| 1977 | LYM569 | aquilegia\|10v2\|JGIAC000753 | 6043 | 525 | 80.33 | glotblastn |
| 1978 | LYM569 | sunflower\|12v1\|EL431559_P1 | 6044 | 525 | 80.3 | globlastp |
| 1979 | LYM569 | gerbera\|09v1\|AJ751921_P1 | 6045 | 525 | 80.3 | globlastp |
| 1980 | LYM569 | sunflower\|10v1\|EL431559 | 6046 | 525 | 80.3 | globlastp |
| 1981 | LYM569 | sarracenia\|11v1\|SRR192669.101455_P1 | 6047 | 525 | 80.2 | globlastp |
| 1982 | LYM569 | sarracenia\|11v1\|SRR192669.115702_P1 | 6047 | 525 | 80.2 | globlastp |
| 1983 | LYM569 | amborella\|12v2\|CK763832_T1 | 6048 | 525 | 80.17 | glotblastn |
| 1984 | LYM569 | amborella\|gb166\|CK763832 | 6048 | 525 | 80.17 | glotblastn |
| 1985 | LYM569 | medicago\|09v1\|BF637130 | 6049 | 525 | 80 | globlastp |
| 1986 | LYM569 | medicago\|12v1\|BF637130_P1 | 6049 | 525 | 80 | globlastp |
| 1987 | LYM569 | tamarix\|gb166\|EG970118 | 6050 | 525 | 80 | globlastp |
| 1988 | LYM570 | sorghum\|09v1\|SB03G045180 | 6051 | 526 | 96.4 | globlastp |
| 1989 | LYM570 | sorghum\|12v1\|SB03G045180_P1 | 6051 | 526 | 96.4 | globlastp |
| 1990 | LYM570 | foxtail_millet\|11v3\|PHY7SI000375M_P1 | 6052 | 526 | 94.8 | globlastp |
| 1991 | LYM570 | foxtail_millet\|10v2\|FXTRMSLX00164057D1 | 6052 | 526 | 94.8 | globlastp |
| 1992 | LYM570 | millet\|10v1\|EVO454PM002284_P1 | 6053 | 526 | 93.7 | globlastp |
| 1993 | LYM570 | brachypodium\|12v1\|BRADI2G60090T2_P1 | 6054 | 526 | 88.8 | globlastp |
| 1994 | LYM570 | brachypodium\|09v1\|GT820385 | 6055 | 526 | 88.78 | glotblastn |
| 1995 | LYM570 | rice\|11v1\|CA998043_P1 | 6056 | 526 | 86.6 | globlastp |
| 1996 | LYM570 | rice\|gb170\|OS01G70940 | 6056 | 526 | 86.6 | globlastp |
| 1997 | LYM571 | sorghum\|09v1\|SB01G008860 | 6057 | 527 | 99.2 | globlastp |
| 1998 | LYM571 | sorghum\|12v1\|SB01G008860_P1 | 6057 | 527 | 99.2 | globlastp |
| 1999 | LYM571 | maize\|10v1\|AI857221_P1 | 6058 | 527 | 98.6 | globlastp |
| 2000 | LYM571 | switchgrass\|gb167\|DN144097 | 6059 | 527 | 97.4 | globlastp |
| 2001 | LYM571 | millet\|10v1\|EVO454PM003239_P1 | 6060 | 527 | 96.6 | globlastp |
| 2002 | LYM571 | foxtail_millet\|11v3\|PHY7SI034713M_P1 | 6061 | 527 | 96.3 | globlastp |
| 2003 | LYM571 | rice\|11v1\|BI807786_P1 | 6062 | 527 | 93.1 | globlastp |
| 2004 | LYM571 | rice\|gb170\|OS03G52630 | 6062 | 527 | 93.1 | globlastp |
| 2005 | LYM571 | sugarcane\|10v1\|AA577635 | 6063 | 527 | 90.8 | globlastp |
| 2006 | LYM571 | wheat\|10v2\|BE415051 | 6064 | 527 | 90.2 | globlastp |
| 2007 | LYM571 | wheat\|10v2\|BE418416 | 6064 | 527 | 90.2 | globlastp |
| 2008 | LYM571 | wheat\|10v2\|BE428212 | 6065 | 527 | 90.2 | globlastp |
| 2009 | LYM571 | barley\|10v2\|BE438872_P1 | 6066 | 527 | 90 | globlastp |
| 2010 | LYM571 | rye\|12v1\|BE704520_P1 | 6067 | 527 | 89.5 | globlastp |
| 2011 | LYM571 | rye\|12v1\|DRR001012.1053_P1 | 6067 | 527 | 89.5 | globlastp |
| 2012 | LYM571 | brachypodium\|09v1\|DV473285 | 6068 | 527 | 89.5 | globlastp |
| 2013 | LYM571 | brachypodium\|12v1\|BRADI1G09460_P1 | 6068 | 527 | 89.5 | globlastp |
| 2014 | LYM571 | fescue\|gb161\|DT680982_P1 | 6069 | 527 | 88.9 | globlastp |
| 2015 | LYM571 | foxtail_millet\|10v2\|OXFXTRMSLX00047633D1T1 | 6070 | 527 | 80.4 | globlastp |
| 2016 | LYM572 | sugarcane\|10v1\|CA072190 | 6071 | 528 | 91.5 | globlastp |
| 2017 | LYM572 | maize\|10v1\|AI691251_P1 | 6072 | 528 | 90.4 | globlastp |
| 2018 | LYM572 | sorghum\|09v1\|SB10G000380 | 6073 | 528 | 88.2 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2019 | LYM572 | sorghum\|12v1\|SB10G000380_P1 | 6073 | 528 | 88.2 | globlastp |
| 2020 | LYM572 | foxtail_millet\|11v3\|PHY7SI007383M_T1 | 6074 | 528 | 80 | glotblastn |
| 2021 | LYM572 | foxtail_millet\|10v2\|SICRP029027 | 6074 | 528 | 80 | glotblastn |
| 2022 | LYM573 | foxtail_millet\|11v3\|PHY7SI018343M_P1 | 6075 | 529 | 99.1 | globlastp |
| 2023 | LYM573 | sugarcane\|10v1\|CA073883 | 6076 | 529 | 99.1 | globlastp |
| 2024 | LYM573 | switchgrass\|gb167\|DN144521 | 6075 | 529 | 99.1 | globlastp |
| 2025 | LYM573 | millet\|10v1\|EVO454PM023683_P1 | 6077 | 529 | 98.1 | globlastp |
| 2026 | LYM573 | sorghum\|09v1\|SB04G027340 | 6078 | 529 | 98.1 | globlastp |
| 2027 | LYM573 | sorghum\|12v1\|SB04G027340_P1 | 6078 | 529 | 98.1 | globlastp |
| 2028 | LYM573 | switchgrass\|gb167\|FL691983 | 6079 | 529 | 98.1 | globlastp |
| 2029 | LYM573 | maize\|10v1\|AW331231_P1 | 6080 | 529 | 97.6 | globlastp |
| 2030 | LYM573 | rice\|11v1\|BE228347_P1 | 6081 | 529 | 97.6 | globlastp |
| 2031 | LYM573 | rice\|gb170\|OS02G52140 | 6081 | 529 | 97.6 | globlastp |
| 2032 | LYM573 | rye\|12v1\|BE586765_P1 | 6082 | 529 | 93.4 | globlastp |
| 2033 | LYM573 | wheat\|10v2\|BE427321 | 6083 | 529 | 93.4 | globlastp |
| 2034 | LYM573 | barley\|10v2\|BF621384_P1 | 6084 | 529 | 92.9 | globlastp |
| 2035 | LYM573 | pseudoroegneria\|gb167\|FF355079 | 6085 | 529 | 92.9 | globlastp |
| 2036 | LYM573 | brachypodium\|12v1\|BRADI3G58600_P1 | 6086 | 529 | 92.5 | globlastp |
| 2037 | LYM573 | oat\|11v1\|GO592519_P1 | 6087 | 529 | 92 | globlastp |
| 2038 | LYM573 | brachypodium\|09v1\|DV483604 | 6088 | 529 | 92 | globlastp |
| 2039 | LYM573 | oat\|10v2\|GO592519 | 6087 | 529 | 92 | globlastp |
| 2040 | LYM574 | foxtail_millet\|11v3\|PHY7SI000317M_P1 | 6089 | 530 | 93.7 | globlastp |
| 2041 | LYM574 | rice\|gb170\|OS01G39830 | 6090 | 530 | 91.9 | globlastp |
| 2042 | LYM574 | sorghum\|12v1\|SB03G025990_P1 | 6091 | 530 | 91.8 | globlastp |
| 2043 | LYM574 | sorghum\|09v1\|SB03G025990 | 6092 | 530 | 91.5 | globlastp |
| 2044 | LYM574 | foxtail_millet\|10v2\|SICRP002221 | 6093 | 530 | 91.4 | globlastp |
| 2045 | LYM574 | brachypodium\|12v1\|BRADI2G41830_P1 | 6094 | 530 | 89.5 | globlastp |
| 2046 | LYM574 | brachypodium\|09v1\|GT802010 | 6095 | 530 | 89.2 | globlastp |
| 2047 | LYM575 | sorghum\|09v1\|SB10G002480 | 6096 | 531 | 97.6 | glotblastn |
| 2048 | LYM575 | sorghum\|12v1\|SB10G002480_T1 | 6096 | 531 | 97.6 | glotblastn |
| 2049 | LYM575 | sugarcane\|10v1\|CA087099 | 6097 | 531 | 96.58 | glotblastn |
| 2050 | LYM575 | foxtail_millet\|11v3\|PHY7SI006886M_T1 | 6098 | 531 | 94.52 | glotblastn |
| 2051 | LYM575 | switchgrass\|gb167\|FE652315 | 6099 | 531 | 93.84 | glotblastn |
| 2052 | LYM575 | millet\|10v1\|EVO454PM002489_T1 | 6100 | 531 | 93.49 | glotblastn |
| 2053 | LYM575 | cynodon\|10v1\|ES305015_T1 | 6101 | 531 | 92.81 | glotblastn |
| 2054 | LYM575 | rice\|11v1\|AA754422_T1 | 6102 | 531 | 91.47 | glotblastn |
| 2055 | LYM575 | rice\|gb170\|OS06G04530 | 6102 | 531 | 91.47 | glotblastn |
| 2056 | LYM575 | brachypodium\|09v1\|DV479696 | 6103 | 531 | 89.73 | glotblastn |
| 2057 | LYM575 | brachypodium\|12v1\|BRADI1G51530_T1 | 6103 | 531 | 89.73 | glotblastn |
| 2058 | LYM575 | barley\|10v2\|BF622202_T1 | 6104 | 531 | 88.44 | glotblastn |
| 2059 | LYM575 | rye\|12v1\|DRR001012.126953_T1 | 6105 | 531 | 88.1 | glotblastn |
| 2060 | LYM575 | leymus\|gb166\|EG379612_T1 | 6105 | 531 | 88.1 | glotblastn |
| 2061 | LYM575 | oat\|10v2\|GO597038 | 6106 | 531 | 88.1 | glotblastn |
| 2062 | LYM575 | oat\|11v1\|GO597038_T1 | 6106 | 531 | 88.1 | glotblastn |
| 2063 | LYM575 | wheat\|10v2\|BE490526 | 6105 | 531 | 88.1 | glotblastn |
| 2064 | LYM575 | wheat\|10v2\|BM137263 | 6105 | 531 | 88.1 | glotblastn |
| 2065 | LYM576 | sorghum\|09v1\|SB01G029740 | 6107 | 532 | 86.46 | glotblastn |
| 2066 | LYM576 | sorghum\|12v1\|SB01G029740_T1 | 6107 | 532 | 86.46 | glotblastn |
| 2067 | LYM576 | maize\|10v1\|AI621448_P1 | 6108 | 532 | 84 | globlastp |
| 2068 | LYM578 | sugarcane\|10v1\|CA095149 | 6109 | 534 | 92.1 | globlastp |
| 2069 | LYM578 | cynodon\|10v1\|ES303046_P1 | 6110 | 534 | 92 | globlastp |
| 2070 | LYM578 | foxtail_millet\|11v3\|PHY7SI038043M_P1 | 6111 | 534 | 91.3 | globlastp |
| 2071 | LYM578 | foxtail_millet\|10v2\|SICRP032527 | 6111 | 534 | 91.3 | globlastp |
| 2072 | LYM578 | sorghum\|09v1\|SB01G032750 | 6112 | 534 | 88.4 | globlastp |
| 2073 | LYM578 | sorghum\|12v1\|SB01G032750_P1 | 6112 | 534 | 88.4 | globlastp |
| 2074 | LYM578 | maize\|10v1\|EG042492_P1 | 6113 | 534 | 86.5 | globlastp |
| 2075 | LYM578 | maize\|10v1\|DV163270_T1 | 6114 | 534 | 85.71 | glotblastn |
| 2076 | LYM578 | brachypodium\|09v1\|GT777927 | 6115 | 534 | 82.4 | globlastp |
| 2077 | LYM578 | brachypodium\|12v1\|BRADI1G60090_P1 | 6115 | 534 | 82.4 | globlastp |
| 2078 | LYM578 | millet\|10v1\|PMSLX0031289D1_P1 | 6116 | 534 | 81 | globlastp |
| 2079 | LYM579 | foxtail_millet\|11v3\|PHY7SI026009M_P1 | 6117 | 535 | 87.5 | globlastp |
| 2080 | LYM579 | foxtail_millet\|10v2\|SICRP022362 | 6118 | 535 | 85.47 | glotblastn |
| 2081 | LYM581 | sorghum\|09v1\|SB04G006360 | 6119 | 537 | 93.6 | globlastp |
| 2082 | LYM581 | sorghum\|12v1\|SB04G006360_P1 | 6119 | 537 | 93.6 | globlastp |
| 2083 | LYM581 | sugarcane\|10v1\|CA072430 | 6120 | 537 | 88.97 | glotblastn |
| 2084 | LYM581 | switchgrass\|gb167\|FL712856 | 6121 | 537 | 85.2 | globlastp |
| 2085 | LYM581 | foxtail_millet\|11v3\|PHY7SI018199M_P1 | 6122 | 537 | 84.5 | globlastp |
| 2086 | LYM581 | foxtail_millet\|10v2\|SICRP023465 | 6123 | 537 | 84.5 | globlastp |
| 2087 | LYM581 | switchgrass\|gb167\|FE601968 | 6124 | 537 | 83.8 | globlastp |
| 2088 | LYM581 | millet\|10v1\|EVO454PM002178_P1 | 6125 | 537 | 81.7 | globlastp |
| 2089 | LYM583 | sugarcane\|10v1\|BQ530047 | 6126 | 539 | 94.2 | globlastp |
| 2090 | LYM583 | sorghum\|09v1\|SB03G041910 | 6127 | 539 | 93.7 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2091 | LYM583 | sorghum\|12v1\|SB03G041910_P1 | 6127 | 539 | 93.7 | globlastp |
| 2092 | LYM583 | foxtail_millet\|11v3\|PHY7SI000354M_P1 | 6128 | 539 | 90.1 | globlastp |
| 2093 | LYM583 | foxtail_millet\|10v2\|SICRP023514 | 6128 | 539 | 90.1 | globlastp |
| 2094 | LYM583 | millet\|10v1\|EVO454PM000626_P1 | 6129 | 539 | 89.6 | globlastp |
| 2095 | LYM583 | switchgrass\|gb167\|FE607270 | 6130 | 539 | 88.6 | globlastp |
| 2096 | LYM583 | barley\|10v2\|BG344022_P1 | 6131 | 539 | 81.5 | globlastp |
| 2097 | LYM583 | wheat\|10v2\|BQ294593 | 6132 | 539 | 80.7 | globlastp |
| 2098 | LYM583 | rye\|12v1\|DRR001012.103327_P1 | 6133 | 539 | 80.6 | globlastp |
| 2099 | LYM583 | rye\|12v1\|BQ160585XX2_P1 | 6134 | 539 | 80.5 | globlastp |
| 2100 | LYM583 | wheat\|10v2\|BE585615 | 6135 | 539 | 80.3 | globlastp |
| 2101 | LYM583 | rye\|12v1\|DRR001012.147086XX2_T1 | 6136 | 539 | 80.07 | glotblastn |
| 2102 | LYM585 | sorghum\|09v1\|SB06G032890 | 6137 | 540 | 92.8 | globlastp |
| 2103 | LYM585 | sorghum\|12v1\|SB06G032890_P1 | 6137 | 540 | 92.8 | globlastp |
| 2104 | LYM585 | foxtail_millet\|11v3\|PHY7SI022259M_P1 | 6138 | 540 | 88.4 | globlastp |
| 2105 | LYM585 | foxtail_millet\|10v2\|SICRP019592 | 6138 | 540 | 88.4 | globlastp |
| 2106 | LYM585 | switchgrass\|gb167\|FE607227 | 6139 | 540 | 86.4 | globlastp |
| 2107 | LYM585 | brachypodium\|09v1\|GT778319 | 6140 | 540 | 81.7 | globlastp |
| 2108 | LYM585 | brachypodium\|12v1\|BRADI5G26120_P1 | 6140 | 540 | 81.7 | globlastp |
| 2109 | LYM585 | rice\|11v1\|AU093213_P1 | 6141 | 540 | 81.6 | globlastp |
| 2110 | LYM585 | rice\|gb170\|OS04G58060 | 6141 | 540 | 81.6 | globlastp |
| 2111 | LYM585 | rye\|12v1\|DRR001012.149666_P1 | 6142 | 540 | 81.3 | globlastp |
| 2112 | LYM586 | sorghum\|09v1\|SB04G002980 | 6143 | 541 | 93.3 | globlastp |
| 2113 | LYM586 | sorghum\|12v1\|SB04G002980_P1 | 6143 | 541 | 93.3 | globlastp |
| 2114 | LYM586 | foxtail_millet\|11v3\|EC613688_P1 | 6144 | 541 | 89.8 | globlastp |
| 2115 | LYM586 | millet\|10v1\|CD725090_T1 | 6145 | 541 | 88.35 | glotblastn |
| 2116 | LYM586 | brachypodium\|09v1\|GT772136 | 6146 | 541 | 85.61 | glotblastn |
| 2117 | LYM586 | brachypodium\|12v1\|BRADI3G03270_P1 | 6147 | 541 | 85.3 | globlastp |
| 2118 | LYM586 | switchgrass\|gb167\|FL737274 | 6148 | 541 | 84.73 | glotblastn |
| 2119 | LYM586 | barley\|10v2\|BF624787_P1 | 6149 | 541 | 84.5 | globlastp |
| 2120 | LYM586 | foxtail_millet\|10v2\|OXEC613688T1 | 6150 | 541 | 84.4 | globlastp |
| 2121 | LYM586 | oat\|10v2\|CN820415 | 6151 | 541 | 83.8 | globlastp |
| 2122 | LYM586 | oat\|11v1\|CN820415_P1 | 6151 | 541 | 83.8 | globlastp |
| 2123 | LYM586 | rice\|11v1\|BE230735_T1 | 6152 | 541 | 83.58 | glotblastn |
| 2124 | LYM586 | rice\|gb170\|OS02G04460 | 6152 | 541 | 83.58 | globlastp |
| 2125 | LYM586 | rye\|12v1\|BE637196_P1 | 6153 | 541 | 82.6 | globlastp |
| 2126 | LYM586 | leymus\|gb166\|EG381321_T1 | 6154 | 541 | 82.58 | glotblastn |
| 2127 | LYM587 | sorghum\|09v1\|SB01G011650 | 6155 | 542 | 83.1 | globlastp |
| 2128 | LYM587 | sorghum\|12v1\|SB01G011650_P1 | 6155 | 542 | 83.1 | globlastp |
| 2129 | LYM588 | maize\|10v1\|T18664_P1 | 6156 | 543 | 92.7 | globlastp |
| 2130 | LYM588 | sorghum\|09v1\|SB01G009660 | 6157 | 543 | 92.7 | globlastp |
| 2131 | LYM588 | sorghum\|12v1\|SB01G009660_P1 | 6157 | 543 | 92.7 | globlastp |
| 2132 | LYM588 | switchgrass\|gb167\|FE617171 | 6158 | 543 | 88.5 | globlastp |
| 2133 | LYM588 | foxtail_millet\|11v3\|PHY7SI038206M_P1 | 6159 | 543 | 86.6 | globlastp |
| 2134 | LYM588 | foxtail_millet\|10v2\|FXTRMSLX02301729D2 | 6159 | 543 | 86.6 | globlastp |
| 2135 | LYM588 | switchgrass\|gb167\|FL955271 | 6160 | 543 | 86.5 | globlastp |
| 2136 | LYM588 | millet\|10v1\|EVO454PM063942_P1 | 6161 | 543 | 85.6 | globlastp |
| 2137 | LYM588 | rye\|12v1\|DRR001012.526849_P1 | 6162 | 543 | 82.3 | globlastp |
| 2138 | LYM588 | rye\|12v1\|DRR001012.550326_P1 | 6162 | 543 | 82.3 | globlastp |
| 2139 | LYM588 | barley\|10v2\|BF259015_P1 | 6163 | 543 | 82.3 | globlastp |
| 2140 | LYM588 | wheat\|10v2\|BQ905713 | 6162 | 543 | 82.3 | globlastp |
| 2141 | LYM588 | oat\|11v1\|GO582922_P1 | 6164 | 543 | 82.1 | globlastp |
| 2142 | LYM588 | rice\|11v1\|AU093128_P1 | 6165 | 543 | 82.1 | globlastp |
| 2143 | LYM588 | rice\|gb170\|OS03G51459 | 6165 | 543 | 82.1 | globlastp |
| 2144 | LYM588 | rice\|11v1\|AA754479_P1 | 6166 | 543 | 82.1 | globlastp |
| 2145 | LYM588 | rice\|gb170\|OS08G10400 | 6166 | 543 | 82.1 | globlastp |
| 2146 | LYM588 | wheat\|10v2\|CJ586657 | 6167 | 543 | 81.4 | globlastp |
| 2147 | LYM588 | rye\|12v1\|DRR001012.144212_P1 | 6168 | 543 | 81.2 | globlastp |
| 2148 | LYM588 | wheat\|10v2\|BF200273 | 6169 | 543 | 81.2 | globlastp |
| 2149 | LYM588 | brachypodium\|09v1\|GT764665 | 6170 | 543 | 81.1 | globlastp |
| 2150 | LYM588 | brachypodium\|12v1\|BRADI1G10250_P1 | 6170 | 543 | 81.1 | globlastp |
| 2151 | LYM588 | rye\|12v1\|DRR001012.250612_P1 | 6171 | 543 | 80.6 | globlastp |
| 2152 | LYM588 | cynodon\|10v1\|ES293189_P1 | 6172 | 543 | 80.4 | globlastp |
| 2153 | LYM588 | pseudoroegneria\|gb167\|FF344761 | 6173 | 543 | 80.21 | glotblastn |
| 2154 | LYM588 | barley\|10v2\|CB862485_P1 | 6174 | 543 | 80.2 | globlastp |
| 2155 | LYM588 | wheat\|10v2\|CA603660 | 6175 | 543 | 80.2 | globlastp |
| 2156 | LYM589 | switchgrass\|gb167\|DN149831 | 6176 | 544 | 87.95 | glotblastn |
| 2157 | LYM589 | foxtail_millet\|11v3\|PHY7SI003130M_P1 | 6177 | 544 | 87.5 | globlastp |
| 2158 | LYM589 | millet\|10v1\|PMSLX0020370D1_P1 | 6178 | 544 | 86.7 | globlastp |
| 2159 | LYM590 | sorghum\|09v1\|SB03G030040 | 6179 | 545 | 96.2 | globlastp |
| 2160 | LYM590 | sorghum\|12v1\|SB03G030040_P1 | 6179 | 545 | 96.2 | globlastp |
| 2161 | LYM590 | foxtail_millet\|11v3\|PHY7SI002304M_P1 | 6180 | 545 | 95.3 | globlastp |
| 2162 | LYM590 | switchgrass\|gb167\|DN140932 | 6181 | 545 | 94.6 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2163 | LYM590 | rice\|11v1\|AU031037_P1 | 6182 | 545 | 89.2 | globlastp |
| 2164 | LYM590 | rice\|gb170\|OS01G46950 | 6182 | 545 | 89.2 | globlastp |
| 2165 | LYM590 | brachypodium\|09v1\|TMPLOS01G46950T1 | 6183 | 545 | 88.61 | glotblastn |
| 2166 | LYM590 | millet\|10v1\|EVO454PM129494_T1 | 6184 | 545 | 81.33 | glotblastn |
| 2167 | LYM590 | rice\|11v1\|CB644577_P1 | 6185 | 545 | 80 | globlastp |
| 2168 | LYM590 | rice\|gb170\|OS05G49430 | 6185 | 545 | 80 | globlastp |
| 2169 | LYM591 | sorghum\|12v1\|SB10G006300_P1 | 6186 | 546 | 93.2 | globlastp |
| 2170 | LYM591 | sorghum\|09v1\|SB10G006280 | 6187 | 546 | 92.9 | globlastp |
| 2171 | LYM591 | sorghum\|12v1\|SB10G006280_P1 | 6188 | 546 | 92.7 | globlastp |
| 2172 | LYM591 | sugarcane\|10v1\|CA082557 | 6189 | 546 | 91.8 | globlastp |
| 2173 | LYM591 | sorghum\|12v1\|SB10G006290_P1 | 6190 | 546 | 91.2 | globlastp |
| 2174 | LYM591 | sorghum\|09v1\|SB10G006290 | 6190 | 546 | 91.2 | globlastp |
| 2175 | LYM591 | switchgrass\|gb167\|FE598390 | 6191 | 546 | 90.4 | globlastp |
| 2176 | LYM591 | millet\|10v1\|EVO454PM040744_P1 | 6192 | 546 | 89.3 | globlastp |
| 2177 | LYM591 | maize\|10v1\|CF004658_P1 | 6193 | 546 | 86.7 | globlastp |
| 2178 | LYM591 | foxtail_millet\|11v3\|PHY7SI039271M_T1 | 6194 | 546 | 85.88 | glotblastn |
| 2179 | LYM591 | rice\|11v1\|AU101335_P1 | 6195 | 546 | 84.5 | globlastp |
| 2180 | LYM591 | rice\|gb170\|OS10G11810 | 6195 | 546 | 84.5 | globlastp |
| 2181 | LYM591 | cynodon\|10v1\|ES293072_P1 | 6196 | 546 | 84.2 | globlastp |
| 2182 | LYM591 | foxtail_millet\|11v3\|PHY7SI039594M_T1 | 6197 | 546 | 83.38 | glotblastn |
| 2183 | LYM591 | rye\|12v1\|DRR001014.696550_T1 | 6198 | 546 | 83.33 | glotblastn |
| 2184 | LYM591 | brachypodium\|09v1\|GT758287 | 6199 | 546 | 83.3 | globlastp |
| 2185 | LYM591 | brachypodium\|12v1\|BRADI3G22980_P1 | 6199 | 546 | 83.3 | globlastp |
| 2186 | LYM591 | sorghum\|09v1\|SB10G006270 | 6200 | 546 | 82.07 | glotblastn |
| 2187 | LYM591 | sorghum\|12v1\|SB10G006270_T1 | 6201 | 546 | 81.79 | glotblastn |
| 2188 | LYM592 | sugarcane\|10v1\|BQ537065 | 6202 | 547 | 92.9 | globlastp |
| 2189 | LYM592 | sorghum\|09v1\|SB09G026770 | 6203 | 547 | 90.9 | globlastp |
| 2190 | LYM592 | sorghum\|12v1\|SB09G026770_P1 | 6203 | 547 | 90.9 | globlastp |
| 2191 | LYM592 | maize\|10v1\|AW573446_P1 | 6204 | 547 | 90.3 | globlastp |
| 2192 | LYM592 | foxtail_millet\|11v3\|PHY7SI021603M_P1 | 6205 | 547 | 85 | globlastp |
| 2193 | LYM592 | foxtail_millet\|10v2\|OXFXTSLX00042279D1T1 | 6205 | 547 | 85 | globlastp |
| 2194 | LYM592 | switchgrass\|gb167\|FE609717 | 6206 | 547 | 84.3 | globlastp |
| 2195 | LYM592 | millet\|10v1\|EVO454PM002747_P1 | 6207 | 547 | 83.7 | globlastp |
| 2196 | LYM592 | switchgrass\|gb167\|FL691765 | 6208 | 547 | 83.3 | globlastp |
| 2197 | LYM593 | sugarcane\|10v1\|CA094158 | 6209 | 548 | 94.1 | globlastp |
| 2198 | LYM593 | sorghum\|09v1\|SB06G020520 | 6210 | 548 | 93.4 | globlastp |
| 2199 | LYM593 | sorghum\|12v1\|SB06G020520_P1 | 6210 | 548 | 93.4 | globlastp |
| 2200 | LYM593 | foxtail_millet\|11v3\|PHY7SI009554M_P1 | 6211 | 548 | 89.6 | globlastp |
| 2201 | LYM593 | switchgrass\|gb167\|FE629929 | 6212 | 548 | 89 | globlastp |
| 2202 | LYM593 | oat\|10v2\|GO588188 | 6213 | 548 | 84.21 | glotblastn |
| 2203 | LYM593 | brachypodium\|09v1\|DV489073 | 6214 | 548 | 83.8 | globlastp |
| 2204 | LYM593 | brachypodium\|12v1\|BRADI5G13700_P1 | 6214 | 548 | 83.8 | globlastp |
| 2205 | LYM593 | millet\|10v1\|CD726589_P1 | 6215 | 548 | 83 | globlastp |
| 2206 | LYM593 | rice\|11v1\|AA750700_P1 | 6216 | 548 | 82.7 | globlastp |
| 2207 | LYM593 | rice\|gb170\|OS04G40660 | 6216 | 548 | 82.7 | globlastp |
| 2208 | LYM593 | wheat\|10v2\|BQ802296 | 6217 | 548 | 80.6 | globlastp |
| 2209 | LYM593 | rye\|12v1\|DRR001012.100510_P1 | 6218 | 548 | 80 | globlastp |
| 2210 | LYM594 | foxtail_millet\|11v3\|SOLX00020230_T1 | 6219 | 549 | 80.8 | glotblastn |
| 2211 | LYM595 | sorghum\|09v1\|SB01G015780 | 6220 | 550 | 83 | globlastp |
| 2212 | LYM595 | sorghum\|12v1\|SB01G015780_P1 | 6220 | 550 | 83 | globlastp |
| 2213 | LYM595 | sugarcane\|10v1\|BQ535312 | 6221 | 550 | 82.1 | globlastp |
| 2214 | LYM595 | foxtail_millet\|11v3\|PHY7SI038239M_P1 | 6222 | 550 | 80.9 | globlastp |
| 2215 | LYM596 | sugarcane\|10v1\|BQ537035 | 6223 | 551 | 97.7 | globlastp |
| 2216 | LYM596 | sorghum\|12v1\|SB04G017430_P1 | 6224 | 551 | 97.2 | globlastp |
| 2217 | LYM596 | sorghum\|09v1\|SB04G017430 | 6224 | 551 | 97.2 | globlastp |
| 2218 | LYM596 | foxtail_millet\|11v3\|PHY7SI018314M_P1 | 6225 | 551 | 93.1 | globlastp |
| 2219 | LYM596 | foxtail_millet\|10v2\|SICRP035834 | 6225 | 551 | 93.1 | globlastp |
| 2220 | LYM596 | cenchrus\|gb166\|EB655382_P1 | 6226 | 551 | 91.7 | globlastp |
| 2221 | LYM596 | switchgrass\|gb167\|FE616504 | 6227 | 551 | 90.8 | globlastp |
| 2222 | LYM596 | millet\|10v1\|EVO454PM152449_P1 | 6228 | 551 | 90.5 | globlastp |
| 2223 | LYM596 | switchgrass\|gb167\|DN141665 | 6229 | 551 | 89.9 | globlastp |
| 2224 | LYM596 | rice\|11v1\|AA750280_P1 | 6230 | 551 | 87.6 | globlastp |
| 2225 | LYM596 | rice\|gb170\|OS02G26700 | 6230 | 551 | 87.6 | globlastp |
| 2226 | LYM596 | brachypodium\|12v1\|BRADI3G43137_P1 | 694 | 551 | 87.6 | globlastp |
| 2227 | LYM596 | euonymus\|11v1\|HS011083_T1 | 6231 | 551 | 84.4 | glotblastn |
| 2228 | LYM596 | leymus\|gb166\|EG391468_P1 | 6232 | 551 | 83.5 | globlastp |
| 2229 | LYM596 | rye\|12v1\|BE588144_P1 | 6233 | 551 | 83.5 | globlastp |
| 2230 | LYM596 | barley\|10v2\|BE413546_P1 | 6234 | 551 | 83.5 | globlastp |
| 2231 | LYM596 | pseudoroegneria\|gb167\|FF339860_P1 | 6235 | 551 | 83 | globlastp |
| 2232 | LYM596 | wheat\|10v2\|BE398695 | 6236 | 551 | 83 | globlastp |
| 2233 | LYM596 | fescue\|gb161\|CK802837_P1 | 6237 | 551 | 82.6 | globlastp |
| 2234 | LYM596 | wheat\|10v2\|BE406054_P1 | 6238 | 551 | 82.6 | globlastp |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2235 | LYM596 | wheat\|10v2\|BE427500_P1 | 6239 | 551 | 82.6 | globlastp |
| 2236 | LYM596 | wheat\|10v2\|BE419394_P1 | 6240 | 551 | 81.7 | globlastp |
| 2237 | LYM596 | oat\|11v1\|CN815629_P1 | 6241 | 551 | 81.2 | globlastp |
| 2238 | LYM598 | sorghum\|12v1\|BG357441_P1 | 6242 | 552 | 86 | globlastp |
| 2239 | LYM598 | sorghum\|09v1\|SB01G047550 | 6242 | 552 | 86 | globlastp |
| 2240 | LYM598 | sugarcane\|10v1\|CA078943 | 6243 | 552 | 85.8 | globlastp |
| 2241 | LYM599 | sugarcane\|10v1\|CA125737 | 6244 | 553 | 88.4 | globlastp |
| 2242 | LYM599 | sorghum\|09v1\|SB01G001060 | 6245 | 553 | 84.7 | globlastp |
| 2243 | LYM599 | sorghum\|12v1\|SB01G001060_P1 | 6245 | 553 | 84.7 | globlastp |
| 2244 | LYM599 | foxtail_millet\|11v3\|PHY7SI010847M_P1 | 6246 | 553 | 80.6 | globlastp |
| 2245 | LYM599 | foxtail_millet\|10v2\|SICRP002576 | 6246 | 553 | 80.6 | globlastp |
| 2246 | LYM600 | sugarcane\|10v1\|CA093963 | 554 | 554 | 100 | globlastp |
| 2247 | LYM600 | sorghum\|09v1\|SB09G030810 | 6247 | 554 | 99 | globlastp |
| 2248 | LYM600 | sorghum\|12v1\|SB09G030810_P1 | 6247 | 554 | 99 | globlastp |
| 2249 | LYM600 | switchgrass\|gb167\|FL731766 | 6248 | 554 | 94.9 | globlastp |
| 2250 | LYM600 | switchgrass\|gb167\|FL943548 | 6248 | 554 | 94.9 | globlastp |
| 2251 | LYM600 | foxtail_millet\|11v3\|PHY7SI023768M_P1 | 6249 | 554 | 93.9 | globlastp |
| 2252 | LYM600 | foxtail_millet\|10v2\|FXTRMSLX00734388D1 | 6249 | 554 | 93.9 | globlastp |
| 2253 | LYM600 | cynodon\|10v1\|ES293199_P1 | 6250 | 554 | 92.9 | globlastp |
| 2254 | LYM600 | oat\|10v2\|GO585886 | 6251 | 554 | 92.9 | globlastp |
| 2255 | LYM600 | oat\|10v2\|GO589084 | 6251 | 554 | 92.9 | globlastp |
| 2256 | LYM600 | oat\|11v1\|GO585886_P1 | 6251 | 554 | 92.9 | globlastp |
| 2257 | LYM600 | rye\|12v1\|DRR001012.111431_P1 | 6252 | 554 | 91.9 | globlastp |
| 2258 | LYM600 | brachypodium\|09v1\|GT804298 | 6253 | 554 | 91.9 | globlastp |
| 2259 | LYM600 | brachypodium\|12v1\|BRADI2G14260_P1 | 6253 | 554 | 91.9 | globlastp |
| 2260 | LYM600 | leymus\|gb166\|EG391342_P1 | 6252 | 554 | 91.9 | globlastp |
| 2261 | LYM600 | millet\|10v1\|EVO454PM162788_P1 | 6254 | 554 | 91.9 | globlastp |
| 2262 | LYM600 | wheat\|10v2\|CA597133 | 6252 | 554 | 91.9 | globlastp |
| 2263 | LYM600 | rice\|11v1\|BI798272_P1 | 6255 | 554 | 90.9 | globlastp |
| 2264 | LYM600 | rice\|gb170\|OS05G51650 | 6255 | 554 | 90.9 | globlastp |
| 2265 | LYM600 | cucurbita\|11v1\|SRR091276X120709_P1 | 6256 | 554 | 88.9 | globlastp |
| 2266 | LYM600 | platanus\|11v1\|SRR096786X130411_P1 | 6256 | 554 | 88.9 | globlastp |
| 2267 | LYM600 | platanus\|11v1\|SRR096786X355108_P1 | 6256 | 554 | 88.9 | globlastp |
| 2268 | LYM600 | poppy\|11v1\|SRR030259.117391_P1 | 6257 | 554 | 88.9 | globlastp |
| 2269 | LYM600 | trigonella\|11v1\|SRR066194X157903_P1 | 6258 | 554 | 88.9 | globlastp |
| 2270 | LYM600 | watermelon\|11v1\|VMEL03913326553522_P1 | 6256 | 554 | 88.9 | globlastp |
| 2271 | LYM600 | tobacco\|gb162\|EH620887 | 6259 | 554 | 88.9 | globlastp |
| 2272 | LYM600 | banana\|10v1\|FL657298_P1 | 6260 | 554 | 87.9 | globlastp |
| 2273 | LYM600 | clementine\|11v1\|CF504147_P1 | 6261 | 554 | 87.9 | globlastp |
| 2274 | LYM600 | coffea\|10v1\|DV712995_P1 | 6262 | 554 | 87.9 | globlastp |
| 2275 | LYM600 | cucumber\|09v1\|AM722106_P1 | 6263 | 554 | 87.9 | globlastp |
| 2276 | LYM600 | melon\|10v1\|AM722106_P1 | 6263 | 554 | 87.9 | globlastp |
| 2277 | LYM600 | soybean\|11v1\|GLYMA08G18410 | 6264 | 554 | 87.9 | globlastp |
| 2278 | LYM600 | soybean\|11v1\|GLYMA15G40590 | 6264 | 554 | 87.9 | globlastp |
| 2279 | LYM600 | tomato\|09v1\|BG130709 | 6262 | 554 | 87.9 | globlastp |
| 2280 | LYM600 | tomato\|11v1\|BG130709_P1 | 6262 | 554 | 87.9 | globlastp |
| 2281 | LYM600 | amsonia\|11v1\|SRR098688X38847_P1 | 6265 | 554 | 86.9 | globlastp |
| 2282 | LYM600 | cotton\|11v1\|BG447136_P1 | 6266 | 554 | 86.9 | globlastp |
| 2283 | LYM600 | cotton\|11v1\|SRR032367.1000742_P1 | 6266 | 554 | 86.9 | globlastp |
| 2284 | LYM600 | cotton\|11v1\|SRR032368.1019733_P1 | 6266 | 554 | 86.9 | globlastp |
| 2285 | LYM600 | flax\|11v1\|JG031667_P1 | 6267 | 554 | 86.9 | globlastp |
| 2286 | LYM600 | flax\|11v1\|JG109780_P1 | 6268 | 554 | 86.9 | globlastp |
| 2287 | LYM600 | gossypium_raimondii\|12v1\|CO082941_P1 | 6266 | 554 | 86.9 | globlastp |
| 2288 | LYM600 | gossypium_raimondii\|12v1\|ES816805_P1 | 6266 | 554 | 86.9 | globlastp |
| 2289 | LYM600 | phalaenopsis\|11v1\|SRR125771.1149762_P1 | 6269 | 554 | 86.9 | globlastp |
| 2290 | LYM600 | amborella\|gb166\|CK755640 | 6270 | 554 | 86.9 | globlastp |
| 2291 | LYM600 | barley\|10v2\|BF625348_P1 | 6271 | 554 | 86.9 | globlastp |
| 2292 | LYM600 | bean\|12v1\|CA914223_P1 | 6272 | 554 | 86.9 | globlastp |
| 2293 | LYM600 | bean\|gb167\|CA914223 | 6272 | 554 | 86.9 | globlastp |
| 2294 | LYM600 | cacao\|10v1\|CU504428_P1 | 6273 | 554 | 86.9 | globlastp |
| 2295 | LYM600 | citrus\|gb166\|CF504147 | 6274 | 554 | 86.9 | globlastp |
| 2296 | LYM600 | coffea\|10v1\|EE191840_P1 | 6275 | 554 | 86.9 | globlastp |
| 2297 | LYM600 | cotton\|10v2\|BG447136 | 6266 | 554 | 86.9 | globlastp |
| 2298 | LYM600 | cotton\|10v2\|SRR032367S0171409 | 6266 | 554 | 86.9 | globlastp |
| 2299 | LYM600 | cowpea\|gb166\|FF392565_P1 | 6276 | 554 | 86.9 | globlastp |
| 2300 | LYM600 | heritiera\|10v1\|SRR005794S0000480_P1 | 6266 | 554 | 86.9 | globlastp |
| 2301 | LYM600 | oak\|10v1\|FP068885_P1 | 6277 | 554 | 86.9 | globlastp |
| 2302 | LYM600 | orange\|11v1\|CF504147_P1 | 6274 | 554 | 86.9 | globlastp |
| 2303 | LYM600 | pigeonpea\|10v1\|SRR054580S0035235 | 6272 | 554 | 86.9 | globlastp |
| 2304 | LYM600 | pigeonpea\|11v1\|SRR054580X230616_P1 | 6272 | 554 | 86.9 | globlastp |
| 2305 | LYM600 | solanum_phureja\|09v1\|SPHBG130709 | 6278 | 554 | 86.9 | globlastp |
| 2306 | LYM600 | beech\|11v1\|SRR364434.64959_P1 | 6279 | 554 | 85.9 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2307 | LYM600 | bupleurum\|11v1\|SRR301254.139455_P1 | 6280 | 554 | 85.9 | globlastp |
| 2308 | LYM600 | bupleurum\|11v1\|SRR301254.15817_P1 | 6281 | 554 | 85.9 | globlastp |
| 2309 | LYM600 | chickpea\|11v1\|GR408995_P1 | 6282 | 554 | 85.9 | globlastp |
| 2310 | LYM600 | eucalyptus\|11v2\|ES592357_P1 | 6283 | 554 | 85.9 | globlastp |
| 2311 | LYM600 | fagopyrum\|11v1\|SRR063689X105178_P1 | 6284 | 554 | 85.9 | globlastp |
| 2312 | LYM600 | medicago\|12v1\|BQ144100_P1 | 6285 | 554 | 85.9 | globlastp |
| 2313 | LYM600 | sarracenia\|11v1\|SRR192669.112573_P1 | 6286 | 554 | 85.9 | globlastp |
| 2314 | LYM600 | utricularia\|11v1\|SRR094438.103235_P1 | 6287 | 554 | 85.9 | globlastp |
| 2315 | LYM600 | antirrhinum\|gb166\|AJ559733_P1 | 6288 | 554 | 85.9 | globlastp |
| 2316 | LYM600 | aquilegia\|10v2\|JGIAC023381 | 6289 | 554 | 85.9 | globlastp |
| 2317 | LYM600 | cassava\|09v1\|JGICASSAVA31061VALIDM1_P1 | 6290 | 554 | 85.9 | globlastp |
| 2318 | LYM600 | eggplant\|10v1\|FS007562_P1 | 6291 | 554 | 85.9 | globlastp |
| 2319 | LYM600 | eucalyptus\|11v1\|ES592357 | 6283 | 554 | 85.9 | globlastp |
| 2320 | LYM600 | grape\|11v1\|GSVIVT01024237001_P1 | 6292 | 554 | 85.9 | globlastp |
| 2321 | LYM600 | grape\|gb160\|DT015350 | 6292 | 554 | 85.9 | globlastp |
| 2322 | LYM600 | ipomoea_nil\|10v1\|CJ753581_P1 | 6293 | 554 | 85.9 | globlastp |
| 2323 | LYM600 | jatropha\|09v1\|FM891742_P1 | 6294 | 554 | 85.9 | globlastp |
| 2324 | LYM600 | pineapple\|10v1\|CO731536_P1 | 6295 | 554 | 85.9 | globlastp |
| 2325 | LYM600 | salvia\|10v1\|FE536863 | 6296 | 554 | 85.9 | globlastp |
| 2326 | LYM600 | pea\|11v1\|FG535244_T1 | — | 554 | 85.86 | glotblastn |
| 2327 | LYM600 | amorphophallus\|11v2\|SRR089351X119533_P1 | 6297 | 554 | 84.8 | globlastp |
| 2328 | LYM600 | catharanthus\|11v1\|EG557252_P1 | 6298 | 554 | 84.8 | globlastp |
| 2329 | LYM600 | eucalyptus\|11v2\|ES588366_P1 | 6299 | 554 | 84.8 | globlastp |
| 2330 | LYM600 | euonymus\|11v1\|SRR070038X161992_P1 | 6300 | 554 | 84.8 | globlastp |
| 2331 | LYM600 | euonymus\|11v1\|SRR070038X427194_P1 | 6300 | 554 | 84.8 | globlastp |
| 2332 | LYM600 | euonymus\|11v1\|SRR070038X545766_P1 | 6300 | 554 | 84.8 | globlastp |
| 2333 | LYM600 | nasturtium\|11v1\|GH167276_P1 | 6301 | 554 | 84.8 | globlastp |
| 2334 | LYM600 | tabernaemontana\|11v1\|SRR098689X130803_P1 | 6302 | 554 | 84.8 | globlastp |
| 2335 | LYM600 | acacia\|10v1\|FS586254_P1 | 6303 | 554 | 84.8 | globlastp |
| 2336 | LYM600 | cassava\|09v1\|DV455379_P1 | 6304 | 554 | 84.8 | globlastp |
| 2337 | LYM600 | eucalyptus\|11v1\|ES588366 | 6299 | 554 | 84.8 | globlastp |
| 2338 | LYM600 | peanut\|10v1\|ES717776_P1 | 6305 | 554 | 84.8 | globlastp |
| 2339 | LYM600 | chickpea\|09v2\|GR408995 | 6306 | 554 | 83.84 | glotblastn |
| 2340 | LYM600 | nasturtium\|10v1\|GH167276 | 6307 | 554 | 83.84 | glotblastn |
| 2341 | LYM600 | cirsium\|11v1\|SRR346952.1006577_P1 | 6308 | 554 | 83.8 | globlastp |
| 2342 | LYM600 | cirsium\|11v1\|SRR346952.1063347_P1 | 6308 | 554 | 83.8 | globlastp |
| 2343 | LYM600 | cirsium\|11v1\|SRR346952.106494_P1 | 6309 | 554 | 83.8 | globlastp |
| 2344 | LYM600 | euonymus\|11v1\|SRR070038X316257_P1 | 6310 | 554 | 83.8 | globlastp |
| 2345 | LYM600 | oil_palm\|11v1\|EL690671_P1 | 6311 | 554 | 83.8 | globlastp |
| 2346 | LYM600 | plantago\|11v2\|SRR066373X134434_P1 | 6312 | 554 | 83.8 | globlastp |
| 2347 | LYM600 | tripterygium\|11v1\|SRR098677X236783_P1 | 6313 | 554 | 83.8 | globlastp |
| 2348 | LYM600 | vinca\|11v1\|SRR098690X147661_P1 | 6314 | 554 | 83.8 | globlastp |
| 2349 | LYM600 | avocado\|10v1\|FD506766_P1 | 6315 | 554 | 83.8 | globlastp |
| 2350 | LYM600 | centaurea\|gb166\|EH739616_P1 | 6316 | 554 | 83.8 | globlastp |
| 2351 | LYM600 | centaurea\|gb166\|EH742668_P1 | 6308 | 554 | 83.8 | globlastp |
| 2352 | LYM600 | cichorium\|gb171\|EL371031_P1 | 6317 | 554 | 83.8 | globlastp |
| 2353 | LYM600 | cynara\|gb167\|GE591637_P1 | 6318 | 554 | 83.8 | globlastp |
| 2354 | LYM600 | hevea\|10v1\|EC600278_P1 | 6319 | 554 | 83.8 | globlastp |
| 2355 | LYM600 | monkeyflower\|10v1\|DV209693_P1 | 6320 | 554 | 83.8 | globlastp |
| 2356 | LYM600 | triphysaria\|10v1\|EY125732 | 6321 | 554 | 83.8 | globlastp |
| 2357 | LYM600 | cannabis\|12v1\|SOLX00063103_P1 | 6322 | 554 | 82.8 | globlastp |
| 2358 | LYM600 | cirsium\|11v1\|SRR346952.125654_P1 | 6323 | 554 | 82.8 | globlastp |
| 2359 | LYM600 | flaveria\|11v1\|SRR149229.21124_P1 | 6324 | 554 | 82.8 | globlastp |
| 2360 | LYM600 | humulus\|11v1\|SRR098683X111685_P1 | 6322 | 554 | 82.8 | globlastp |
| 2361 | LYM600 | olea\|11v1\|SRR014464.32155_P1 | 6325 | 554 | 82.8 | globlastp |
| 2362 | LYM600 | rose\|12v1\|SRR397984.29539_P1 | 6326 | 554 | 82.8 | globlastp |
| 2363 | LYM600 | aristolochia\|10v1\|SRR039082S0054216_P1 | 6327 | 554 | 82.8 | globlastp |
| 2364 | LYM600 | artemisia\|10v1\|SRR019254S0103015_P1 | 6328 | 554 | 82.8 | globlastp |
| 2365 | LYM600 | cynara\|gb167\|GE590619_P1 | 6329 | 554 | 82.8 | globlastp |
| 2366 | LYM600 | dandelion\|10v1\|GO665877_P1 | 6330 | 554 | 82.8 | globlastp |
| 2367 | LYM600 | lotus\|09v1\|AU251384_P1 | 6331 | 554 | 82.8 | globlastp |
| 2368 | LYM600 | poplar\|10v1\|BI121188_P1 | 6332 | 554 | 82.8 | globlastp |
| 2369 | LYM600 | strawberry\|11v1\|CO381503 | 6326 | 554 | 82.8 | globlastp |
| 2370 | LYM600 | sunflower\|10v1\|EE611564 | 6324 | 554 | 82.8 | globlastp |
| 2371 | LYM600 | sunflower\|12v1\|EE611564_P1 | 6324 | 554 | 82.8 | globlastp |
| 2372 | LYM600 | zinnia\|gb171\|AU307714 | 6333 | 554 | 82.8 | globlastp |
| 2373 | LYM600 | momordica\|10v1\|SRR071315S0102256_P1 | 6334 | 554 | 82 | globlastp |
| 2374 | LYM600 | ambrosia\|11v1\|SRR346943.132542_T1 | — | 554 | 81.82 | glotblastn |
| 2375 | LYM600 | flaveria\|11v1\|SRR149232.381162_T1 | — | 554 | 81.82 | glotblastn |
| 2376 | LYM600 | ambrosia\|11v1\|SRR346943.120806_P1 | 6335 | 554 | 81.8 | globlastp |
| 2377 | LYM600 | b_rapa\|11v1\|CX281114_P1 | 6336 | 554 | 81.8 | globlastp |
| 2378 | LYM600 | euphorbia\|11v1\|DV119892_P1 | 6337 | 554 | 81.8 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2379 | LYM600 | euphorbia\|11v1\|SRR098678X107103_P1 | 6338 | 554 | 81.8 | globlastp |
| 2380 | LYM600 | flaveria\|11v1\|SRR149229.317100_P1 | 6335 | 554 | 81.8 | globlastp |
| 2381 | LYM600 | flaveria\|11v1\|SRR149232.156175_P1 | 6335 | 554 | 81.8 | globlastp |
| 2382 | LYM600 | sunflower\|12v1\|EL432223_P1 | 6335 | 554 | 81.8 | globlastp |
| 2383 | LYM600 | thellungiella_halophilum\|11v1\|EHJGI11011720_P1 | 6339 | 554 | 81.8 | globlastp |
| 2384 | LYM600 | artemisia\|10v1\|EY064441_P1 | 6340 | 554 | 81.8 | globlastp |
| 2385 | LYM600 | radish\|gb164\|EX748624 | 6341 | 554 | 81.8 | globlastp |
| 2386 | LYM600 | spurge\|gb161\|DV119892 | 6337 | 554 | 81.8 | globlastp |
| 2387 | LYM600 | sunflower\|10v1\|CD854782 | 6335 | 554 | 81.8 | globlastp |
| 2388 | LYM600 | sunflower\|12v1\|CD854782_P1 | 6335 | 554 | 81.8 | globlastp |
| 2389 | LYM600 | sunflower\|10v1\|EE652689 | 6335 | 554 | 81.8 | globlastp |
| 2390 | LYM600 | sunflower\|12v1\|EE652689_P1 | 6335 | 554 | 81.8 | globlastp |
| 2391 | LYM600 | zostera\|10v1\|SRR057351S0102941 | 6342 | 554 | 81.8 | globlastp |
| 2392 | LYM600 | valeriana\|11v1\|SRR099039X175201_P1 | 6343 | 554 | 81.2 | globlastp |
| 2393 | LYM600 | chestnut\|gb170\|SRR006295S0081537_T1 | 6344 | 554 | 81 | glotblastn |
| 2394 | LYM600 | foxtail_millet\|10v2\|SICRP005742 | 6345 | 554 | 80.81 | glotblastn |
| 2395 | LYM600 | primula\|11v1\|SRR098679X61753_P1 | 6346 | 554 | 80.8 | globlastp |
| 2396 | LYM600 | arabidopsis\|10v1\|AT1G65700_P1 | 6347 | 554 | 80.8 | globlastp |
| 2397 | LYM600 | b_juncea\|10v2\|E6ANDIZ01A1MXB1_P1 | 6348 | 554 | 80.8 | globlastp |
| 2398 | LYM600 | b_oleracea\|gb161\|EE534039_P1 | 6348 | 554 | 80.8 | globlastp |
| 2399 | LYM600 | b_rapa\|11v1\|CD818907_P1 | 6348 | 554 | 80.8 | globlastp |
| 2400 | LYM600 | b_rapa\|gb162\|CA992000 | 6348 | 554 | 80.8 | globlastp |
| 2401 | LYM600 | canola\|10v1\|CD818907 | 6348 | 554 | 80.8 | globlastp |
| 2402 | LYM600 | canola\|10v1\|CD821357 | 6348 | 554 | 80.8 | globlastp |
| 2403 | LYM600 | canola\|10v1\|CN732235 | 6348 | 554 | 80.8 | globlastp |
| 2404 | LYM600 | castorbean\|09v1\|XM002523821 | 6349 | 554 | 80.8 | globlastp |
| 2405 | LYM600 | castorbean\|11v1\|XM_002523821_P1 | 6349 | 554 | 80.8 | globlastp |
| 2406 | LYM600 | lettuce\|10v1\|DW154030_P1 | 6350 | 554 | 80.8 | globlastp |
| 2407 | LYM600 | lotus\|09v1\|AV426525_P1 | 6351 | 554 | 80.8 | globlastp |
| 2408 | LYM600 | papaya\|gb165\|EX252216_P1 | 6352 | 554 | 80.8 | globlastp |
| 2409 | LYM600 | radish\|gb164\|EY895818 | 6353 | 554 | 80.8 | globlastp |
| 2410 | LYM600 | sequoia\|10v1\|SRR065044S0138565 | 6354 | 554 | 80.8 | globlastp |
| 2411 | LYM600 | canola\|11v1\|CN732235_P1 | 6348 | 554 | 80.8 | globlastp |
| 2412 | LYM601 | sorghum\|09v1\|SB07G007750 | 6355 | 555 | 98.1 | globlastp |
| 2413 | LYM601 | sorghum\|12v1\|SB07G007750_P1 | 6355 | 555 | 98.1 | globlastp |
| 2414 | LYM601 | foxtail_millet\|11v3\|PHY7SI013402M_P1 | 6356 | 555 | 95.8 | globlastp |
| 2415 | LYM601 | rice\|11v1\|BI813578_P1 | 6357 | 555 | 90.2 | globlastp |
| 2416 | LYM601 | rice\|gb170\|OS08G14620 | 6357 | 555 | 90.2 | globlastp |
| 2417 | LYM601 | brachypodium\|09v1\|DV474658 | 6358 | 555 | 88.7 | globlastp |
| 2418 | LYM601 | brachypodium\|12v1\|BRADI3G18920_P1 | 6358 | 555 | 88.7 | globlastp |
| 2419 | LYM601 | rye\|12v1\|DRR001012.128982_T1 | 6359 | 555 | 86.05 | glotblastn |
| 2420 | LYM601 | rye\|12v1\|DRR001012.104980_P1 | 6360 | 555 | 85.6 | globlastp |
| 2421 | LYM602 | sorghum\|09v1\|SB04G022140 | 6361 | 556 | 95.8 | globlastp |
| 2422 | LYM602 | sorghum\|12v1\|SB04G022140_P1 | 6362 | 556 | 95.6 | globlastp |
| 2423 | LYM602 | switchgrass\|gb167\|FL690824 | 6363 | 556 | 92.1 | globlastp |
| 2424 | LYM602 | foxtail_millet\|11v3\|EC612280_P1 | 6364 | 556 | 90.2 | globlastp |
| 2425 | LYM602 | foxtail_millet\|10v2\|SICRP032110 | 6364 | 556 | 90.2 | globlastp |
| 2426 | LYM602 | oat\|10v2\|GR333470 | 6365 | 556 | 87.8 | globlastp |
| 2427 | LYM602 | oat\|11v1\|GR333470_P1 | 6365 | 556 | 87.8 | globlastp |
| 2428 | LYM602 | rice\|11v1\|BE040097_P1 | 6366 | 556 | 87.3 | globlastp |
| 2429 | LYM602 | rice\|gb170\|OS02G33710 | 6366 | 556 | 87.3 | globlastp |
| 2430 | LYM602 | brachypodium\|09v1\|DV469217 | 6367 | 556 | 86.7 | globlastp |
| 2431 | LYM602 | brachypodium\|12v1\|BRADI3G45260_P1 | 6367 | 556 | 86.7 | globlastp |
| 2432 | LYM602 | wheat\|10v2\|BE213243 | 6368 | 556 | 83 | globlastp |
| 2433 | LYM602 | rye\|12v1\|BE493876_P1 | 6369 | 556 | 82.6 | globlastp |
| 2434 | LYM602 | rye\|12v1\|DRR001012.179873_T1 | 6370 | 556 | 81.58 | glotblastn |
| 2435 | LYM603 | sugarcane\|10v1\|CA074471 | 6371 | 557 | 98.7 | globlastp |
| 2436 | LYM603 | sorghum\|09v1\|SB01G027790 | 6372 | 557 | 98.1 | globlastp |
| 2437 | LYM603 | sorghum\|12v1\|SB01G027790_P1 | 6372 | 557 | 98.1 | globlastp |
| 2438 | LYM603 | foxtail_millet\|11v3\|PHY7SI037847M_P1 | 6373 | 557 | 95 | globlastp |
| 2439 | LYM603 | foxtail_millet\|10v2\|OXFXTSLX00004096D1T1 | 6373 | 557 | 95 | globlastp |
| 2440 | LYM603 | millet\|10v1\|EVO454PM055842_P1 | 6374 | 557 | 93.7 | globlastp |
| 2441 | LYM603 | cynodon\|10v1\|ES297680_P1 | 6375 | 557 | 93.2 | globlastp |
| 2442 | LYM603 | switchgrass\|gb167\|DN143865 | 6376 | 557 | 93.1 | globlastp |
| 2443 | LYM603 | switchgrass\|gb167\|FE629735 | 6377 | 557 | 90.6 | globlastp |
| 2444 | LYM603 | lovegrass\|gb167\|EH184835_P1 | 6378 | 557 | 89.4 | globlastp |
| 2445 | LYM603 | rice\|11v1\|BI306142_P1 | 6379 | 557 | 88.1 | globlastp |
| 2446 | LYM603 | rice\|gb170\|OS10G42840 | 6379 | 557 | 88.1 | globlastp |
| 2447 | LYM603 | barley\|10v2\|BE411720_P1 | 6380 | 557 | 85 | globlastp |
| 2448 | LYM603 | brachypodium\|09v1\|DV479530 | 6381 | 557 | 85 | globlastp |
| 2449 | LYM603 | brachypodium\|12v1\|BRADI3G34557_P1 | 6381 | 557 | 85 | globlastp |
| 2450 | LYM603 | pseudoroegneria\|gb167\|FF339930 | 6382 | 557 | 84.4 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2451 | LYM603 | maize\|10v1\|BE056112_T1 | — | 557 | 83.95 | glotblastn |
| 2452 | LYM603 | rye\|12v1\|BE494038_P1 | 6383 | 557 | 83.8 | globlastp |
| 2453 | LYM603 | fescue\|gb161\|DT701118_P1 | 6384 | 557 | 83.8 | globlastp |
| 2454 | LYM603 | oat\|10v2\|CN815694 | 6385 | 557 | 83.8 | globlastp |
| 2455 | LYM603 | oat\|11v1\|CN815694_P1 | 6385 | 557 | 83.8 | globlastp |
| 2456 | LYM603 | oat\|10v2\|GO582267 | 6385 | 557 | 83.8 | globlastp |
| 2457 | LYM603 | oat\|11v1\|GO582267_P1 | 6386 | 557 | 83.8 | globlastp |
| 2458 | LYM603 | rye\|gb164\|BE494038 | 6383 | 557 | 83.8 | globlastp |
| 2459 | LYM603 | rye\|12v1\|DRR001014.113006_T1 | 6387 | 557 | 83.02 | glotblastn |
| 2460 | LYM603 | oil_palm\|11v1\|EY397025_P1 | 6388 | 557 | 80.5 | globlastp |
| 2461 | LYM604 | sorghum\|09v1\|SB06G021810 | 6389 | 558 | 95.3 | globlastp |
| 2462 | LYM604 | sorghum\|12v1\|SB06G021810_P1 | 6389 | 558 | 95.3 | globlastp |
| 2463 | LYM604 | sugarcane\|10v1\|CA222951 | 6390 | 558 | 94.4 | globlastp |
| 2464 | LYM604 | switchgrass\|gb167\|DW177305 | 6391 | 558 | 91.2 | globlastp |
| 2465 | LYM604 | millet\|10v1\|EVO454PM004605_P1 | 6392 | 558 | 88.4 | globlastp |
| 2466 | LYM604 | foxtail_millet\|11v3\|PHY7SI011051M_P1 | 6393 | 558 | 87.9 | globlastp |
| 2467 | LYM604 | foxtail_millet\|10v2\|SICRP021182 | 6393 | 558 | 87.9 | globlastp |
| 2468 | LYM604 | brachypodium\|09v1\|DV485200 | 6394 | 558 | 84.1 | globlastp |
| 2469 | LYM604 | brachypodium\|12v1\|BRADI5G14910_P1 | 6394 | 558 | 84.1 | globlastp |
| 2470 | LYM604 | wheat\|10v2\|BE638059 | 6395 | 558 | 82.2 | globlastp |
| 2471 | LYM604 | rye\|12v1\|BE705236_P1 | 6396 | 558 | 81.8 | globlastp |
| 2472 | LYM604 | pseudoroegneria\|gb167\|FF350465 | 6397 | 558 | 81.3 | globlastp |
| 2473 | LYM604 | rye\|12v1\|DRR001012.134837_T1 | 6398 | 558 | 80.84 | glotblastn |
| 2474 | LYM606 | sorghum\|09v1\|SB10G025050 | 6399 | 559 | 95.9 | globlastp |
| 2475 | LYM606 | sorghum\|12v1\|SB10G025050_P1 | 6399 | 559 | 95.9 | globlastp |
| 2476 | LYM606 | maize\|10v1\|AW563059_P1 | 6400 | 559 | 95.3 | globlastp |
| 2477 | LYM606 | foxtail_millet\|11v3\|GT228203_P1 | 6401 | 559 | 94.7 | globlastp |
| 2478 | LYM606 | rice\|11v1\|BE607436_P1 | 6402 | 559 | 89.2 | globlastp |
| 2479 | LYM606 | rice\|gb170\|OS06G43210 | 6402 | 559 | 89.2 | globlastp |
| 2480 | LYM606 | brachypodium\|09v1\|DV476163 | 6403 | 559 | 87.6 | globlastp |
| 2481 | LYM606 | brachypodium\|12v1\|BRADI1G30330_P1 | 6403 | 559 | 87.6 | globlastp |
| 2482 | LYM606 | rye\|12v1\|DRR001012.25717_P1 | 6404 | 559 | 86.7 | globlastp |
| 2483 | LYM606 | rye\|12v1\|DRR001012.108444_P1 | 6405 | 559 | 85.6 | globlastp |
| 2484 | LYM606 | rye\|12v1\|DRR001012.127359_P1 | 6406 | 559 | 84.1 | globlastp |
| 2485 | LYM606 | rye\|12v1\|DRR001012.176109_T1 | 6407 | 559 | 83.65 | glotblastn |
| 2486 | LYM606 | switchgrass\|gb167\|FL696179 | 6408 | 559 | 81.94 | glotblastn |
| 2487 | LYM608 | sorghum\|12v1\|SB03G010320_P1 | 6409 | 561 | 92.7 | globlastp |
| 2488 | LYM608 | sorghum\|09v1\|SB03G010320 | 6410 | 561 | 92.4 | globlastp |
| 2489 | LYM608 | switchgrass\|gb167\|DN140772 | 6411 | 561 | 90.8 | globlastp |
| 2490 | LYM609 | sorghum\|12v1\|SB10G029300_P1 | 6412 | 562 | 87.4 | globlastp |
| 2491 | LYM609 | sorghum\|09v1\|SB10G029300 | 6412 | 562 | 87.4 | globlastp |
| 2492 | LYM609 | foxtail_millet\|10v2\|SICRP011813 | 6413 | 562 | 81 | globlastp |
| 2493 | LYM611 | sorghum\|09v1\|SB01G043220 | 6414 | 564 | 98.9 | globlastp |
| 2494 | LYM611 | sorghum\|12v1\|SB01G043220_P1 | 6414 | 564 | 98.9 | globlastp |
| 2495 | LYM611 | sugarcane\|10v1\|BQ533221 | 6414 | 564 | 98.9 | globlastp |
| 2496 | LYM611 | maize\|10v1\|AI491301_P1 | 6415 | 564 | 98.2 | globlastp |
| 2497 | LYM611 | switchgrass\|gb167\|FE600476 | 6416 | 564 | 97.5 | globlastp |
| 2498 | LYM611 | foxtail_millet\|11v3\|PHY7SI006022M_P1 | 6417 | 564 | 97.3 | globlastp |
| 2499 | LYM611 | rice\|gb170\|OS06G34690 | 6418 | 564 | 97.1 | globlastp |
| 2500 | LYM611 | foxtail_millet\|10v2\|OXFXTRMSLX00145499D1T1 | 6419 | 564 | 96.77 | glotblastn |
| 2501 | LYM611 | brachypodium\|09v1\|GT767056 | 6420 | 564 | 96.6 | globlastp |
| 2502 | LYM611 | brachypodium\|12v1\|BRADI1G39090_P1 | 6420 | 564 | 96.6 | globlastp |
| 2503 | LYM611 | brachypodium\|12v1\|BRADI2G26420_T1 | 6421 | 564 | 95.34 | glotblastn |
| 2504 | LYM611 | brachypodium\|09v1\|SRR031797S0049352 | 6421 | 564 | 95.34 | glotblastn |
| 2505 | LYM611 | oat\|11v1\|GO598901_P1 | 6422 | 564 | 95.3 | globlastp |
| 2506 | LYM611 | oat\|10v2\|GO598901 | 6423 | 564 | 95.2 | globlastp |
| 2507 | LYM611 | rice\|gb170\|OS02G14929 | 6424 | 564 | 94.1 | globlastp |
| 2508 | LYM611 | wheat\|10v2\|BE404300 | 6425 | 564 | 93.5 | globlastp |
| 2509 | LYM611 | wheat\|10v2\|BE399770 | 6426 | 564 | 93.4 | globlastp |
| 2510 | LYM611 | rye\|12v1\|DRR001012.108353_P1 | 6427 | 564 | 93.2 | globlastp |
| 2511 | LYM611 | rye\|12v1\|DRR001012.248343_P1 | 6427 | 564 | 93.2 | globlastp |
| 2512 | LYM611 | rye\|12v1\|DRR001012.155827_P1 | 6428 | 564 | 93 | globlastp |
| 2513 | LYM611 | oil_palm\|11v1\|EY409424_T1 | 6429 | 564 | 90.16 | glotblastn |
| 2514 | LYM611 | oil_palm\|11v1\|EY407670_P1 | 6430 | 564 | 90 | globlastp |
| 2515 | LYM611 | castorbean\|11v1\|EG692210_P1 | 6431 | 564 | 89.4 | globlastp |
| 2516 | LYM611 | watermelon\|11v1\|BI740251_P1 | 6432 | 564 | 89.4 | globlastp |
| 2517 | LYM611 | cassava\|09v1\|BM259914_P1 | 6433 | 564 | 89.4 | globlastp |
| 2518 | LYM611 | tripterygium\|11v1\|SRR098677X100547_P1 | 6434 | 564 | 89.3 | globlastp |
| 2519 | LYM611 | citrus\|gb166\|CB304914 | 6435 | 564 | 89.1 | globlastp |
| 2520 | LYM611 | clementine\|11v1\|CB304914_P1 | 6436 | 564 | 89.1 | globlastp |
| 2521 | LYM611 | orange\|11v1\|CB304914_P1 | 6436 | 564 | 89.1 | globlastp |
| 2522 | LYM611 | melon\|10v1\|AM727766_T1 | 6437 | 564 | 88.89 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2523 | LYM611 | euonymus|11v1|SRR070038X115804_P1 | 6438 | 564 | 88.7 | globlastp |
| 2524 | LYM611 | euphorbia|11v1|BG317307_P1 | 6439 | 564 | 88.7 | globlastp |
| 2525 | LYM611 | cotton|10v2|BE055074 | 6440 | 564 | 88.7 | globlastp |
| 2526 | LYM611 | cotton|11v1|AI727905_P1 | 6440 | 564 | 88.7 | globlastp |
| 2527 | LYM611 | euonymus|11v1|SRR070038X112478_P1 | 6441 | 564 | 88.6 | globlastp |
| 2528 | LYM611 | grape|11v1|GSVIVT01007770001_P1 | 6442 | 564 | 88.6 | globlastp |
| 2529 | LYM611 | millet|10v1|EVO454PM001315_P1 | 6443 | 564 | 88.5 | globlastp |
| 2530 | LYM611 | eucalyptus|11v2|ES590324_P1 | 6444 | 564 | 88.4 | globlastp |
| 2531 | LYM611 | grape|11v1|GSVIVT01000263001_P1 | 6445 | 564 | 88.4 | globlastp |
| 2532 | LYM611 | ambrosia|11v1|SRR346935.104108_T1 | 6446 | 564 | 88.35 | glotblastn |
| 2533 | LYM611 | catharanthus|11v1|EG555556_P1 | 6447 | 564 | 88.2 | globlastp |
| 2534 | LYM611 | tabernaemontana|11v1|SRR098689X100220_P1 | 6448 | 564 | 88.2 | globlastp |
| 2535 | LYM611 | poplar|10v1|BI120102_P1 | 6449 | 564 | 88.2 | globlastp |
| 2536 | LYM611 | eucalyptus|11v1|ES590324 | 6450 | 564 | 88.19 | glotblastn |
| 2537 | LYM611 | ambrosia|11v1|SRR346935.307154_T1 | 6451 | 564 | 88.17 | glotblastn |
| 2538 | LYM611 | flaveria|11v1|SRR149229.102721_P1 | 6452 | 564 | 88 | globlastp |
| 2539 | LYM611 | poplar|10v1|AI162988_P1 | 6453 | 564 | 88 | globlastp |
| 2540 | LYM611 | sunflower|10v1|CD853266 | 6454 | 564 | 88 | globlastp |
| 2541 | LYM611 | sunflower|12v1|DY931786_P1 | 6454 | 564 | 88 | globlastp |
| 2542 | LYM611 | triphysaria|10v1|EX988156 | 6455 | 564 | 87.81 | glotblastn |
| 2543 | LYM611 | cichorium|gb171|EH675116_P1 | 6456 | 564 | 87.8 | globlastp |
| 2544 | LYM611 | oak|10v1|CU656729_P1 | 6457 | 564 | 87.8 | globlastp |
| 2545 | LYM611 | tragopogon|10v1|SRR020205S0004863 | 6458 | 564 | 87.8 | globlastp |
| 2546 | LYM611 | amsonia|11v1|SRR098688X107521_P1 | 6459 | 564 | 87.7 | globlastp |
| 2547 | LYM611 | orange|11v1|CF506647_P1 | 6460 | 564 | 87.7 | globlastp |
| 2548 | LYM611 | triphysaria|10v1|DR173475 | 6461 | 564 | 87.6 | globlastp |
| 2549 | LYM611 | castorbean|09v1|EG692210 | 6462 | 564 | 87.52 | glotblastn |
| 2550 | LYM611 | artemisia|10v1|EY036781_P1 | 6463 | 564 | 87.5 | globlastp |
| 2551 | LYM611 | citrus|gb166|CF506647 | 6464 | 564 | 87.5 | globlastp |
| 2552 | LYM611 | clementine|11v1|CF506647_P1 | 6465 | 564 | 87.5 | globlastp |
| 2553 | LYM611 | coffea|10v1|DV675662_P1 | 6466 | 564 | 87.5 | globlastp |
| 2554 | LYM611 | momordica|10v1|SRR071315S0009397_P1 | 6467 | 564 | 87.5 | globlastp |
| 2555 | LYM611 | monkeyflower|10v1|DV208694_P1 | 6468 | 564 | 87.5 | globlastp |
| 2556 | LYM611 | nasturtium|10v1|GH162060 | 6469 | 564 | 87.5 | globlastp |
| 2557 | LYM611 | nasturtium|11v1|GH162060_T1 | 6470 | 564 | 87.46 | glotblastn |
| 2558 | LYM611 | prunus|10v1|CN993152 | 6471 | 564 | 87.37 | glotblastn |
| 2559 | LYM611 | cirsium|11v1|SRR346952.1017142_P1 | 6472 | 564 | 87.3 | globlastp |
| 2560 | LYM611 | pigeonpea|11v1|SRR054580X100373_P1 | 6473 | 564 | 87.3 | globlastp |
| 2561 | LYM611 | ambrosia|11v1|SRR346935.65560_T1 | 6474 | 564 | 87.28 | glotblastn |
| 2562 | LYM611 | flaveria|11v1|SRR149229.231079XX2_T1 | 6475 | 564 | 87.28 | glotblastn |
| 2563 | LYM611 | cirsium|11v1|SRR346952.162014_P1 | 6476 | 564 | 87.1 | globlastp |
| 2564 | LYM611 | sunflower|12v1|CD853266_T1 | 6477 | 564 | 87.1 | glotblastn |
| 2565 | LYM611 | valeriana|11v1|SRR099039X10437_P1 | 6478 | 564 | 87.1 | globlastp |
| 2566 | LYM611 | vinca|11v1|SRR098690X110682_P1 | 6479 | 564 | 87.1 | globlastp |
| 2567 | LYM611 | arabidopsis_lyrata|09v1|JGIAL022374_P1 | 6480 | 564 | 87.1 | globlastp |
| 2568 | LYM611 | aristolochia|10v1|SRR039082S0101548_P1 | 6481 | 564 | 87.1 | globlastp |
| 2569 | LYM611 | sunflower|10v1|DY911131 | 6482 | 564 | 87.1 | glotblastn |
| 2570 | LYM611 | amorphophallus|11v2|SRR089351X108628_T1 | 6483 | 564 | 86.94 | glotblastn |
| 2571 | LYM611 | b_rapa|11v1|CD826108_P1 | 6484 | 564 | 86.9 | globlastp |
| 2572 | LYM611 | canola|11v1|DT469126XX1_P1 | 6484 | 564 | 86.9 | globlastp |
| 2573 | LYM611 | canola|11v1|EE472123_P1 | 6484 | 564 | 86.9 | globlastp |
| 2574 | LYM611 | canola|11v1|EE549209_T1 | 6485 | 564 | 86.74 | glotblastn |
| 2575 | LYM611 | trigonella|11v1|SRR066194X122711_P1 | 6486 | 564 | 86.7 | globlastp |
| 2576 | LYM611 | arabidopsis|10v1|AT5G26360_P1 | 6487 | 564 | 86.7 | globlastp |
| 2577 | LYM611 | radish|gb164|EW717942 | 6488 | 564 | 86.7 | globlastp |
| 2578 | LYM611 | amborella|12v2|SRR038634.26959_P1 | 6489 | 564 | 86.6 | globlastp |
| 2579 | LYM611 | chestnut|gb170|SRR006295S0028395_P1 | 6490 | 564 | 86.6 | globlastp |
| 2580 | LYM611 | orobanche|10v1|SRR023189S0002940_P1 | 6491 | 564 | 86.6 | globlastp |
| 2581 | LYM611 | soybean|11v1|GLYMA09G28650 | 6492 | 564 | 86.6 | globlastp |
| 2582 | LYM611 | phalaenopsis|11v1|SRR125771.1000872_T1 | 6493 | 564 | 86.58 | glotblastn |
| 2583 | LYM611 | beet|12v1|BQ488783_P1 | 6494 | 564 | 86.4 | globlastp |
| 2584 | LYM611 | thellungiella_halophilum|11v1|BY810123_P1 | 6495 | 564 | 86.4 | globlastp |
| 2585 | LYM611 | medicago|09v1|LLAW684643 | 6496 | 564 | 86.4 | globlastp |
| 2586 | LYM611 | soybean|11v1|GLYMA16G33380 | 6497 | 564 | 86.4 | globlastp |
| 2587 | LYM611 | tomato|09v1|AW041240 | 6498 | 564 | 86.4 | globlastp |
| 2588 | LYM611 | tomato|11v1|AW041240_P1 | 6498 | 564 | 86.4 | globlastp |
| 2589 | LYM611 | dandelion|10v1|DR400237_T1 | 6499 | 564 | 86.38 | glotblastn |
| 2590 | LYM611 | bean|12v1|CA906417_P1 | 6500 | 564 | 86.2 | globlastp |
| 2591 | LYM611 | sunflower|12v1|EE620205_P1 | 6501 | 564 | 86.2 | globlastp |
| 2592 | LYM611 | thellungiella_halophilum|11v1|BY801043_P1 | 6502 | 564 | 86.2 | globlastp |
| 2593 | LYM611 | radish|gb164|EX751194 | 6503 | 564 | 86.2 | glotblastn |
| 2594 | LYM611 | b_rapa|11v1|L38155_P1 | 6504 | 564 | 86 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2595 | LYM611 | chickpea\|11v1\|CD051320_P1 | 6505 | 564 | 86 | globlastp |
| 2596 | LYM611 | eschscholzia\|11v1\|CK751932_P1 | 6506 | 564 | 86 | globlastp |
| 2597 | LYM611 | poppy\|11v1\|FE965011_P1 | 6507 | 564 | 86 | globlastp |
| 2598 | LYM611 | poppy\|11v1\|SRR030259.194142_P1 | 6508 | 564 | 86 | globlastp |
| 2599 | LYM611 | thellungiella_parvulum\|11v1\|BY810123_P1 | 6509 | 564 | 86 | globlastp |
| 2600 | LYM611 | chelidonium\|11v1\|SRR084752X114234_T1 | 6510 | 564 | 85.84 | glotblastn |
| 2601 | LYM611 | thellungiella_parvulum\|11v1\|BY801043_P1 | 6511 | 564 | 85.8 | globlastp |
| 2602 | LYM611 | kiwi\|gb166\|FG418221_P1 | 6512 | 564 | 85.8 | globlastp |
| 2603 | LYM611 | solanum_phureja\|09v1\|SPHAW041240 | 6513 | 564 | 85.7 | globlastp |
| 2604 | LYM611 | b_oleracea\|gb161\|DY023459_T1 | 6514 | 564 | 85.66 | glotblastn |
| 2605 | LYM611 | vinca\|11v1\|SRR098690X123290_P1 | 6515 | 564 | 85.5 | globlastp |
| 2606 | LYM611 | rye\|12v1\|BE704833_P1 | 6516 | 564 | 85.4 | globlastp |
| 2607 | LYM611 | aquilegia\|10v2\|DR926250 | 6517 | 564 | 85.23 | globlastp |
| 2608 | LYM611 | abies\|11v2\|SRR098676X124250_T1 | 6518 | 564 | 85.13 | glotblastn |
| 2609 | LYM611 | ambrosia\|11v1\|SRR346935.126014_P1 | 6519 | 564 | 84.9 | globlastp |
| 2610 | LYM611 | pseudotsuga\|10v1\|SRR065119S0004989 | 6520 | 564 | 84.9 | globlastp |
| 2611 | LYM611 | strawberry\|11v1\|CO817045 | 6521 | 564 | 84.9 | globlastp |
| 2612 | LYM611 | maritime_pine\|10v1\|BX250540_P1 | 6522 | 564 | 84.8 | globlastp |
| 2613 | LYM611 | pine\|10v2\|AW056700_P1 | 6523 | 564 | 84.6 | globlastp |
| 2614 | LYM611 | gossypium_raimondii\|12v1\|AI727905_T1 | 6524 | 564 | 84.47 | glotblastn |
| 2615 | LYM611 | silene\|11v1\|SRR096785X110757_P1 | 6525 | 564 | 84.1 | globlastp |
| 2616 | LYM611 | zostera\|10v1\|SRR057351S0000590 | 6526 | 564 | 84.1 | globlastp |
| 2617 | LYM611 | sunflower\|12v1\|DY911131_P1 | 6527 | 564 | 83.7 | globlastp |
| 2618 | LYM611 | zostera\|10v1\|AM767310 | 6528 | 564 | 83.57 | glotblastn |
| 2619 | LYM611 | arabidopsis_lyrata\|09v1\|JGIAL008982_T1 | 6529 | 564 | 83.15 | glotblastn |
| 2620 | LYM611 | phyla\|11v2\|SRR099035X100113_P1 | 6530 | 564 | 82.3 | globlastp |
| 2621 | LYM611 | podocarpus\|10v1\|SRR065014S0030106_P1 | 6531 | 564 | 82.1 | globlastp |
| 2622 | LYM611 | sciadopitys\|10v1\|SRR065035S0022639 | 6532 | 564 | 81.9 | globlastp |
| 2623 | LYM611 | euonymus\|11v1\|SRR070038X118006_T1 | 6533 | 564 | 81.54 | glotblastn |
| 2624 | LYM611 | cynara\|gb167\|GE577561_T1 | 6534 | 564 | 81.36 | glotblastn |
| 2625 | LYM611 | flaveria\|11v1\|SRR149229.376402XX1_T1 | 6535 | 564 | 81.18 | glotblastn |
| 2626 | LYM611 | pigeonpea\|11v1\|SRR054580X165407_P1 | 6536 | 564 | 80.9 | globlastp |
| 2627 | LYM611 | distylium\|11v1\|SRR065077X111648_P1 | 6537 | 564 | 80.5 | globlastp |
| 2628 | LYM612 | sorghum\|09v1\|SB04G037820 | 6538 | 565 | 89.4 | globlastp |
| 2629 | LYM612 | sorghum\|12v1\|SB04G037820_P1 | 6538 | 565 | 89.4 | globlastp |
| 2630 | LYM612 | sugarcane\|10v1\|CA137382 | 6539 | 565 | 86.4 | globlastp |
| 2631 | LYM612 | wheat\|10v2\|BE403878 | 6540 | 565 | 82.8 | globlastp |
| 2632 | LYM612 | pseudoroegneria\|gb167\|FF356910 | 6541 | 565 | 82.7 | globlastp |
| 2633 | LYM612 | foxtail_millet\|11v3\|PHY7SI020460M_T1 | 6542 | 565 | 82.35 | glotblastn |
| 2634 | LYM612 | switchgrass\|gb167\|FL732578 | 6543 | 565 | 82.09 | glotblastn |
| 2635 | LYM612 | rye\|12v1\|DRR001012.156852_T1 | 6544 | 565 | 81.02 | glotblastn |
| 2636 | LYM612 | rye\|12v1\|DRR001012.455264_P1 | 6545 | 565 | 80.2 | globlastp |
| 2637 | LYM612 | rice\|11v1\|OSU16257_P1 | 6546 | 565 | 80 | globlastp |
| 2638 | LYM612 | rice\|gb170\|OS02G57760 | 6546 | 565 | 80 | globlastp |
| 2639 | LYM613 | rice\|11v1\|AA753385_P1 | 6547 | 566 | 88.7 | globlastp |
| 2640 | LYM613 | rice\|gb170\|OS01G14950 | 6547 | 566 | 88.7 | globlastp |
| 2641 | LYM613 | sunflower\|12v1\|CD854960_P1 | 6548 | 566 | 83.7 | globlastp |
| 2642 | LYM613 | nicotiana_benthamiana\|gb162\|CN748020_P1 | 6549 | 566 | 83.2 | globlastp |
| 2643 | LYM613 | cotton\|10v2\|CO071731 | 6550 | 566 | 82.5 | globlastp |
| 2644 | LYM613 | euonymus\|11v1\|SRR070038X108680_P1 | 6551 | 566 | 82.3 | globlastp |
| 2645 | LYM613 | cotton\|11v1\|EV483104_P1 | 6552 | 566 | 82.1 | globlastp |
| 2646 | LYM613 | cotton\|10v2\|SRR032367S0114652 | 6553 | 566 | 82.1 | globlastp |
| 2647 | LYM613 | gossypium_raimondii\|12v1\|DV849345_P1 | 6554 | 566 | 82 | globlastp |
| 2648 | LYM613 | cotton\|11v1\|DW480993_P1 | 6554 | 566 | 82 | globlastp |
| 2649 | LYM613 | ambrosia\|11v1\|SRR346943.236458_T1 | 6555 | 566 | 81.92 | glotblastn |
| 2650 | LYM613 | ambrosia\|11v1\|SRR346935.121691_T1 | 6556 | 566 | 81.77 | glotblastn |
| 2651 | LYM613 | sunflower\|12v1\|DY941579_T1 | 6557 | 566 | 81.54 | glotblastn |
| 2652 | LYM613 | triphysaria\|10v1\|EX999372 | 6558 | 566 | 80 | globlastp |
| 2653 | LYM614 | sorghum\|09v1\|SB03G044840 | 6559 | 567 | 90.7 | globlastp |
| 2654 | LYM614 | sorghum\|12v1\|SB03G044840_P1 | 6559 | 567 | 90.7 | globlastp |
| 2655 | LYM614 | foxtail_millet\|11v3\|PHY7SI002254M_P1 | 6560 | 567 | 84.4 | globlastp |
| 2656 | LYM614 | switchgrass\|gb167\|FE601061 | 6561 | 567 | 83.3 | globlastp |
| 2657 | LYM615 | sorghum\|09v1\|SB01G041310 | 6562 | 568 | 97 | globlastp |
| 2658 | LYM615 | sorghum\|12v1\|SB01G041310_P1 | 6562 | 568 | 97 | globlastp |
| 2659 | LYM615 | sugarcane\|10v1\|CA082257 | 6563 | 568 | 93.9 | globlastp |
| 2660 | LYM615 | foxtail_millet\|11v3\|PHY7SI034968M_P1 | 6564 | 568 | 93.8 | globlastp |
| 2661 | LYM615 | foxtail_millet\|10v2\|SICRP005786 | 6565 | 568 | 92.69 | glotblastn |
| 2662 | LYM615 | switchgrass\|gb167\|FE650016 | 6566 | 568 | 92.4 | globlastp |
| 2663 | LYM615 | rice\|11v1\|BE229586_P1 | 6567 | 568 | 86.5 | globlastp |
| 2664 | LYM615 | rice\|gb170\|OS03G14010 | 6567 | 568 | 86.5 | globlastp |
| 2665 | LYM615 | brachypodium\|09v1\|DV482321 | 6568 | 568 | 85.3 | globlastp |
| 2666 | LYM615 | brachypodium\|12v1\|BRADI1G68310_P1 | 6568 | 568 | 85.3 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2667 | LYM615 | rye\|12v1\|DRR001012.124283_P1 | 6569 | 568 | 84.3 | globlastp |
| 2668 | LYM615 | barley\|10v2\|AV834621_T1 | 6570 | 568 | 83.42 | glotblastn |
| 2669 | LYM615 | wheat\|10v2\|CA656584 | 6571 | 568 | 82.4 | globlastp |
| 2670 | LYM616 | sorghum\|09v1\|SB03G030390 | 6572 | 569 | 94.4 | globlastp |
| 2671 | LYM616 | sorghum\|12v1\|SB03G030390_P1 | 6572 | 569 | 94.4 | globlastp |
| 2672 | LYM616 | foxtail_millet\|11v3\|PHY7SI000874M_P1 | 6573 | 569 | 89.8 | globlastp |
| 2673 | LYM616 | rice\|11v1\|CB214022_P1 | 6574 | 569 | 82.4 | globlastp |
| 2674 | LYM616 | rice\|gb170\|OS01G47460 | 6574 | 569 | 82.4 | globlastp |
| 2675 | LYM616 | brachypodium\|09v1\|DV486637 | 6575 | 569 | 80.1 | globlastp |
| 2676 | LYM616 | brachypodium\|12v1\|BRADI2G45840_P1 | 6575 | 569 | 80.1 | globlastp |
| 2677 | LYM617 | maize\|10v1\|AW171786_P1 | 6576 | 570 | 93.1 | globlastp |
| 2678 | LYM617 | sorghum\|09v1\|SB08G015570 | 6577 | 570 | 90.3 | globlastp |
| 2679 | LYM617 | sorghum\|12v1\|SB08G015570_P1 | 6577 | 570 | 90.3 | globlastp |
| 2680 | LYM617 | sugarcane\|10v1\|CA103075 | 6578 | 570 | 87.2 | globlastp |
| 2681 | LYM617 | foxtail_millet\|11v3\|PHY7SI022909M_P1 | 6579 | 570 | 86.2 | globlastp |
| 2682 | LYM618 | maize\|10v1\|AI438430_P1 | 6580 | 571 | 98.4 | globlastp |
| 2683 | LYM618 | cynodon\|10v1\|ES294929_P1 | 6581 | 571 | 98 | globlastp |
| 2684 | LYM618 | sugarcane\|10v1\|AA842746 | 6582 | 571 | 98 | globlastp |
| 2685 | LYM618 | sugarcane\|10v1\|BQ536636 | 6583 | 571 | 98 | globlastp |
| 2686 | LYM618 | sorghum\|09v1\|SB02G040990 | 6584 | 571 | 97.6 | globlastp |
| 2687 | LYM618 | sorghum\|12v1\|SB02G040990_P1 | 6584 | 571 | 97.6 | globlastp |
| 2688 | LYM618 | cenchrus\|gb166\|EB658585_P1 | 6585 | 571 | 97.2 | globlastp |
| 2689 | LYM618 | maize\|10v1\|AI943816_P1 | 6586 | 571 | 97.2 | globlastp |
| 2690 | LYM618 | millet\|10v1\|EVO454PM004421_P1 | 6587 | 571 | 97.2 | globlastp |
| 2691 | LYM618 | switchgrass\|gb167\|DN143286 | 6588 | 571 | 97.2 | globlastp |
| 2692 | LYM618 | foxtail_millet\|11v3\|PHY7SI002675M_P1 | 6589 | 571 | 96.8 | globlastp |
| 2693 | LYM618 | foxtail_millet\|10v2\|SICRP018121 | 6589 | 571 | 96.8 | globlastp |
| 2694 | LYM618 | rice\|11v1\|BM420295_P1 | 6590 | 571 | 96.8 | globlastp |
| 2695 | LYM618 | rice\|gb170\|OS01G59600 | 6590 | 571 | 96.8 | globlastp |
| 2696 | LYM618 | sorghum\|09v1\|SB03G037640 | 6591 | 571 | 96.8 | globlastp |
| 2697 | LYM618 | sorghum\|12v1\|SB03G037640_P1 | 6591 | 571 | 96.8 | globlastp |
| 2698 | LYM618 | switchgrass\|gb167\|FE604411 | 6592 | 571 | 96.8 | globlastp |
| 2699 | LYM618 | sugarcane\|10v1\|CA072118 | 6593 | 571 | 96.4 | globlastp |
| 2700 | LYM618 | brachypodium\|09v1\|GT761626 | 6594 | 571 | 93.6 | globlastp |
| 2701 | LYM618 | brachypodium\|12v1\|BRADI2G21510_P1 | 6594 | 571 | 93.6 | globlastp |
| 2702 | LYM618 | rice\|11v1\|AA750193_P1 | 6595 | 571 | 93.2 | globlastp |
| 2703 | LYM618 | rice\|gb170\|OS05G41180 | 6595 | 571 | 93.2 | globlastp |
| 2704 | LYM618 | rye\|12v1\|DRR001012.178515_P1 | 6596 | 571 | 92.8 | globlastp |
| 2705 | LYM618 | rye\|12v1\|DRR001012.303733_P1 | 6596 | 571 | 92.8 | globlastp |
| 2706 | LYM618 | wheat\|10v2\|BE404474 | 6596 | 571 | 92.8 | globlastp |
| 2707 | LYM618 | oat\|11v1\|GO583329_P1 | 6597 | 571 | 92.4 | globlastp |
| 2708 | LYM618 | rye\|12v1\|BE586303_P1 | 6598 | 571 | 92.4 | globlastp |
| 2709 | LYM618 | rye\|12v1\|DRR001012.197950_P1 | 6598 | 571 | 92.4 | globlastp |
| 2710 | LYM618 | barley\|10v2\|BF623820_P1 | 6598 | 571 | 92.4 | globlastp |
| 2711 | LYM618 | oat\|10v2\|GO583329 | 6599 | 571 | 92.4 | globlastp |
| 2712 | LYM618 | oat\|10v2\|GO592015 | 6597 | 571 | 92.4 | globlastp |
| 2713 | LYM618 | oat\|11v1\|GO592141_P1 | 6597 | 571 | 92.4 | globlastp |
| 2714 | LYM618 | wheat\|10v2\|BE399052 | 6598 | 571 | 92.4 | globlastp |
| 2715 | LYM618 | platanus\|11v1\|SRR096786X124431_P1 | 6600 | 571 | 90.4 | globlastp |
| 2716 | LYM618 | tripterygium\|11v1\|SRR098677X100363_P1 | 6601 | 571 | 90 | globlastp |
| 2717 | LYM618 | solanum_phureja\|09v1\|SPHAI488953 | 6602 | 571 | 90 | globlastp |
| 2718 | LYM618 | euonymus\|11v1\|SRR070038X215578_P1 | 6603 | 571 | 89.6 | globlastp |
| 2719 | LYM618 | platanus\|11v1\|SRR096786X131437_P1 | 6604 | 571 | 89.6 | globlastp |
| 2720 | LYM618 | pineapple\|10v1\|CO731274_P1 | 6605 | 571 | 89.6 | globlastp |
| 2721 | LYM618 | potato\|10v1\|BG594265_P1 | 6606 | 571 | 89.6 | globlastp |
| 2722 | LYM618 | tomato\|09v1\|AI488953 | 6606 | 571 | 89.6 | globlastp |
| 2723 | LYM618 | tomato\|11v1\|AI488953_P1 | 6606 | 571 | 89.6 | globlastp |
| 2724 | LYM618 | walnuts\|gb166\|CV196428 | 6607 | 571 | 89.6 | globlastp |
| 2725 | LYM618 | oil_palm\|11v1\|EL691488_P1 | 6608 | 571 | 89.2 | globlastp |
| 2726 | LYM618 | phalaenopsis\|11v1\|CK857600_P1 | 6609 | 571 | 89.2 | globlastp |
| 2727 | LYM618 | phalaenopsis\|11v1\|CK858273_P1 | 6609 | 571 | 89.2 | globlastp |
| 2728 | LYM618 | citrus\|gb166\|CB304559 | 6610 | 571 | 89.2 | globlastp |
| 2729 | LYM618 | clementine\|11v1\|CB304559_P1 | 6610 | 571 | 89.2 | globlastp |
| 2730 | LYM618 | eggplant\|10v1\|FS001536_P1 | 6611 | 571 | 89.2 | globlastp |
| 2731 | LYM618 | oil_palm\|gb166\|EL691488 | 6608 | 571 | 89.2 | globlastp |
| 2732 | LYM618 | orange\|11v1\|CB304559_P1 | 6610 | 571 | 89.2 | globlastp |
| 2733 | LYM618 | potato\|10v1\|BQ117432_P1 | 6612 | 571 | 89.2 | globlastp |
| 2734 | LYM618 | solanum_phureja\|09v1\|SPHBG126931 | 6612 | 571 | 89.2 | globlastp |
| 2735 | LYM618 | tobacco\|gb162\|CV016306 | 6613 | 571 | 89.2 | globlastp |
| 2736 | LYM618 | flax\|11v1\|GW865887_P1 | 6614 | 571 | 88.8 | globlastp |
| 2737 | LYM618 | oil_palm\|11v1\|SRR190698.146841_P1 | 6615 | 571 | 88.8 | globlastp |
| 2738 | LYM618 | olea\|11v1\|SRR014463.10628_P1 | 6616 | 571 | 88.8 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2739 | LYM618 | watermelon\|11v1\|DV634469_P1 | 6617 | 571 | 88.8 | globlastp |
| 2740 | LYM618 | cucumber\|09v1\|CK085605_P1 | 6618 | 571 | 88.8 | globlastp |
| 2741 | LYM618 | ipomoea_nil\|10v1\|CJ747523_P1 | 6619 | 571 | 88.8 | globlastp |
| 2742 | LYM618 | melon\|10v1\|DV631752_P1 | 6620 | 571 | 88.8 | globlastp |
| 2743 | LYM618 | sunflower\|10v1\|CD852210 | 6621 | 571 | 88.8 | globlastp |
| 2744 | LYM618 | sunflower\|12v1\|CD852210_P1 | 6621 | 571 | 88.8 | globlastp |
| 2745 | LYM618 | ambrosia\|11v1\|SRR346935.264705_P1 | 6622 | 571 | 88.4 | globlastp |
| 2746 | LYM618 | aquilegia\|10v1\|DT745261_P1 | 6623 | 571 | 88.4 | globlastp |
| 2747 | LYM618 | cucurbita\|11v1\|FG227439_P1 | 6624 | 571 | 88.4 | globlastp |
| 2748 | LYM618 | euonymus\|11v1\|SRR070038X120289_P1 | 6625 | 571 | 88.4 | globlastp |
| 2749 | LYM618 | chestnut\|gb170\|SRR006295S0019528_P1 | 6626 | 571 | 88.4 | globlastp |
| 2750 | LYM618 | gerbera\|09v1\|AJ758761_P1 | 6627 | 571 | 88.4 | globlastp |
| 2751 | LYM618 | peanut\|10v1\|ES490885_P1 | 6628 | 571 | 88.4 | globlastp |
| 2752 | LYM618 | peanut\|10v1\|ES722433_P1 | 6628 | 571 | 88.4 | globlastp |
| 2753 | LYM618 | pepper\|gb171\|BM063024_P1 | 6629 | 571 | 88.4 | globlastp |
| 2754 | LYM618 | tomato\|09v1\|BG126931 | 6630 | 571 | 88.4 | globlastp |
| 2755 | LYM618 | tomato\|11v1\|BG126931_P1 | 6630 | 571 | 88.4 | globlastp |
| 2756 | LYM618 | tragopogon\|10v1\|SRR020205S0020529 | 6631 | 571 | 88.4 | globlastp |
| 2757 | LYM618 | zostera\|10v1\|SRR057351S0008909 | 6632 | 571 | 88.4 | globlastp |
| 2758 | LYM618 | chelidonium\|11v1\|SRR084752X117011_T1 | 6633 | 571 | 88.35 | glotblastn |
| 2759 | LYM618 | amborella\|12v2\|SRR038634.8195_P1 | 6634 | 571 | 88 | globlastp |
| 2760 | LYM618 | amorphophallus\|11v2\|SRR089351X325197_P1 | 6635 | 571 | 88 | globlastp |
| 2761 | LYM618 | cucurbita\|11v1\|SRR091276X113571_P1 | 6636 | 571 | 88 | globlastp |
| 2762 | LYM618 | phyla\|11v2\|SRR099037X118182_P1 | 6637 | 571 | 88 | globlastp |
| 2763 | LYM618 | aquilegia\|10v2\|DT745261 | 6638 | 571 | 88 | globlastp |
| 2764 | LYM618 | cichorium\|gb171\|DT214124_P1 | 6639 | 571 | 88 | globlastp |
| 2765 | LYM618 | pepper\|gb171\|BM065004_P1 | 6640 | 571 | 88 | globlastp |
| 2766 | LYM618 | safflower\|gb162\|EL378335 | 6641 | 571 | 88 | globlastp |
| 2767 | LYM618 | sunflower\|10v1\|DY913072 | 6642 | 571 | 88 | globlastp |
| 2768 | LYM618 | aristolochia\|10v1\|SRR039085S0175270_T1 | 6643 | 571 | 87.95 | glotblastn |
| 2769 | LYM618 | amsonia\|11v1\|SRR098688X109897_P1 | 6644 | 571 | 87.6 | globlastp |
| 2770 | LYM618 | apple\|11v1\|CN883649_P1 | 6645 | 571 | 87.6 | globlastp |
| 2771 | LYM618 | arnica\|11v1\|SRR099034X105811_P1 | 6646 | 571 | 87.6 | globlastp |
| 2772 | LYM618 | arnica\|11v1\|SRR099034X112592XX2_P1 | 6647 | 571 | 87.6 | globlastp |
| 2773 | LYM618 | catharanthus\|11v1\|EG557339_P1 | 6648 | 571 | 87.6 | globlastp |
| 2774 | LYM618 | eschscholzia\|11v1\|SRR014116.104619_P1 | 6649 | 571 | 87.6 | globlastp |
| 2775 | LYM618 | eschscholzia\|11v1\|SRR014116.127866_P1 | 6650 | 571 | 87.6 | globlastp |
| 2776 | LYM618 | sunflower\|12v1\|DY913072_P1 | 6651 | 571 | 87.6 | globlastp |
| 2777 | LYM618 | apple\|gb171\|CN493150 | 6645 | 571 | 87.6 | globlastp |
| 2778 | LYM618 | basilicum\|10v1\|DY336625_P1 | 6652 | 571 | 87.6 | globlastp |
| 2779 | LYM618 | cassava\|09v1\|FF380265_P1 | 6653 | 571 | 87.6 | globlastp |
| 2780 | LYM618 | centaurea\|gb166\|EH711172_P1 | 6654 | 571 | 87.6 | globlastp |
| 2781 | LYM618 | centaurea\|gb166\|EH714679_P1 | 6655 | 571 | 87.6 | globlastp |
| 2782 | LYM618 | coffea\|10v1\|DQ124065_P1 | 6656 | 571 | 87.6 | globlastp |
| 2783 | LYM618 | dandelion\|10v1\|DR400215_P1 | 6657 | 571 | 87.6 | globlastp |
| 2784 | LYM618 | grape\|11v1\|GSVIVT01025839001_P1 | 6658 | 571 | 87.6 | globlastp |
| 2785 | LYM618 | grape\|gb160\|BQ792102 | 6658 | 571 | 87.6 | globlastp |
| 2786 | LYM618 | lettuce\|10v1\|DW044895_P1 | 6659 | 571 | 87.6 | globlastp |
| 2787 | LYM618 | liriodendron\|gb166\|CK759778_P1 | 6660 | 571 | 87.6 | globlastp |
| 2788 | LYM618 | oak\|10v1\|DB996700_P1 | 6661 | 571 | 87.6 | globlastp |
| 2789 | LYM618 | petunia\|gb171\|CV300555_P1 | 6662 | 571 | 87.6 | globlastp |
| 2790 | LYM618 | prunus\|10v1\|CB823004 | 6663 | 571 | 87.6 | globlastp |
| 2791 | LYM618 | soybean\|11v1\|GLYMA05G14330 | 6664 | 571 | 87.6 | globlastp |
| 2792 | LYM618 | strawberry\|11v1\|CO378625 | 6665 | 571 | 87.6 | globlastp |
| 2793 | LYM618 | tobacco\|gb162\|EB424607 | 6666 | 571 | 87.6 | globlastp |
| 2794 | LYM618 | ambrosia\|11v1\|SRR346935.124143_T1 | 6667 | 571 | 87.55 | glotblastn |
| 2795 | LYM618 | beech\|11v1\|SRR006293.15566_T1 | 6668 | 571 | 87.55 | glotblastn |
| 2796 | LYM618 | cirsium\|11v1\|SRR346952.1000620_T1 | 6669 | 571 | 87.15 | glotblastn |
| 2797 | LYM618 | apple\|11v1\|CN490111_P1 | 6670 | 571 | 87.1 | globlastp |
| 2798 | LYM618 | rose\|12v1\|BQ104516_P1 | 6671 | 571 | 87.1 | globlastp |
| 2799 | LYM618 | sunflower\|12v1\|CF086123_P1 | 6672 | 571 | 87.1 | globlastp |
| 2800 | LYM618 | tabernaemontana\|11v1\|SRR098689X112460_P1 | 6673 | 571 | 87.1 | globlastp |
| 2801 | LYM618 | tabernaemontana\|11v1\|SRR098689X112536_P1 | 6674 | 571 | 87.1 | globlastp |
| 2802 | LYM618 | vinca\|11v1\|SRR098690X120702_P1 | 6675 | 571 | 87.1 | globlastp |
| 2803 | LYM618 | apple\|gb171\|CN490111 | 6670 | 571 | 87.1 | globlastp |
| 2804 | LYM618 | cleome_spinosa\|10v1\|GR933889_P1 | 6676 | 571 | 87.1 | globlastp |
| 2805 | LYM618 | monkeyflower\|10v1\|DV207163_P1 | 6677 | 571 | 87.1 | globlastp |
| 2806 | LYM618 | nicotiana_benthamiana\|gb162\|CN743481_P1 | 6678 | 571 | 87.1 | globlastp |
| 2807 | LYM618 | pigeonpea\|10v1\|SRR054580S0009847 | 6679 | 571 | 87.1 | globlastp |
| 2808 | LYM618 | pigeonpea\|11v1\|SRR054580X101219_P1 | 6679 | 571 | 87.1 | globlastp |
| 2809 | LYM618 | senecio\|gb170\|CO553167 | 6680 | 571 | 87.1 | globlastp |
| 2810 | LYM618 | soybean\|11v1\|GLYMA19G17920 | 6681 | 571 | 87.1 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2811 | LYM618 | tobacco\|gb162\|DV157641 | 6682 | 571 | 87.1 | globlastp |
| 2812 | LYM618 | walnuts\|gb166\|CV197554 | 6683 | 571 | 87.1 | globlastp |
| 2813 | LYM618 | cannabis\|12v1\|JK493807_P1 | 6684 | 571 | 86.7 | globlastp |
| 2814 | LYM618 | cotton\|11v1\|BF272183XX1_P1 | 6685 | 571 | 86.7 | globlastp |
| 2815 | LYM618 | fagopyrum\|11v1\|SRR063689X100335_P1 | 6686 | 571 | 86.7 | globlastp |
| 2816 | LYM618 | flaveria\|11v1\|SRR149229.121715_P1 | 6687 | 571 | 86.7 | globlastp |
| 2817 | LYM618 | flaveria\|11v1\|SRR149229.18262_P1 | 6687 | 571 | 86.7 | globlastp |
| 2818 | LYM618 | flaveria\|11v1\|SRR149232.226868_P1 | 6688 | 571 | 86.7 | globlastp |
| 2819 | LYM618 | gossypium_raimondii\|12v1\|BF272183_P1 | 6685 | 571 | 86.7 | globlastp |
| 2820 | LYM618 | sarracenia\|11v1\|SRR192669.102682_P1 | 6689 | 571 | 86.7 | globlastp |
| 2821 | LYM618 | antirrhinum\|gb166\|AJ559235_P1 | 6690 | 571 | 86.7 | globlastp |
| 2822 | LYM618 | bean\|12v1\|CA905802_P1 | 6691 | 571 | 86.7 | globlastp |
| 2823 | LYM618 | bean\|gb167\|CA905802 | 6691 | 571 | 86.7 | globlastp |
| 2824 | LYM618 | cacao\|10v1\|CU577695_P1 | 6692 | 571 | 86.7 | globlastp |
| 2825 | LYM618 | clover\|gb162\|BB903744_P1 | 6693 | 571 | 86.7 | globlastp |
| 2826 | LYM618 | cowpea\|gb166\|FC458472_P1 | 6694 | 571 | 86.7 | globlastp |
| 2827 | LYM618 | kiwi\|gb166\|FG405965_P1 | 6695 | 571 | 86.7 | globlastp |
| 2828 | LYM618 | monkeyflower\|10v1\|CV521520_P1 | 6696 | 571 | 86.7 | globlastp |
| 2829 | LYM618 | poplar\|10v1\|AI163521_P1 | 6697 | 571 | 86.7 | globlastp |
| 2830 | LYM618 | zostera\|10v1\|AM768788 | 6698 | 571 | 86.7 | globlastp |
| 2831 | LYM618 | beet\|12v1\|BE590418_P1 | 6699 | 571 | 86.3 | globlastp |
| 2832 | LYM618 | fagopyrum\|11v1\|SRR063689X103805_P1 | 6700 | 571 | 86.3 | globlastp |
| 2833 | LYM618 | fagopyrum\|11v1\|SRR063689X141652_P1 | 6700 | 571 | 86.3 | globlastp |
| 2834 | LYM618 | silene\|11v1\|GH293083_P1 | 6701 | 571 | 86.3 | globlastp |
| 2835 | LYM618 | vinca\|11v1\|SRR098690X103571_P1 | 6702 | 571 | 86.3 | globlastp |
| 2836 | LYM618 | cacao\|10v1\|CU485045_P1 | 6703 | 571 | 86.3 | globlastp |
| 2837 | LYM618 | cotton\|10v2\|SRR032367S0071053 | 6704 | 571 | 86.3 | globlastp |
| 2838 | LYM618 | ginseng\|10v1\|CN846008_P1 | 6705 | 571 | 86.3 | globlastp |
| 2839 | LYM618 | lotus\|09v1\|BI419229_P1 | 6706 | 571 | 86.3 | globlastp |
| 2840 | LYM618 | nasturtium\|10v1\|SRR032558S0004295 | 6707 | 571 | 86.3 | globlastp |
| 2841 | LYM618 | nasturtium\|11v1\|SRR032558.115231_P1 | 6707 | 571 | 86.3 | globlastp |
| 2842 | LYM618 | orobanche\|10v1\|SRR023189S0003207_P1 | 6708 | 571 | 86.3 | globlastp |
| 2843 | LYM618 | taxus\|10v1\|SRR032523S0026069 | 6709 | 571 | 86.3 | globlastp |
| 2844 | LYM618 | flaveria\|11v1\|SRR149229.10776_T1 | 6710 | 571 | 85.94 | glotblastn |
| 2845 | LYM618 | cephalotaxus\|11v1\|SRR064395X102481_P1 | 6711 | 571 | 85.9 | globlastp |
| 2846 | LYM618 | chickpea\|11v1\|GR407793_P1 | 6712 | 571 | 85.9 | globlastp |
| 2847 | LYM618 | eucalyptus\|11v2\|CB967808_P1 | 6713 | 571 | 85.9 | globlastp |
| 2848 | LYM618 | euphorbia\|11v1\|BP961149_P1 | 6714 | 571 | 85.9 | globlastp |
| 2849 | LYM618 | gossypium_raimondii\|12v1\|AI729204_P1 | 6715 | 571 | 85.9 | globlastp |
| 2850 | LYM618 | phyla\|11v2\|SRR099035X135361_P1 | 6716 | 571 | 85.9 | globlastp |
| 2851 | LYM618 | plantago\|11v2\|SRR066373X101438_P1 | 6717 | 571 | 85.9 | globlastp |
| 2852 | LYM618 | poppy\|11v1\|FE964927_P1 | 6718 | 571 | 85.9 | globlastp |
| 2853 | LYM618 | poppy\|11v1\|SRR030259.197569_P1 | 6718 | 571 | 85.9 | globlastp |
| 2854 | LYM618 | trigonella\|11v1\|SRR066194X106460_P1 | 6719 | 571 | 85.9 | globlastp |
| 2855 | LYM618 | cotton\|10v2\|BF278408 | 6715 | 571 | 85.9 | globlastp |
| 2856 | LYM618 | cotton\|11v1\|AI729204_P1 | 6715 | 571 | 85.9 | globlastp |
| 2857 | LYM618 | eucalyptus\|11v1\|CB967808 | 6713 | 571 | 85.9 | globlastp |
| 2858 | LYM618 | medicago\|09v1\|LLAW685471 | 6720 | 571 | 85.9 | globlastp |
| 2859 | LYM618 | medicago\|12v1\|AW685471_P1 | 6720 | 571 | 85.9 | globlastp |
| 2860 | LYM618 | nasturtium\|10v1\|GH162890 | 6721 | 571 | 85.9 | globlastp |
| 2861 | LYM618 | nasturtium\|11v1\|GH162890_P1 | 6721 | 571 | 85.9 | globlastp |
| 2862 | LYM618 | sciadopitys\|10v1\|SRR065035S0020951 | 6722 | 571 | 85.9 | globlastp |
| 2863 | LYM618 | tamarix\|gb166\|EG970613 | 6723 | 571 | 85.9 | globlastp |
| 2864 | LYM618 | cedrus\|11v1\|SRR065007X105181_P1 | 6724 | 571 | 85.5 | globlastp |
| 2865 | LYM618 | euphorbia\|11v1\|DV123915_P1 | 6725 | 571 | 85.5 | globlastp |
| 2866 | LYM618 | gossypium_raimondii\|12v1\|AI728999_P1 | 6726 | 571 | 85.5 | globlastp |
| 2867 | LYM618 | cotton\|10v2\|BQ404009 | 6726 | 571 | 85.5 | globlastp |
| 2868 | LYM618 | cotton\|11v1\|AI728999_P1 | 6726 | 571 | 85.5 | globlastp |
| 2869 | LYM618 | podocarpus\|10v1\|SRR065014S0002788_P1 | 6727 | 571 | 85.5 | globlastp |
| 2870 | LYM618 | poplar\|10v1\|AI161591_P1 | 6728 | 571 | 85.5 | globlastp |
| 2871 | LYM618 | spurge\|gb161\|DV123915 | 6725 | 571 | 85.5 | globlastp |
| 2872 | LYM618 | abies\|11v2\|SRR098676X108000_P1 | 6729 | 571 | 85.1 | globlastp |
| 2873 | LYM618 | canola\|11v1\|SRR329661.178392_P1 | 6730 | 571 | 85.1 | globlastp |
| 2874 | LYM618 | distylium\|11v1\|SRR065077X10715_P1 | 6731 | 571 | 85.1 | globlastp |
| 2875 | LYM618 | euphorbia\|11v1\|SRR098678X105123_P1 | 6732 | 571 | 85.1 | globlastp |
| 2876 | LYM618 | thellungiella_parvulum\|11v1\|EPCRP000355_P1 | 6733 | 571 | 85.1 | globlastp |
| 2877 | LYM618 | valeriana\|11v1\|SRR099039X102057_P1 | 6734 | 571 | 85.1 | globlastp |
| 2878 | LYM618 | sequoia\|10v1\|SRR065044S0008978 | 6735 | 571 | 85.1 | globlastp |
| 2879 | LYM618 | spruce\|11v1\|ES860369_P1 | 6736 | 571 | 85.1 | globlastp |
| 2880 | LYM618 | spruce\|gb162\|CO232377 | 6736 | 571 | 85.1 | globlastp |
| 2881 | LYM618 | triphysaria\|10v1\|EY020960 | 6737 | 571 | 85.1 | globlastp |
| 2882 | LYM618 | ambrosia\|11v1\|SRR346935.193248_P1 | 6738 | 571 | 85 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2883 | LYM618 | cephalotaxus\|11v1\|SRR064395X117699_P1 | 6739 | 571 | 84.7 | globlastp |
| 2884 | LYM618 | arabidopsis_lyrata\|09v1\|JGIAL013640_P1 | 6740 | 571 | 84.7 | globlastp |
| 2885 | LYM618 | maize\|10v1\|AI901972_P1 | 6741 | 571 | 84.7 | globlastp |
| 2886 | LYM618 | pine\|10v2\|AA739655_P1 | 6742 | 571 | 84.7 | globlastp |
| 2887 | LYM618 | pseudotsuga\|10v1\|SRR065119S0002247 | 6743 | 571 | 84.7 | globlastp |
| 2888 | LYM618 | pteridium\|11v1\|SRR043594X105305_P1 | 6744 | 571 | 84.4 | globlastp |
| 2889 | LYM618 | maritime_pine\|10v1\|BX253443XX1_T1 | 6745 | 571 | 84.34 | glotblastn |
| 2890 | LYM618 | canola\|11v1\|DY030602_P1 | 6746 | 571 | 84.3 | globlastp |
| 2891 | LYM618 | thellungiella_halophilum\|11v1\|DN779086_P1 | 6746 | 571 | 84.3 | globlastp |
| 2892 | LYM618 | arabidopsis\|10v1\|AT2G27020_P1 | 6747 | 571 | 84.3 | globlastp |
| 2893 | LYM618 | b_rapa\|11v1\|CD813166_P1 | 6746 | 571 | 84.3 | globlastp |
| 2894 | LYM618 | b_rapa\|gb162\|DN960579 | 6746 | 571 | 84.3 | globlastp |
| 2895 | LYM618 | b_rapa\|11v1\|CD838453_P1 | 6748 | 571 | 84.3 | globlastp |
| 2896 | LYM618 | b_rapa\|gb162\|DY010259 | 6746 | 571 | 84.3 | globlastp |
| 2897 | LYM618 | canola\|10v1\|CD813166 | 6746 | 571 | 84.3 | globlastp |
| 2898 | LYM618 | canola\|10v1\|CD838453 | 6746 | 571 | 84.3 | globlastp |
| 2899 | LYM618 | pseudoroegneria\|gb167\|FF351474 | 6749 | 571 | 84.3 | globlastp |
| 2900 | LYM618 | radish\|gb164\|EV527775 | 6746 | 571 | 84.3 | globlastp |
| 2901 | LYM618 | radish\|gb164\|EV530225 | 6746 | 571 | 84.3 | globlastp |
| 2902 | LYM618 | radish\|gb164\|EV537779 | 6746 | 571 | 84.3 | globlastp |
| 2903 | LYM618 | thellungiella\|gb167\|DN779086 | 6746 | 571 | 84.3 | globlastp |
| 2904 | LYM618 | canola\|11v1\|CN737103_P1 | 6746 | 571 | 84.3 | globlastp |
| 2905 | LYM618 | lovegrass\|gb167\|EH184070_T1 | 6750 | 571 | 83.94 | glotblastn |
| 2906 | LYM618 | thellungiella_parvulum\|11v1\|DN779086_P1 | 6751 | 571 | 83.9 | globlastp |
| 2907 | LYM618 | canola\|10v1\|CX281705 | 6752 | 571 | 83.9 | globlastp |
| 2908 | LYM618 | radish\|gb164\|EV525491 | 6751 | 571 | 83.9 | globlastp |
| 2909 | LYM618 | catharanthus\|gb166\|EG557339 | 6753 | 571 | 83.6 | globlastp |
| 2910 | LYM618 | canola\|10v1\|CD818595 | 6754 | 571 | 83.5 | globlastp |
| 2911 | LYM618 | canola\|11v1\|EE439992_P1 | 6754 | 571 | 83.5 | globlastp |
| 2912 | LYM618 | radish\|gb164\|EX888469 | 6755 | 571 | 83.13 | glotblastn |
| 2913 | LYM618 | momordica\|10v1\|SRR071315S0001940_P1 | 6756 | 571 | 83.1 | globlastp |
| 2914 | LYM618 | triphysaria\|10v1\|EY138636 | 6757 | 571 | 82.8 | globlastp |
| 2915 | LYM618 | canola\|11v1\|DY004370XX1_T1 | 6758 | 571 | 82.73 | glotblastn |
| 2916 | LYM618 | ambrosia\|11v1\|SRR346935.195528_P1 | 6759 | 571 | 81.9 | globlastp |
| 2917 | LYM618 | acacia\|10v1\|FS583849_P1 | 6760 | 571 | 81.9 | globlastp |
| 2918 | LYM618 | onion\|gb162\|CF440672_P1 | 6761 | 571 | 81.9 | globlastp |
| 2919 | LYM618 | cynara\|gb167\|GE592900_P1 | 6762 | 571 | 81.7 | globlastp |
| 2920 | LYM618 | fraxinus\|11v1\|SRR058827.100577_P1 | 6763 | 571 | 81.5 | globlastp |
| 2921 | LYM618 | marchantia\|gb166\|C95781_P1 | 6764 | 571 | 81.2 | globlastp |
| 2922 | LYM618 | antirrhinum\|gb166\|AJ568496_T1 | 6765 | 571 | 81.12 | glotblastn |
| 2923 | LYM618 | banana\|10v1\|BBS3018T3_P1 | 6766 | 571 | 80.8 | globlastp |
| 2924 | LYM618 | utricularia\|11v1\|SRR094438.101641_T1 | 6767 | 571 | 80.32 | glotblastn |
| 2925 | LYM619 | sorghum\|09v1\|SB03G046760 | 6768 | 572 | 84.7 | globlastp |
| 2926 | LYM619 | sorghum\|12v1\|SB03G046760_P1 | 6768 | 572 | 84.7 | globlastp |
| 2927 | LYM620 | maize\|10v1\|EY954874_P1 | 6769 | 573 | 87.4 | globlastp |
| 2928 | LYM620 | sorghum\|09v1\|SB07G024120 | 6770 | 573 | 86.8 | globlastp |
| 2929 | LYM620 | sorghum\|12v1\|SB07G024120_P1 | 6770 | 573 | 86.8 | globlastp |
| 2930 | LYM620 | wheat\|10v2\|CA485488 | 6770 | 573 | 86.8 | globlastp |
| 2931 | LYM620 | millet\|10v1\|CD725000_P1 | 6771 | 573 | 86.2 | globlastp |
| 2932 | LYM620 | sugarcane\|10v1\|CA071057 | 6772 | 573 | 85.1 | globlastp |
| 2933 | LYM620 | switchgrass\|gb167\|FE653731 | 6773 | 573 | 83.1 | globlastp |
| 2934 | LYM620 | lovegrass\|gb167\|DN481354_P1 | 6774 | 573 | 82 | globlastp |
| 2935 | LYM620 | cynodon\|10v1\|ES293660_P1 | 6775 | 573 | 81.8 | globlastp |
| 2936 | LYM621 | sugarcane\|10v1\|BQ537527 | 6776 | 574 | 90.8 | globlastp |
| 2937 | LYM621 | sorghum\|09v1\|SB03G027650 | 6777 | 574 | 90.6 | globlastp |
| 2938 | LYM621 | sorghum\|12v1\|SB03G027650_P1 | 6777 | 574 | 90.6 | globlastp |
| 2939 | LYM621 | switchgrass\|gb167\|FE626940 | 6778 | 574 | 89.8 | globlastp |
| 2940 | LYM621 | switchgrass\|gb167\|FL750423 | 6779 | 574 | 89.8 | globlastp |
| 2941 | LYM621 | foxtail_millet\|11v3\|PHY7SI001055M_P1 | 6780 | 574 | 89.5 | globlastp |
| 2942 | LYM621 | foxtail_millet\|10v2\|SICRP006619 | 6780 | 574 | 89.5 | globlastp |
| 2943 | LYM621 | rice\|gb170\|OS01G42520 | 6781 | 574 | 85.6 | globlastp |
| 2944 | LYM621 | foxtail_millet\|11v3\|SICRP068714_P1 | 6782 | 574 | 84.3 | globlastp |
| 2945 | LYM621 | sorghum\|12v1\|SB12V1CRP050477_P1 | 6783 | 574 | 84.3 | globlastp |
| 2946 | LYM621 | rice\|11v1\|CF956339_P1 | 6784 | 574 | 82.2 | globlastp |
| 2947 | LYM621 | leymus\|gb166\|EG375712_P1 | 6785 | 574 | 82.2 | globlastp |
| 2948 | LYM621 | wheat\|10v2\|BE496946 | 6786 | 574 | 82.2 | globlastp |
| 2949 | LYM621 | leymus\|gb166\|EG378713_P1 | 6787 | 574 | 81.9 | globlastp |
| 2950 | LYM621 | wheat\|10v2\|BF293727 | 6788 | 574 | 81.9 | globlastp |
| 2951 | LYM621 | leymus\|gb166\|EG377756_P1 | 6789 | 574 | 81.6 | globlastp |
| 2952 | LYM621 | rye\|12v1\|BF145856_P1 | 6790 | 574 | 81.4 | globlastp |
| 2953 | LYM621 | rye\|12v1\|DRR001012.101816_P1 | 6790 | 574 | 81.4 | globlastp |
| 2954 | LYM621 | rye\|12v1\|DRR001012.106046_P1 | 6791 | 574 | 81.4 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 2955 | LYM621 | rye\|12v1\|DRR001012.104176_P1 | 6792 | 574 | 81.2 | globlastp |
| 2956 | LYM621 | rye\|12v1\|DRR001012.109716_P1 | 6793 | 574 | 81.1 | globlastp |
| 2957 | LYM621 | brachypodium\|09v1\|DV474047 | 6794 | 574 | 81.1 | globlastp |
| 2958 | LYM621 | brachypodium\|12v1\|BRADI2G43230_P1 | 6794 | 574 | 81.1 | globlastp |
| 2959 | LYM621 | rye\|12v1\|DRR001012.116443_P1 | 6795 | 574 | 80.9 | globlastp |
| 2960 | LYM621 | rye\|12v1\|DRR001012.107834_P1 | 6796 | 574 | 80.8 | globlastp |
| 2961 | LYM621 | rye\|12v1\|DRR001013.132894_T1 | 6797 | 574 | 80.63 | glotblastn |
| 2962 | LYM621 | barley\|10v2\|BE412553_P1 | 6798 | 574 | 80.6 | globlastp |
| 2963 | LYM622 | sorghum\|09v1\|SB02G003270 | 6799 | 575 | 91.1 | globlastp |
| 2964 | LYM622 | sorghum\|12v1\|SB02G003270_P1 | 6799 | 575 | 91.1 | globlastp |
| 2965 | LYM622 | foxtail_millet\|11v3\|PHY7SI029481M_T1 | 6800 | 575 | 89.51 | glotblastn |
| 2966 | LYM622 | switchgrass\|gb167\|FE620397 | 6801 | 575 | 85.8 | globlastp |
| 2967 | LYM622 | brachypodium\|09v1\|GT794739 | 6802 | 575 | 85.4 | globlastp |
| 2968 | LYM622 | brachypodium\|12v1\|BRADI1G57360_P1 | 6802 | 575 | 85.4 | globlastp |
| 2969 | LYM622 | wheat\|10v2\|BE430489 | 6803 | 575 | 85.1 | globlastp |
| 2970 | LYM622 | rye\|12v1\|DRR001012.11553_P1 | 6804 | 575 | 84.8 | globlastp |
| 2971 | LYM622 | rice\|11v1\|BI805150_P1 | 6805 | 575 | 84 | globlastp |
| 2972 | LYM622 | rice\|gb170\|OS07G06080 | 6805 | 575 | 84 | globlastp |
| 2973 | LYM622 | barley\|10v2\|BF626156_P1 | 6806 | 575 | 83.9 | globlastp |
| 2974 | LYM622 | leymus\|gb166\|EG402765_T1 | 6807 | 575 | 80.83 | glotblastn |
| 2975 | LYM623 | foxtail_millet\|11v3\|PHY7SI029615M_T1 | 6808 | 576 | 87.4 | glotblastn |
| 2976 | LYM623 | sorghum\|09v1\|SB02G036640 | 6809 | 576 | 84.6 | globlastp |
| 2977 | LYM623 | sorghum\|12v1\|SB02G036640_P1 | 6809 | 576 | 84.6 | globlastp |
| 2978 | LYM623 | rice\|11v1\|CI533235_T1 | 6810 | 576 | 82.18 | glotblastn |
| 2979 | LYM623 | rice\|gb170\|OS07G37960 | 6810 | 576 | 82.18 | glotblastn |
| 2980 | LYM623 | brachypodium\|09v1\|SRR031797S0060563 | 6811 | 576 | 80.59 | glotblastn |
| 2981 | LYM623 | brachypodium\|12v1\|BRADI1G24360_T1 | 6811 | 576 | 80.59 | glotblastn |
| 2982 | LYM624 | sorghum\|09v1\|SB01G009950 | 6812 | 577 | 92.2 | globlastp |
| 2983 | LYM624 | sorghum\|12v1\|SB01G009950_P1 | 6812 | 577 | 92.2 | globlastp |
| 2984 | LYM624 | millet\|10v1\|PMSLX0002798D1_P1 | 6813 | 577 | 89.7 | globlastp |
| 2985 | LYM624 | foxtail_millet\|11v3\|PHY7SI036077M_P1 | 6814 | 577 | 89.4 | globlastp |
| 2986 | LYM624 | maize\|10v1\|T12728_P1 | 6815 | 577 | 89.2 | globlastp |
| 2987 | LYM624 | switchgrass\|gb167\|DN147363 | 6816 | 577 | 88.6 | globlastp |
| 2988 | LYM624 | rice\|11v1\|AA752952_P1 | 6817 | 577 | 83.1 | globlastp |
| 2989 | LYM624 | rice\|gb170\|OS03G51010 | 6817 | 577 | 83.1 | globlastp |
| 2990 | LYM625 | sorghum\|09v1\|SB08G019430 | 6818 | 578 | 83 | globlastp |
| 2991 | LYM625 | sorghum\|12v1\|SB08G019430_P1 | 6818 | 578 | 83 | globlastp |
| 2992 | LYM628 | sugarcane\|10v1\|CA075372 | 6819 | 580 | 83.1 | globlastp |
| 2993 | LYM630 | sorghum\|09v1\|SB02G006130 | 6820 | 581 | 96.6 | globlastp |
| 2994 | LYM630 | sorghum\|12v1\|SB02G006130_P1 | 6820 | 581 | 96.6 | globlastp |
| 2995 | LYM630 | sugarcane\|10v1\|CA073637 | 6821 | 581 | 96.2 | globlastp |
| 2996 | LYM630 | switchgrass\|gb167\|DN145768 | 6822 | 581 | 95 | globlastp |
| 2997 | LYM630 | foxtail_millet\|11v3\|PHY7SI029978M_P1 | 6823 | 581 | 94 | globlastp |
| 2998 | LYM630 | foxtail_millet\|10v2\|SICRP009824 | 6823 | 581 | 94 | globlastp |
| 2999 | LYM630 | millet\|10v1\|EVO454PM054544_P1 | 6824 | 581 | 94 | globlastp |
| 3000 | LYM630 | brachypodium\|09v1\|DV487106 | 6825 | 581 | 88.5 | globlastp |
| 3001 | LYM630 | brachypodium\|12v1\|BRADI1G54360_P1 | 6825 | 581 | 88.5 | globlastp |
| 3002 | LYM630 | rice\|11v1\|AU064337_P1 | 6826 | 581 | 87.9 | globlastp |
| 3003 | LYM630 | rice\|gb170\|OS07G10530 | 6826 | 581 | 87.9 | globlastp |
| 3004 | LYM630 | sugarcane\|10v1\|BQ535880 | 6827 | 581 | 85.1 | globlastp |
| 3005 | LYM630 | foxtail_millet\|11v3\|PHY7SI035911M_P1 | 6828 | 581 | 84.6 | globlastp |
| 3006 | LYM630 | sorghum\|09v1\|SB01G004360 | 6829 | 581 | 84.4 | globlastp |
| 3007 | LYM630 | sorghum\|12v1\|SB01G004360_P1 | 6829 | 581 | 84.4 | globlastp |
| 3008 | LYM630 | switchgrass\|gb167\|FE637298 | 6830 | 581 | 84.1 | globlastp |
| 3009 | LYM630 | rice\|11v1\|AU068694_P1 | 6831 | 581 | 83.7 | globlastp |
| 3010 | LYM630 | rice\|gb170\|OS03G59240 | 6831 | 581 | 83.7 | globlastp |
| 3011 | LYM630 | wheat\|10v2\|BE399278 | 6832 | 581 | 82.3 | globlastp |
| 3012 | LYM630 | brachypodium\|09v1\|SRR031797S0002191 | 6833 | 581 | 81.8 | globlastp |
| 3013 | LYM630 | brachypodium\|12v1\|BRADI1G04720_P1 | 6833 | 581 | 81.8 | globlastp |
| 3014 | LYM630 | wheat\|10v2\|BQ788715 | 6834 | 581 | 81.3 | globlastp |
| 3015 | LYM630 | maize\|10v1\|AW066813_P1 | 6835 | 581 | 80.7 | globlastp |
| 3016 | LYM630 | barley\|10v2\|AW982668_P1 | 6836 | 581 | 80.1 | globlastp |
| 3017 | LYM631 | sorghum\|09v1\|SB03G040920 | 6837 | 582 | 96.8 | globlastp |
| 3018 | LYM631 | sorghum\|12v1\|SB03G040920_P1 | 6837 | 582 | 96.8 | globlastp |
| 3019 | LYM631 | sugarcane\|10v1\|BQ533810 | 6837 | 582 | 96.8 | globlastp |
| 3020 | LYM631 | switchgrass\|gb167\|FE637312 | 6838 | 582 | 96.8 | globlastp |
| 3021 | LYM631 | foxtail_millet\|11v3\|PHY7SI003506M_P1 | 6839 | 582 | 95.8 | globlastp |
| 3022 | LYM631 | foxtail_millet\|10v2\|FXTRMSLX00614452D2 | 6839 | 582 | 95.8 | globlastp |
| 3023 | LYM631 | millet\|10v1\|EVO454PM674974_P1 | 6840 | 582 | 94.7 | globlastp |
| 3024 | LYM631 | switchgrass\|gb167\|FE609269 | 6841 | 582 | 94.7 | globlastp |
| 3025 | LYM631 | rice\|gb170\|OS01G64680 | 6842 | 582 | 93.8 | globlastp |
| 3026 | LYM631 | rice\|11v1\|BE530946_T1 | 6843 | 582 | 93.75 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3027 | LYM631 | wheat\|10v2\|CA486181 | 6844 | 582 | 93.7 | globlastp |
| 3028 | LYM631 | brachypodium\|09v1\|GT784099 | 6845 | 582 | 91.6 | globlastp |
| 3029 | LYM631 | brachypodium\|12v1\|BRADI2G56050_P1 | 6845 | 582 | 91.6 | globlastp |
| 3030 | LYM631 | rye\|12v1\|DRR001012.138833_P1 | 6846 | 582 | 86.6 | globlastp |
| 3031 | LYM631 | oat\|10v2\|SRR020741S0119334 | 6847 | 582 | 86.6 | globlastp |
| 3032 | LYM631 | rye\|12v1\|DRR001012.131290_P1 | 6848 | 582 | 85.6 | globlastp |
| 3033 | LYM631 | rye\|12v1\|DRR001012.104073_P1 | 6849 | 582 | 85.4 | globlastp |
| 3034 | LYM631 | oat\|11v1\|SRR020741.119335_P1 | 6850 | 582 | 85.4 | globlastp |
| 3035 | LYM631 | rye\|12v1\|DRR001016.410628_P1 | 6851 | 582 | 85.3 | globlastp |
| 3036 | LYM631 | wheat\|10v2\|BQ841327 | 6852 | 582 | 83.7 | globlastp |
| 3037 | LYM631 | barley\|10v2\|BF626072_P1 | 6853 | 582 | 81.4 | globlastp |
| 3038 | LYM632 | sorghum\|09v1\|SB02G033900 | 6854 | 583 | 95 | globlastp |
| 3039 | LYM632 | sorghum\|12v1\|SB02G033900_P1 | 6854 | 583 | 95 | globlastp |
| 3040 | LYM632 | foxtail_millet\|11v3\|PHY7SI030364M_P1 | 6855 | 583 | 91.1 | globlastp |
| 3041 | LYM632 | rice\|11v1\|BE040705_P1 | 6856 | 583 | 87.4 | globlastp |
| 3042 | LYM632 | rice\|gb170\|OS07G31430 | 6856 | 583 | 87.4 | globlastp |
| 3043 | LYM632 | brachypodium\|12v1\|BRADI1G26950_P1 | 6857 | 583 | 82.5 | globlastp |
| 3044 | LYM632 | brachypodium\|09v1\|DV472875 | 6857 | 583 | 82.5 | globlastp |
| 3045 | LYM635 | sorghum\|12v1\|AW287172_T1 | — | 585 | 99.42 | glotblastn |
| 3045 | LYM745 | sorghum\|12v1\|AW287172_T1 | — | 733 | 95.63 | glotblastn |
| 3046 | LYM635 | brachypodium\|12v1\|BDPRD12V1011015_T1 | — | 585 | 97.12 | glotblastn |
| 3046 | LYM721 | brachypodium\|12v1\|BDPRD12V1011015_T1 | — | 664 | 92.57 | glotblastn |
| 3047 | LYM635 | brachypodium\|09v1\|CRPBD011704 | 6858 | 585 | 96.55 | glotblastn |
| 3048 | LYM635 | maize\|10v1\|AI621976_P1 | 6859 | 585 | 96.2 | globlastp |
| 3049 | LYM635 | sorghum\|09v1\|AW282689 | 6860 | 585 | 96 | globlastp |
| 3050 | LYM635 | maize\|10v1\|ZMCRP2V108755_P1 | 6861 | 585 | 95.8 | globlastp |
| 3051 | LYM635 | rice\|11v1\|OSCRP133177_P1 | 6862 | 585 | 95.4 | globlastp |
| 3052 | LYM635 | rice\|11v1\|OSCRP096191_P1 | 6863 | 585 | 95.2 | globlastp |
| 3053 | LYM635 | castorbean\|11v1\|SRR020784.100826_T1 | — | 585 | 94.24 | glotblastn |
| 3054 | LYM635 | poplar\|10v1\|GFXAF315314X1_T1 | 6864 | 585 | 91.76 | glotblastn |
| 3055 | LYM635 | castorbean\|09v1\|XM002519733 | 6865 | 585 | 91.17 | glotblastn |
| 3056 | LYM635 | castorbean\|09v1\|XM002519744 | 6866 | 585 | 90.4 | glotblastn |
| 3057 | LYM635 | lotus\|09v1\|GFXAP002983X34_P1 | 6867 | 585 | 90.2 | globlastp |
| 3058 | LYM635 | medicago\|09v1\|GFXNC003119X7 | 6868 | 585 | 89.6 | globlastp |
| 3059 | LYM635 | prunus\|10v1\|CN854620 | 6869 | 585 | 89.25 | glotblastn |
| 3060 | LYM635 | brachypodium\|09v1\|CRPBD026436 | 6870 | 585 | 89 | globlastp |
| 3061 | LYM635 | brachypodium\|12v1\|BDCRP12V1055702_P1 | 6870 | 585 | 89 | globlastp |
| 3062 | LYM635 | tomato\|09v1\|SRR027942S0156718 | 6871 | 585 | 87.91 | glotblastn |
| 3063 | LYM635 | coffea\|10v1\|GFXEF044213X25_P1 | 6872 | 585 | 86.9 | globlastp |
| 3064 | LYM635 | castorbean\|09v1\|CRPRC000955 | 6873 | 585 | 81.96 | glotblastn |
| 3065 | LYM639 | sorghum\|09v1\|SB05G018990 | 6874 | 588 | 84.1 | globlastp |
| 3066 | LYM639 | sorghum\|12v1\|SB05G018990_P1 | 6874 | 588 | 84.1 | globlastp |
| 3067 | LYM639 | sugarcane\|10v1\|CA118613 | 6875 | 588 | 81.5 | globlastp |
| 3068 | LYM640 | sorghum\|09v1\|SB07G029170 | 6876 | 589 | 93.7 | globlastp |
| 3069 | LYM640 | sorghum\|12v1\|SB07G029170_P1 | 6876 | 589 | 93.7 | globlastp |
| 3070 | LYM640 | foxtail_millet\|11v3\|EC613790_P1 | 6877 | 589 | 86.9 | globlastp |
| 3071 | LYM640 | rice\|11v1\|BF430574_P1 | 6878 | 589 | 85.8 | globlastp |
| 3072 | LYM640 | rice\|gb170\|OS08G37600 | 6878 | 589 | 85.8 | globlastp |
| 3073 | LYM640 | oat\|10v2\|GR324784 | 6879 | 589 | 85.7 | globlastp |
| 3074 | LYM640 | oat\|11v1\|GR324784_P1 | 6879 | 589 | 85.7 | globlastp |
| 3075 | LYM640 | brachypodium\|09v1\|DV475291 | 6880 | 589 | 84.9 | globlastp |
| 3076 | LYM640 | brachypodium\|12v1\|BRADI3G38580_P1 | 6880 | 589 | 84.9 | globlastp |
| 3077 | LYM640 | rye\|12v1\|BE587614_P1 | 6881 | 589 | 84.4 | globlastp |
| 3078 | LYM640 | wheat\|10v2\|BE398737 | 6882 | 589 | 84.2 | globlastp |
| 3079 | LYM640 | sorghum\|09v1\|SB07G029165 | 6883 | 589 | 80 | globlastp |
| 3080 | LYM640 | sorghum\|12v1\|SB07G029165_P1 | 6883 | 589 | 80 | globlastp |
| 3081 | LYM643 | maize\|10v1\|T18840_P1 | 6884 | 591 | 81.1 | globlastp |
| 3082 | LYM643 | sugarcane\|10v1\|CA124122 | 6885 | 591 | 80.6 | globlastp |
| 3083 | LYM645 | sorghum\|09v1\|SB09G025090 | 6886 | 593 | 91.8 | globlastp |
| 3084 | LYM645 | sorghum\|12v1\|SB09G025090_P1 | 6886 | 593 | 91.8 | globlastp |
| 3085 | LYM645 | rice\|11v1\|BI807977_P1 | 6887 | 593 | 80.4 | globlastp |
| 3086 | LYM645 | rice\|gb170\|OS05G43460 | 6887 | 593 | 80.4 | globlastp |
| 3087 | LYM646 | foxtail_millet\|11v3\|SOLX00022687_P1 | 6888 | 594 | 81.8 | globlastp |
| 3088 | LYM646 | maize\|10v1\|BI396341_P1 | 6889 | 594 | 81 | globlastp |
| 3089 | LYM647 | sorghum\|12v1\|SB10G026520_P1 | 6890 | 595 | 86.8 | globlastp |
| 3090 | LYM647 | foxtail_millet\|10v2\|SICRP016294 | 6891 | 595 | 84.5 | globlastp |
| 3091 | LYM647 | sorghum\|12v1\|CN139880_T1 | 6892 | 595 | 83.18 | glotblastn |
| 3092 | LYM647 | sorghum\|09v1\|SB10G026510 | 6892 | 595 | 83.18 | glotblastn |
| 3093 | LYM647 | switchgrass\|gb167\|DN147679 | 6893 | 595 | 81.4 | globlastp |
| 3094 | LYM648 | sorghum\|12v1\|SB05G017110_P1 | 6894 | 596 | 86.2 | globlastp |
| 3095 | LYM648 | sorghum\|09v1\|SB05G017110 | 6894 | 596 | 86.2 | globlastp |
| 3096 | LYM648 | foxtail_millet\|11v3\|PHY7SI026434M_P1 | 6895 | 596 | 80.1 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3097 | LYM649 | sugarcane\|10v1\|CA148427_P1 | 6896 | 597 | 82 | globlastp |
| 3098 | LYM652 | sorghum\|09v1\|SB06G017360 | 6897 | 599 | 86.7 | globlastp |
| 3099 | LYM652 | sorghum\|12v1\|SB06G017360_P1 | 6897 | 599 | 86.7 | globlastp |
| 3100 | LYM652 | maize\|10v1\|AI622174_P1 | 6898 | 599 | 83.4 | globlastp |
| 3101 | LYM652 | foxtail_millet\|11v3\|EC612877_P1 | 6899 | 599 | 83 | globlastp |
| 3102 | LYM652 | switchgrass\|gb167\|DN150296_T1 | 6900 | 599 | 82.78 | glotblastn |
| 3103 | LYM652 | millet\|10v1\|CD726751_P1 | 6901 | 599 | 82.3 | globlastp |
| 3104 | LYM653 | sugarcane\|10v1\|CA065443 | 6902 | 600 | 96.7 | globlastp |
| 3105 | LYM653 | foxtail_millet\|11v3\|PHY7SI034645M_P1 | 6903 | 600 | 94.2 | globlastp |
| 3106 | LYM653 | switchgrass\|gb167\|DN149945 | 6904 | 600 | 93.7 | globlastp |
| 3107 | LYM653 | foxtail_millet\|10v2\|SICRP027576 | 6905 | 600 | 93.6 | globlastp |
| 3108 | LYM653 | rice\|gb170\|OS10G36690 | 6906 | 600 | 87.6 | globlastp |
| 3109 | LYM653 | brachypodium\|09v1\|GT777348 | 6907 | 600 | 85.9 | globlastp |
| 3110 | LYM653 | brachypodium\|12v1\|BRADI3G30670_P1 | 6907 | 600 | 85.9 | globlastp |
| 3111 | LYM653 | barley\|10v2\|BE060545_P1 | 6908 | 600 | 82.4 | globlastp |
| 3112 | LYM653 | rye\|12v1\|DRR001012.172560_T1 | 6909 | 600 | 82.39 | glotblastn |
| 3113 | LYM654 | sugarcane\|10v1\|CA115439 | 6910 | 601 | 87.4 | globlastp |
| 3114 | LYM654 | sorghum\|09v1\|SB02G038200 | 6911 | 601 | 86.9 | globlastp |
| 3115 | LYM654 | sorghum\|12v1\|SB02G038200_P1 | 6911 | 601 | 86.9 | globlastp |
| 3116 | LYM654 | foxtail_millet\|11v3\|PHY7SI030978M_P1 | 6912 | 601 | 83.3 | globlastp |
| 3117 | LYM654 | switchgrass\|gb167\|DN145463 | 6913 | 601 | 81.7 | globlastp |
| 3118 | LYM655 | sorghum\|09v1\|SB01G038960 | 6914 | 602 | 94.5 | globlastp |
| 3119 | LYM655 | sorghum\|12v1\|SB01G038960_P1 | 6914 | 602 | 94.5 | globlastp |
| 3120 | LYM655 | foxtail_millet\|11v3\|PHY7SI033954M_T1 | 6915 | 602 | 91.54 | glotblastn |
| 3121 | LYM655 | foxtail_millet\|11v3\|SICRP058614_P1 | 6916 | 602 | 91.5 | globlastp |
| 3122 | LYM656 | sorghum\|12v1\|SB06G022540_P1 | 6917 | 603 | 88.4 | globlastp |
| 3123 | LYM656 | sorghum\|09v1\|SB06G022530 | 6918 | 603 | 87.88 | glotblastn |
| 3124 | LYM657 | sorghum\|09v1\|SB03G027120 | 6919 | 604 | 81.3 | globlastp |
| 3125 | LYM657 | sorghum\|12v1\|SB03G027120_P1 | 6919 | 604 | 81.3 | globlastp |
| 3126 | LYM657 | sugarcane\|10v1\|CA067004 | 6920 | 604 | 81.27 | glotblastn |
| 3127 | LYM658 | sorghum\|09v1\|SB04G024620 | 6921 | 605 | 95.4 | globlastp |
| 3128 | LYM658 | sorghum\|12v1\|SB04G024620_P1 | 6921 | 605 | 95.4 | globlastp |
| 3129 | LYM658 | maize\|10v1\|AI622810_P1 | 6922 | 605 | 92.8 | globlastp |
| 3130 | LYM658 | foxtail_millet\|11v3\|PHY7SI016680M_P1 | 6923 | 605 | 92.6 | globlastp |
| 3131 | LYM658 | millet\|10v1\|EVO454PM030910_P1 | 6924 | 605 | 91.7 | globlastp |
| 3132 | LYM658 | foxtail_millet\|11v3\|EC613383_P1 | 6925 | 605 | 90.2 | globlastp |
| 3133 | LYM658 | foxtail_millet\|10v2\|EC613383 | 6926 | 605 | 90 | globlastp |
| 3134 | LYM658 | foxtail_millet\|10v2\|SICRP004546 | 6927 | 605 | 88.76 | glotblastn |
| 3135 | LYM658 | rye\|12v1\|DRR001012.375564_P1 | 6928 | 605 | 88.5 | globlastp |
| 3136 | LYM658 | rice\|11v1\|AU055799_P1 | 6929 | 605 | 88.5 | globlastp |
| 3137 | LYM658 | rice\|gb170\|OS05G34820 | 6929 | 605 | 88.5 | globlastp |
| 3138 | LYM658 | brachypodium\|09v1\|GT768950 | 6930 | 605 | 88.1 | globlastp |
| 3139 | LYM658 | brachypodium\|12v1\|BRADI5G18230_P1 | 6930 | 605 | 88.1 | globlastp |
| 3140 | LYM658 | rice\|11v1\|OSPRD071902_T1 | 6931 | 605 | 86.99 | glotblastn |
| 3141 | LYM658 | brachypodium\|09v1\|GT815201 | 6932 | 605 | 86.7 | globlastp |
| 3142 | LYM658 | brachypodium\|12v1\|BRADI4G29160_P1 | 6932 | 605 | 86.7 | globlastp |
| 3143 | LYM658 | brachypodium\|12v1\|SRR031797.131015_T1 | 6933 | 605 | 86.18 | glotblastn |
| 3144 | LYM658 | oil_palm\|11v1\|SRR190698.26385_T1 | 6934 | 605 | 84.64 | glotblastn |
| 3145 | LYM658 | castorbean\|09v1\|XM002533162 | 6935 | 605 | 82.03 | glotblastn |
| 3146 | LYM658 | castorbean\|11v1\|XM_002533162_T1 | 6935 | 605 | 82.03 | glotblastn |
| 3147 | LYM658 | poplar\|10v1\|DT470271_T1 | 6936 | 605 | 81.89 | glotblastn |
| 3148 | LYM658 | pigeonpea\|11v1\|SRR054580X100449_T1 | 6937 | 605 | 81.7 | glotblastn |
| 3149 | LYM658 | cassava\|09v1\|JGICASSAVA866VALIDM1_T1 | 6938 | 605 | 81.57 | glotblastn |
| 3150 | LYM658 | cacao\|10v1\|CU539770_T1 | 6939 | 605 | 81.43 | glotblastn |
| 3151 | LYM658 | gossypium_raimondii\|12v1\|AI725465_T1 | 6940 | 605 | 81.27 | glotblastn |
| 3152 | LYM658 | cotton\|10v2\|BQ404230 | 6941 | 605 | 81.27 | glotblastn |
| 3153 | LYM658 | bean\|12v1\|SRR001334.79706_T1 | 6942 | 605 | 81.21 | glotblastn |
| 3154 | LYM658 | soybean\|11v1\|GLYMA05G31280 | 6943 | 605 | 81.21 | glotblastn |
| 3155 | LYM658 | soybean\|11v1\|GLYMA08G14500 | 6944 | 605 | 81.21 | glotblastn |
| 3156 | LYM658 | oak\|10v1\|FP054498_P1 | 6945 | 605 | 81.2 | globlastp |
| 3157 | LYM658 | cotton\|11v1\|AI725465_T1 | 6946 | 605 | 81.11 | glotblastn |
| 3158 | LYM658 | cotton\|11v1\|BE053910_T1 | 6947 | 605 | 81.11 | glotblastn |
| 3159 | LYM658 | chickpea\|11v1\|FE671239_P1 | 6948 | 605 | 81.1 | globlastp |
| 3160 | LYM658 | prunus\|10v1\|BU041739 | 6949 | 605 | 81.07 | glotblastn |
| 3161 | LYM658 | poppy\|11v1\|SRR030259.145619_T1 | 6950 | 605 | 81.05 | glotblastn |
| 3162 | LYM658 | amorphophallus\|11v2\|SRR089351X156162_P1 | 6951 | 605 | 81 | globlastp |
| 3163 | LYM658 | aristolochia\|10v1\|SRR039082S0005698_T1 | 6952 | 605 | 80.97 | glotblastn |
| 3164 | LYM658 | strawberry\|11v1\|CX661662 | 6953 | 605 | 80.94 | glotblastn |
| 3165 | LYM658 | poplar\|10v1\|CX170200_T1 | 6954 | 605 | 80.91 | glotblastn |
| 3166 | LYM658 | cassava\|09v1\|JGICASSAVA31188VALIDM1_T1 | 6955 | 605 | 80.88 | glotblastn |
| 3167 | LYM658 | solanum_phureja\|09v1\|SPHBG133286 | 6956 | 605 | 80.84 | glotblastn |
| 3168 | LYM658 | tomato\|09v1\|BG133286 | 6957 | 605 | 80.84 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3169 | LYM658 | tomato\|11v1\|BG133286_T1 | 6957 | 605 | 80.84 | glotblastn |
| 3170 | LYM658 | aquilegia\|10v2\|DR921454 | 6958 | 605 | 80.39 | glotblastn |
| 3171 | LYM658 | clementine\|11v1\|CK702125_T1 | 6959 | 605 | 80.39 | glotblastn |
| 3172 | LYM658 | euphorbia\|11v1\|BP955632XX2_T1 | 6960 | 605 | 80.36 | glotblastn |
| 3173 | LYM658 | cucumber\|09v1\|AM728627_T1 | 6961 | 605 | 80.33 | glotblastn |
| 3174 | LYM658 | watermelon\|11v1\|VMEL01756238391244_T1 | 6962 | 605 | 80 | glotblastn |
| 3175 | LYM660 | foxtail_millet\|11v3\|PHY7SI025448M_P1 | 6963 | 607 | 85.5 | globlastp |
| 3176 | LYM660 | maize\|10v1\|AI734690_P1 | 6964 | 607 | 85.4 | globlastp |
| 3177 | LYM660 | sorghum\|09v1\|SB09G021150 | 6965 | 607 | 83 | globlastp |
| 3178 | LYM660 | sorghum\|12v1\|SB09G021150_P1 | 6965 | 607 | 83 | globlastp |
| 3179 | LYM660 | rye\|12v1\|DRR001012.685021_P1 | 6966 | 607 | 80.9 | globlastp |
| 3180 | LYM660 | wheat\|10v2\|BF201764 | 6967 | 607 | 80.7 | globlastp |
| 3181 | LYM660 | rye\|12v1\|DRR001012.102693_T1 | 6968 | 607 | 80.08 | glotblastn |
| 3182 | LYM662 | maize\|10v1\|EU944134_P1 | 6969 | 609 | 86.9 | globlastp |
| 3183 | LYM662 | sorghum\|09v1\|SB08G006420 | 6970 | 609 | 81.9 | globlastp |
| 3184 | LYM662 | sorghum\|12v1\|SB08G006420_P1 | 6970 | 609 | 81.9 | globlastp |
| 3185 | LYM663 | sorghum\|12v1\|SB03G002950_P1 | 6971 | 610 | 87 | globlastp |
| 3186 | LYM663 | foxtail_millet\|11v3\|PHY7SI000132M_P1 | 6972 | 610 | 86.7 | globlastp |
| 3187 | LYM665 | sorghum\|09v1\|BE600472 | 6973 | 611 | 81.5 | globlastp |
| 3188 | LYM665 | sorghum\|12v1\|BE600472_P1 | 6973 | 611 | 81.5 | globlastp |
| 3189 | LYM665 | wheat\|10v2\|CA486824 | 6973 | 611 | 81.5 | globlastp |
| 3190 | LYM666 | sorghum\|12v1\|SB10G029540_P1 | 6974 | 612 | 80.2 | globlastp |
| 3191 | LYM666 | sorghum\|09v1\|SB10G029540 | 6974 | 612 | 80.2 | globlastp |
| 3192 | LYM667 | foxtail_millet\|11v3\|PHY7SI009269M_P1 | 6975 | 613 | 92.6 | globlastp |
| 3193 | LYM667 | rice\|11v1\|CA761879_P1 | 6976 | 613 | 85.8 | globlastp |
| 3194 | LYM667 | brachypodium\|12v1\|BRADI5G13680_P1 | 6977 | 613 | 85.2 | globlastp |
| 3195 | LYM668 | sorghum\|09v1\|SB10G006400 | 6978 | 614 | 89.5 | globlastp |
| 3196 | LYM668 | foxtail_millet\|11v3\|PHY7SI006927M_P1 | 6979 | 614 | 85.3 | globlastp |
| 3197 | LYM668 | switchgrass\|gb167\|FL743676 | 6980 | 614 | 84.3 | globlastp |
| 3198 | LYM668 | millet\|10v1\|EVO454PM070569_P1 | 6981 | 614 | 82.2 | globlastp |
| 3199 | LYM668 | foxtail_millet\|10v2\|SICRP026837 | 6982 | 614 | 80.6 | globlastp |
| 3200 | LYM670 | sorghum\|12v1\|SB12V1CRP127261_T1 | — | 616 | 99.72 | glotblastn |
| 3201 | LYM670 | sorghum\|12v1\|SB03G020184_P1 | 795 | 616 | 99.6 | globlastp |
| 3202 | LYM670 | maize\|10v1\|BI398383_T1 | 6983 | 616 | 98.89 | glotblastn |
| 3202 | LYM708 | maize\|10v1\|BI398383_T1 | 6983 | 651 | 98.61 | glotblastn |
| 3203 | LYM670 | b_rapa\|11v1\|BRA041038_T1 | 6984 | 616 | 98.24 | glotblastn |
| 3203 | LYM708 | b_rapa\|11v1\|BRA041038_T1 | 6984 | 651 | 98.33 | glotblastn |
| 3204 | LYM670 | b_rapa\|11v1\|BRARACRP076788_T1 | 6984 | 616 | 98.24 | glotblastn |
| 3204 | LYM708 | b_rapa\|11v1\|BRARACRP076788_T1 | 6984 | 651 | 98.33 | glotblastn |
| 3205 | LYM670 | foxtail_millet\|11v3\|SICRP067741_T1 | 6985 | 616 | 98.14 | glotblastn |
| 3205 | LYM708 | foxtail_millet\|11v3\|SICRP067741_T1 | 6985 | 651 | 98.23 | glotblastn |
| 3206 | LYM670 | rice\|11v1\|OSCRP167188_P1 | 6986 | 616 | 98.1 | globlastp |
| 3206 | LYM708 | rice\|11v1\|OSCRP167188_P1 | 6986 | 651 | 98.2 | globlastp |
| 3207 | LYM670 | rice\|gb170\|OSP1G00240 | 6986 | 616 | 98.1 | globlastp |
| 3207 | LYM708 | rice\|gb170\|OSP1G00240 | 6986 | 651 | 98.2 | globlastp |
| 3208 | LYM670 | rice\|11v1\|CA764315_T1 | — | 616 | 98.05 | glotblastn |
| 3208 | LYM708 | rice\|11v1\|CA764315_T1 | — | 651 | 98.14 | glotblastn |
| 3209 | LYM670 | rice\|11v1\|BI796832_P1 | 6987 | 616 | 98 | globlastp |
| 3209 | LYM708 | rice\|11v1\|BI796832_P1 | 6987 | 651 | 98.1 | globlastp |
| 3210 | LYM670 | rice\|gb170\|OS04G16820 | 6988 | 616 | 98 | globlastp |
| 3210 | LYM708 | rice\|gb170\|OS04G16820 | 6988 | 651 | 98.1 | globlastp |
| 3211 | LYM670 | brachypodium\|09v1\|CRPBD020464 | 6989 | 616 | 96.38 | glotblastn |
| 3211 | LYM708 | brachypodium\|09v1\|CRPBD020464 | 6989 | 651 | 96.47 | glotblastn |
| 3212 | LYM670 | brachypodium\|12v1\|SOLX00012727_T1 | — | 616 | 96.38 | glotblastn |
| 3212 | LYM708 | brachypodium\|12v1\|SOLX00012727_T1 | — | 651 | 96.47 | glotblastn |
| 3213 | LYM670 | brachypodium\|12v1\|SRR031797.122789_P1 | 6990 | 616 | 92.5 | globlastp |
| 3213 | LYM708 | brachypodium\|12v1\|SRR031797.122789_P1 | 6990 | 651 | 92.6 | globlastp |
| 3214 | LYM670 | rice\|11v1\|BI306246_T1 | 6991 | 616 | 91.07 | glotblastn |
| 3214 | LYM708 | rice\|11v1\|BI306246_T1 | 6991 | 651 | 91.26 | glotblastn |
| 3215 | LYM670 | brachypodium\|09v1\|CRPBD021288 | 6992 | 616 | 88.7 | globlastp |
| 3215 | LYM708 | brachypodium\|09v1\|CRPBD021288 | 6992 | 795 | 88.7 | globlastp |
| 3216 | LYM670 | maize\|10v1\|DW725983_T1 | 6993 | 616 | 85.77 | glotblastn |
| 3216 | LYM708 | maize\|10v1\|DW725983_T1 | 6993 | 651 | 85.67 | glotblastn |
| 3217 | LYM670 | aristolochia\|10v1\|GFXAF528920X1_T1 | — | 616 | 81.53 | glotblastn |
| 3217 | LYM708 | aristolochia\|10v1\|GFXAF528920X1_T1 | — | 651 | 81.63 | glotblastn |
| 3218 | LYM670 | grape\|11v1\|GSVIVT01016016001_P1 | 6994 | 616 | 81.5 | globlastp |
| 3218 | LYM708 | grape\|11v1\|GSVIVT01016016001_P1 | 6994 | 795 | 81.6 | globlastp |
| 3219 | LYM670 | grape\|11v1\|VVCRP205380_P1 | 6994 | 616 | 81.5 | globlastp |
| 3219 | LYM708 | grape\|11v1\|VVCRP205380_P1 | 6994 | 795 | 81.6 | globlastp |
| 3220 | LYM670 | grape\|11v1\|VVCRP205512_P1 | 6994 | 616 | 81.5 | globlastp |
| 3220 | LYM708 | grape\|11v1\|VVCRP205512_P1 | 6994 | 795 | 81.6 | globlastp |
| 3221 | LYM670 | grape\|11v1\|CB001417_P1 | 6994 | 616 | 81.5 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3221 | LYM708 | grape\|11v1\|CB001417_P1 | 6994 | 795 | 81.6 | globlastp |
| 3222 | LYM670 | grape\|gb160\|CA817136 | 6994 | 616 | 81.5 | globlastp |
| 3222 | LYM708 | grape\|gb160\|CA817136 | 6994 | 795 | 81.6 | globlastp |
| 3223 | LYM670 | grape\|11v1\|CB001417_T1 | — | 616 | 81.26 | glotblastn |
| 3223 | LYM708 | grape\|11v1\|CB001417_T1 | — | 795 | 81.35 | glotblastn |
| 3224 | LYM670 | eucalyptus\|11v2\|CT980503_P1 | 6995 | 616 | 81.2 | globlastp |
| 3224 | LYM708 | eucalyptus\|11v2\|CT980503_P1 | 6995 | 651 | 81.3 | globlastp |
| 3225 | LYM670 | castorbean\|11v1\|AM267450_P1 | 6996 | 616 | 80.7 | globlastp |
| 3225 | LYM708 | castorbean\|11v1\|AM267450_P1 | 6996 | 651 | 80.8 | globlastp |
| 3226 | LYM670 | castorbean\|11v1\|RCCRP021877_P1 | 6996 | 616 | 80.7 | globlastp |
| 3226 | LYM708 | castorbean\|11v1\|RCCRP021877_P1 | 6996 | 651 | 80.8 | globlastp |
| 3227 | LYM670 | castorbean\|11v1\|EE253794_T1 | — | 616 | 80.7 | glotblastn |
| 3227 | LYM708 | castorbean\|11v1\|EE253794_T1 | — | 651 | 80.79 | glotblastn |
| 3228 | LYM670 | brachypodium\|09v1\|GFXEU325680X7 | 6997 | 616 | 80.32 | glotblastn |
| 3228 | LYM708 | brachypodium\|09v1\|GFXEU325680X7 | 6997 | 651 | 80.58 | glotblastn |
| 3229 | LYM670 | rice\|gb170\|OS10G21230 | 6998 | 616 | 80.32 | glotblastn |
| 3229 | LYM708 | rice\|gb170\|OS10G21230 | 6998 | 651 | 80.58 | glotblastn |
| 3230 | LYM670 | cannabis\|12v1\|MDCRP043432_P1 | 6999 | 616 | 80.3 | globlastp |
| 3230 | LYM708 | cannabis\|12v1\|MDCRP043432_P1 | 6999 | 651 | 80.4 | globlastp |
| 3231 | LYM670 | cannabis\|12v1\|SOLX00002586_T1 | 7000 | 616 | 80.15 | glotblastn |
| 3231 | LYM708 | cannabis\|12v1\|SOLX00002586_T1 | 7000 | 651 | 80.24 | glotblastn |
| 3232 | LYM670 | amborella\|12v2\|SRR038634.9338_P1 | 7001 | 616 | 80.1 | globlastp |
| 3232 | LYM708 | amborella\|12v2\|SRR038634.9338_P1 | 7001 | 651 | 80 | globlastp |
| 3233 | LYM670 | apple\|11v1\|CN854599_P1 | 7002 | 616 | 80.1 | globlastp |
| 3233 | LYM708 | apple\|11v1\|CN854599_P1 | 7002 | 651 | 80.2 | globlastp |
| 3234 | LYM670 | amborella\|12v2\|GFXAJ506156X4_T1 | 7003 | 616 | 80.07 | glotblastn |
| 3235 | LYM671 | foxtail_millet\|11v3\|PHY7SI006289M_P1 | 7004 | 617 | 91.1 | globlastp |
| 3236 | LYM671 | maize\|10v1\|AI001225_P1 | 7005 | 617 | 80.2 | globlastp |
| 3237 | LYM672 | sorghum\|12v1\|SB03G012590_P1 | 7006 | 618 | 83.1 | globlastp |
| 3238 | LYM673 | sorghum\|09v1\|SB08G005500 | 7007 | 619 | 91.7 | globlastp |
| 3239 | LYM673 | sorghum\|12v1\|SB08G005500_P1 | 7007 | 619 | 91.7 | globlastp |
| 3240 | LYM673 | foxtail_millet\|11v3\|PHY7SI022373M_P1 | 7008 | 619 | 91.5 | globlastp |
| 3241 | LYM673 | foxtail_millet\|10v2\|SICRP013927 | 7008 | 619 | 91.5 | globlastp |
| 3242 | LYM673 | cynodon\|10v1\|ES294980_P1 | 7009 | 619 | 91 | globlastp |
| 3243 | LYM673 | switchgrass\|gb167\|DN143249 | 7010 | 619 | 91 | globlastp |
| 3244 | LYM673 | rice\|11v1\|AA751889_P1 | 7011 | 619 | 88.1 | globlastp |
| 3245 | LYM673 | rice\|gb170\|OS12G23180 | 7011 | 619 | 88.1 | globlastp |
| 3246 | LYM673 | fescue\|gb161\|DT680081_P1 | 7012 | 619 | 85.8 | globlastp |
| 3247 | LYM673 | oat\|10v2\|GR313014 | 7013 | 619 | 85 | globlastp |
| 3248 | LYM673 | oat\|11v1\|CN818621_P1 | 7013 | 619 | 85 | globlastp |
| 3249 | LYM673 | oat\|10v2\|GR317699 | 7014 | 619 | 84.92 | glotblastn |
| 3250 | LYM673 | oat\|10v2\|GR313013 | 7015 | 619 | 84.7 | globlastp |
| 3251 | LYM673 | oat\|11v1\|GR317699_P1 | 7016 | 619 | 84.7 | globlastp |
| 3252 | LYM673 | leymus\|gb166\|CD808800_P1 | 7017 | 619 | 83.9 | globlastp |
| 3253 | LYM673 | wheat\|10v2\|BE213409 | 7018 | 619 | 83.9 | globlastp |
| 3254 | LYM673 | leymus\|gb166\|EG374703_P1 | 7019 | 619 | 83.8 | globlastp |
| 3255 | LYM673 | rye\|12v1\|DRR001012.105025_P1 | 7020 | 619 | 83.6 | globlastp |
| 3256 | LYM673 | barley\|10v2\|BE420859_P1 | 7020 | 619 | 83.6 | globlastp |
| 3257 | LYM673 | pseudoroegneria\|gb167\|FF342518 | 7021 | 619 | 83.6 | globlastp |
| 3258 | LYM673 | wheat\|10v2\|BE412371 | 7020 | 619 | 83.6 | globlastp |
| 3259 | LYM673 | rye\|12v1\|DRR001012.101368_P1 | 7022 | 619 | 83.4 | globlastp |
| 3260 | LYM673 | rye\|12v1\|DRR001012.180409_P1 | 7023 | 619 | 83.4 | globlastp |
| 3261 | LYM673 | rye\|12v1\|BF146083_P1 | 7024 | 619 | 83.1 | globlastp |
| 3262 | LYM673 | rye\|12v1\|BE705085_T1 | 7025 | 619 | 83.07 | glotblastn |
| 3263 | LYM673 | rye\|12v1\|BE704974_T1 | 7026 | 619 | 82.85 | glotblastn |
| 3264 | LYM674 | cenchrus\|gb166\|EB661653_P1 | 7027 | 620 | 96.8 | globlastp |
| 3265 | LYM674 | foxtail_millet\|10v2\|OXFXTSLX00011060D1T1 | 7027 | 620 | 96.8 | globlastp |
| 3266 | LYM674 | lovegrass\|gb167\|EH186316_P1 | 7028 | 620 | 96.8 | globlastp |
| 3267 | LYM674 | maize\|10v1\|AI901386_P1 | 7027 | 620 | 96.8 | globlastp |
| 3268 | LYM674 | millet\|10v1\|EVO454PM002889_P1 | 7027 | 620 | 96.8 | globlastp |
| 3269 | LYM674 | millet\|10v1\|PMSLX0006387D1_P1 | 7027 | 620 | 96.8 | globlastp |
| 3270 | LYM674 | sorghum\|09v1\|SB10G027860 | 7027 | 620 | 96.8 | globlastp |
| 3271 | LYM674 | sorghum\|12v1\|SB10G027860_P1 | 7027 | 620 | 96.8 | globlastp |
| 3272 | LYM674 | sugarcane\|10v1\|BQ478936 | 7029 | 620 | 96.8 | globlastp |
| 3273 | LYM674 | sugarcane\|10v1\|BU103503 | 7029 | 620 | 96.8 | globlastp |
| 3274 | LYM674 | wheat\|10v2\|CA485619 | 7027 | 620 | 96.8 | globlastp |
| 3275 | LYM674 | wheat\|10v2\|CA618076 | 7030 | 620 | 96.77 | glotblastn |
| 3276 | LYM674 | cynodon\|10v1\|ES294067_P1 | 7031 | 620 | 95.2 | globlastp |
| 3277 | LYM674 | switchgrass\|gb167\|FE622613 | 7032 | 620 | 95.2 | globlastp |
| 3278 | LYM674 | rice\|11v1\|BI795125_P1 | 7033 | 620 | 93.7 | globlastp |
| 3279 | LYM674 | rice\|gb170\|OS06G47230 | 7033 | 620 | 93.7 | globlastp |
| 3280 | LYM674 | switchgrass\|gb167\|FL724429 | 7034 | 620 | 93.5 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3281 | LYM674 | fagopyrum\|11v1\|SRR063689X106965_P1 | 7035 | 620 | 91.9 | globlastp |
| 3282 | LYM674 | fagopyrum\|11v1\|SRR063703X102206_P1 | 7035 | 620 | 91.9 | globlastp |
| 3283 | LYM674 | cynodon\|10v1\|ES291885_P1 | 7036 | 620 | 91.9 | globlastp |
| 3284 | LYM674 | brachypodium\|09v1\|DV480073 | 7037 | 620 | 90.5 | globlastp |
| 3285 | LYM674 | brachypodium\|12v1\|BRADHG33240_P1 | 7037 | 620 | 90.5 | globlastp |
| 3286 | LYM674 | bupleurum\|11v1\|SRR301254.100076XX1_P1 | 7038 | 620 | 87.5 | globlastp |
| 3287 | LYM674 | bupleurum\|11v1\|SRR301254.100467_P1 | 7038 | 620 | 87.5 | globlastp |
| 3288 | LYM674 | bupleurum\|11v1\|SRR301254.10098_P1 | 7038 | 620 | 87.5 | globlastp |
| 3289 | LYM674 | bupleurum\|11v1\|SRR301254.10148_P1 | 7038 | 620 | 87.5 | globlastp |
| 3290 | LYM674 | bupleurum\|11v1\|SRR301254.102821_P1 | 7038 | 620 | 87.5 | globlastp |
| 3291 | LYM674 | bupleurum\|11v1\|SRR301254.117013_P1 | 7038 | 620 | 87.5 | globlastp |
| 3292 | LYM674 | eucalyptus\|11v2\|CT980761_P1 | 7039 | 620 | 87.5 | globlastp |
| 3293 | LYM674 | castorbean\|09v1\|EE260650 | 7040 | 620 | 87.5 | globlastp |
| 3294 | LYM674 | castorbean\|11v1\|EE260650_P1 | 7040 | 620 | 87.5 | globlastp |
| 3295 | LYM674 | eucalyptus\|11v1\|CT980761 | 7039 | 620 | 87.5 | globlastp |
| 3296 | LYM674 | bupleurum\|11v1\|SRR301254.147563_T1 | 7041 | 620 | 87.3 | glotblastn |
| 3297 | LYM674 | vinca\|11v1\|SRR098690X122147_P1 | 7042 | 620 | 87.3 | globlastp |
| 3298 | LYM674 | fraxinus\|11v1\|SRR058827.100960_T1 | — | 620 | 87.1 | glotblastn |
| 3299 | LYM674 | apple\|11v1\|CN444624_P1 | 7043 | 620 | 85.9 | globlastp |
| 3300 | LYM674 | apple\|11v1\|CN491546_P1 | 7044 | 620 | 85.9 | globlastp |
| 3301 | LYM674 | phyla\|11v2\|SRR099038X42348_P1 | 7045 | 620 | 85.9 | globlastp |
| 3302 | LYM674 | apple\|gb171\|CN444624 | 7043 | 620 | 85.9 | globlastp |
| 3303 | LYM674 | apple\|gb171\|CN491546 | 7044 | 620 | 85.9 | globlastp |
| 3304 | LYM674 | arabidopsis_lyrata\|09v1\|JGIAL001611_P1 | 7046 | 620 | 85.9 | globlastp |
| 3305 | LYM674 | arabidopsis\|10v1\|AT1G15270_P1 | 7046 | 620 | 85.9 | globlastp |
| 3306 | LYM674 | ginseng\|10v1\|GR873071_P1 | 7047 | 620 | 85.9 | globlastp |
| 3307 | LYM674 | canola\|10v1\|CN731983 | 7048 | 620 | 85.71 | glotblastn |
| 3308 | LYM674 | canola\|11v1\|CN731983_T1 | 7048 | 620 | 85.71 | glotblastn |
| 3309 | LYM674 | radish\|gb164\|FD954820 | 7049 | 620 | 85.71 | glotblastn |
| 3310 | LYM674 | vinca\|11v1\|SRR098690X184375_P1 | 7050 | 620 | 85.7 | globlastp |
| 3311 | LYM674 | eggplant\|10v1\|FS001349_P1 | 7051 | 620 | 85.7 | globlastp |
| 3312 | LYM674 | fescue\|gb161\|DT699350_P1 | 7052 | 620 | 85.7 | globlastp |
| 3313 | LYM674 | ipomoea_batatas\|10v1\|EE875248_P1 | 7053 | 620 | 85.7 | globlastp |
| 3314 | LYM674 | lolium\|10v1\|AU249250_P1 | 7052 | 620 | 85.7 | globlastp |
| 3315 | LYM674 | fraxinus\|11v1\|SRR058827.132445_T1 | 7054 | 620 | 85.48 | glotblastn |
| 3316 | LYM674 | amorphophallus\|11v2\|SRR089351X100345_P1 | 7055 | 620 | 84.4 | globlastp |
| 3317 | LYM674 | b_rapa\|11v1\|CD812699_P1 | 7056 | 620 | 84.4 | globlastp |
| 3318 | LYM674 | b_rapa\|11v1\|EL590863_P1 | 7056 | 620 | 84.4 | globlastp |
| 3319 | LYM674 | canola\|11v1\|EG019446_P1 | 7056 | 620 | 84.4 | globlastp |
| 3320 | LYM674 | canola\|11v1\|SRR019556.1930_P1 | 7056 | 620 | 84.4 | globlastp |
| 3321 | LYM674 | phyla\|11v2\|SRR099037X11804_P1 | 7057 | 620 | 84.4 | globlastp |
| 3322 | LYM674 | thellungiella_parvulum\|11v1\|BY814668_P1 | 7056 | 620 | 84.4 | globlastp |
| 3323 | LYM674 | b_juncea\|10v2\|BJ1SLX00016707D1_P1 | 7056 | 620 | 84.4 | globlastp |
| 3324 | LYM674 | b_juncea\|10v2\|BJISLX00100868D1_P1 | 7056 | 620 | 84.4 | globlastp |
| 3325 | LYM674 | b_juncea\|10v2\|BJISLX00386056D1_P1 | 7056 | 620 | 84.4 | globlastp |
| 3326 | LYM674 | b_juncea\|10v2\|BJISLX00418015D1_P1 | 7056 | 620 | 84.4 | globlastp |
| 3327 | LYM674 | b_juncea\|10v2\|E6ANDIZ01AL5MQ_P1 | 7056 | 620 | 84.4 | globlastp |
| 3328 | LYM674 | b_juncea\|10v2\|E6ANDIZ01AYWME_P1 | 7056 | 620 | 84.4 | globlastp |
| 3329 | LYM674 | b_juncea\|10v2\|E6ANDIZ01B86FS_P1 | 7058 | 620 | 84.4 | globlastp |
| 3330 | LYM674 | b_juncea\|10v2\|E6ANDIZ02IIRX5_P1 | 7056 | 620 | 84.4 | globlastp |
| 3331 | LYM674 | b_juncea\|10v2\|OXBJ1SLX00007417D1T1_P1 | 7056 | 620 | 84.4 | globlastp |
| 3332 | LYM674 | b_juncea\|10v2\|OXBJ1SLX00008884D1T1_P1 | 7056 | 620 | 84.4 | globlastp |
| 3333 | LYM674 | b_oleracea\|gb161\|AM395498_P1 | 7056 | 620 | 84.4 | globlastp |
| 3334 | LYM674 | b_rapa\|gb162\|CA991716 | 7056 | 620 | 84.4 | globlastp |
| 3335 | LYM674 | b_rapa\|11v1\|BQ704619_P1 | 7056 | 620 | 84.4 | globlastp |
| 3336 | LYM674 | b_rapa\|gb162\|CX269074 | 7056 | 620 | 84.4 | globlastp |
| 3337 | LYM674 | bruguiera\|gb166\|BP939355_P1 | 7059 | 620 | 84.4 | globlastp |
| 3338 | LYM674 | canola\|10v1\|CD813828 | 7056 | 620 | 84.4 | globlastp |
| 3339 | LYM674 | canola\|10v1\|CD814514 | 7056 | 620 | 84.4 | globlastp |
| 3340 | LYM674 | canola\|11v1\|DW998592_P1 | 7056 | 620 | 84.4 | globlastp |
| 3341 | LYM674 | canola\|10v1\|CD816847 | 7056 | 620 | 84.4 | globlastp |
| 3342 | LYM674 | canola\|10v1\|EE403709 | 7058 | 620 | 84.4 | globlastp |
| 3343 | LYM674 | coffea\|10v1\|DV667153_P1 | 7060 | 620 | 84.4 | globlastp |
| 3344 | LYM674 | grape\|11v1\|GSVIVT01017091001_P1 | 7061 | 620 | 84.4 | globlastp |
| 3345 | LYM674 | grape\|gb160\|BM436597 | 7061 | 620 | 84.4 | globlastp |
| 3346 | LYM674 | radish\|gb164\|EV537168 | 7056 | 620 | 84.4 | globlastp |
| 3347 | LYM674 | radish\|gb164\|EV566491 | 7056 | 620 | 84.4 | globlastp |
| 3348 | LYM674 | radish\|gb164\|EV572866 | 7056 | 620 | 84.4 | globlastp |
| 3349 | LYM674 | radish\|gb164\|FD968152 | 7056 | 620 | 84.4 | globlastp |
| 3350 | LYM674 | salvia\|10v1\|SRR014553S0002535 | 7062 | 620 | 84.4 | globlastp |
| 3351 | LYM674 | sesame\|10v1\|BU668569 | 7063 | 620 | 84.4 | globlastp |
| 3352 | LYM674 | strawberry\|11v1\|CO379849 | 7064 | 620 | 84.4 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3353 | LYM674 | tea\|10v1\|CV013795 | 7065 | 620 | 84.4 | globlastp |
| 3354 | LYM674 | triphysaria\|10v1\|DR171571 | 7066 | 620 | 84.4 | globlastp |
| 3355 | LYM674 | triphysaria\|10v1\|SRR023500S0007334 | 7066 | 620 | 84.4 | globlastp |
| 3356 | LYM674 | zostera\|10v1\|AM766369 | 7067 | 620 | 84.4 | globlastp |
| 3357 | LYM674 | canola\|11v1\|EG019622_P1 | 7056 | 620 | 84.4 | globlastp |
| 3358 | LYM674 | phalaenopsis\|11v1\|SRR125771.1002229XX1_T1 | 7068 | 620 | 84.38 | glotblastn |
| 3359 | LYM674 | rye\|gb164\|BE495087 | 7069 | 620 | 84.13 | glotblastn |
| 3360 | LYM674 | euphorbia\|11v1\|DV119597_P1 | 7070 | 620 | 84.1 | globlastp |
| 3361 | LYM674 | fraxinus\|11v1\|SRR058827.100992XX1_P1 | 7071 | 620 | 84.1 | globlastp |
| 3362 | LYM674 | fraxinus\|11v1\|SRR058827.105740_P1 | 7072 | 620 | 84.1 | globlastp |
| 3363 | LYM674 | fraxinus\|11v1\|SRR058827.109819_P1 | 7071 | 620 | 84.1 | globlastp |
| 3364 | LYM674 | fraxinus\|11v1\|SRR058827.112998_P1 | 7071 | 620 | 84.1 | globlastp |
| 3365 | LYM674 | fraxinus\|11v1\|SRR058827.130969_P1 | 7071 | 620 | 84.1 | globlastp |
| 3366 | LYM674 | hornbeam\|12v1\|SRR364455.101509_P1 | 7073 | 620 | 84.1 | globlastp |
| 3367 | LYM674 | oat\|11v1\|GR331754_P1 | 7074 | 620 | 84.1 | globlastp |
| 3368 | LYM674 | olea\|11v1\|GO244557XX1_P1 | 7075 | 620 | 84.1 | globlastp |
| 3369 | LYM674 | olea\|11v1\|SRR014463.10998_P1 | 7076 | 620 | 84.1 | globlastp |
| 3370 | LYM674 | plantago\|11v2\|SRR066373X102021_P1 | 7077 | 620 | 84.1 | globlastp |
| 3371 | LYM674 | primula\|11v1\|SRR098679X13011_P1 | 7078 | 620 | 84.1 | globlastp |
| 3372 | LYM674 | rye\|12v1\|BE495087_P1 | 7074 | 620 | 84.1 | globlastp |
| 3373 | LYM674 | rye\|12v1\|DRR001012.11810_P1 | 7074 | 620 | 84.1 | globlastp |
| 3374 | LYM674 | antirrhinum\|gb166\|AJ559847_P1 | 7079 | 620 | 84.1 | globlastp |
| 3375 | LYM674 | barley\|10v2\|BE413024_P1 | 7074 | 620 | 84.1 | globlastp |
| 3376 | LYM674 | foxtail_millet\|10v2\|FXTSLX00051477 | 7074 | 620 | 84.1 | globlastp |
| 3377 | LYM674 | foxtail_millet\|10v2\|FXTSLX00060886 | 7074 | 620 | 84.1 | globlastp |
| 3378 | LYM674 | oat\|10v2\|CN816415 | 7074 | 620 | 84.1 | globlastp |
| 3379 | LYM674 | oat\|11v1\|CN816415_P1 | 7074 | 620 | 84.1 | globlastp |
| 3380 | LYM674 | oat\|10v2\|CN816764 | 7074 | 620 | 84.1 | globlastp |
| 3381 | LYM674 | oat\|11v1\|CN816764_P1 | 7074 | 620 | 84.1 | globlastp |
| 3382 | LYM674 | pepper\|gb171\|BM062934_P1 | 7080 | 620 | 84.1 | globlastp |
| 3383 | LYM674 | spurge\|gb161\|DV119597 | 7070 | 620 | 84.1 | globlastp |
| 3384 | LYM674 | walnuts\|gb166\|CV195464 | 7081 | 620 | 84.1 | globlastp |
| 3385 | LYM674 | wheat\|10v2\|BE398947 | 7074 | 620 | 84.1 | globlastp |
| 3386 | LYM674 | wheat\|10v2\|BE404637 | 7074 | 620 | 84.1 | globlastp |
| 3387 | LYM674 | wheat\|10v2\|BE415811 | 7074 | 620 | 84.1 | globlastp |
| 3388 | LYM674 | wheat\|10v2\|BE429982 | 7074 | 620 | 84.1 | globlastp |
| 3389 | LYM674 | wheat\|10v2\|CA602404 | 7074 | 620 | 84.1 | globlastp |
| 3390 | LYM674 | cirsium\|11v1\|SRR346952.1008085_T1 | 7082 | 620 | 83.87 | glotblastn |
| 3391 | LYM674 | cirsium\|11v1\|SRR346952.1008892_T1 | 7083 | 620 | 83.87 | glotblastn |
| 3392 | LYM674 | fraxinus\|11v1\|SRR058827.100487_T1 | 7084 | 620 | 83.87 | glotblastn |
| 3393 | LYM674 | safflower\|gb162\|EL510084 | 7085 | 620 | 83.87 | glotblastn |
| 3394 | LYM674 | cucurbita\|11v1\|SRR091276X105643_T1 | — | 620 | 83.87 | glotblastn |
| 3395 | LYM674 | abies\|11v2\|SRR098676X103278_P1 | 7086 | 620 | 82.8 | globlastp |
| 3396 | LYM674 | amsonia\|11v1\|SRR098688X122830_P1 | 7087 | 620 | 82.8 | globlastp |
| 3397 | LYM674 | chickpea\|11v1\|DY475173_P1 | 7088 | 620 | 82.8 | globlastp |
| 3398 | LYM674 | cucurbita\|11v1\|SRR091276X101559_P1 | 7089 | 620 | 82.8 | globlastp |
| 3399 | LYM674 | distylium\|11v1\|SRR065077X107460XX1_P1 | 7090 | 620 | 82.8 | globlastp |
| 3400 | LYM674 | euonymus\|11v1\|SRR070038X102260_P1 | 7091 | 620 | 82.8 | globlastp |
| 3401 | LYM674 | euonymus\|11v1\|SRR070038X141304_P1 | 7091 | 620 | 82.8 | globlastp |
| 3402 | LYM674 | nasturtium\|11v1\|GH163719_P1 | 7092 | 620 | 82.8 | globlastp |
| 3403 | LYM674 | phyla\|11v2\|SRR099038X76130_P1 | 7093 | 620 | 82.8 | globlastp |
| 3404 | LYM674 | trigonella\|11v1\|SRR066194X100086_P1 | 7094 | 620 | 82.8 | globlastp |
| 3405 | LYM674 | valeriana\|11v1\|SRR099039X147982_P1 | 7095 | 620 | 82.8 | globlastp |
| 3406 | LYM674 | valeriana\|11v1\|SRR099040X71022_P1 | 7095 | 620 | 82.8 | globlastp |
| 3407 | LYM674 | b_juncea\|10v2\|E6ANDIZ01B0PNZ_P1 | 7096 | 620 | 82.8 | globlastp |
| 3408 | LYM674 | basilicum\|10v1\|DY322210_P1 | 7097 | 620 | 82.8 | globlastp |
| 3409 | LYM674 | basilicum\|10v1\|DY325883_P1 | 7098 | 620 | 82.8 | globlastp |
| 3410 | LYM674 | cassava\|09v1\|CK641727_P1 | 7099 | 620 | 82.8 | globlastp |
| 3411 | LYM674 | chickpea\|09v2\|DY475173 | 7088 | 620 | 82.8 | globlastp |
| 3412 | LYM674 | citrus\|gb166\|BQ623463 | 7100 | 620 | 82.8 | globlastp |
| 3413 | LYM674 | clementine\|11v1\|BQ623463_P1 | 7100 | 620 | 82.8 | globlastp |
| 3413 | LYM674 | orange\|11v1\|BQ623463_P1 | 7100 | 620 | 82.8 | globlastp |
| 3414 | LYM674 | cycas\|gb166\|EX927396_P1 | 7101 | 620 | 82.8 | globlastp |
| 3415 | LYM674 | ginger\|gb164\|DY350028_P1 | 7102 | 620 | 82.8 | globlastp |
| 3416 | LYM674 | medicago\|09v1\|AW698603 | 7094 | 620 | 82.8 | globlastp |
| 3417 | LYM674 | medicago\|12v1\|AW698603_P1 | 7094 | 620 | 82.8 | globlastp |
| 3418 | LYM674 | monkeyflower\|10v1\|GO997665_P1 | 7103 | 620 | 82.8 | globlastp |
| 3419 | LYM674 | nasturtium\|10v1\|GH163719 | 7092 | 620 | 82.8 | globlastp |
| 3420 | LYM674 | radish\|gb164\|EV528224 | 7104 | 620 | 82.8 | globlastp |
| 3421 | LYM674 | rose\|10v1\|BQ105053 | 7105 | 620 | 82.8 | globlastp |
| 3422 | LYM674 | rose\|12v1\|BQ105053_P1 | 7105 | 620 | 82.8 | globlastp |
| 3423 | LYM674 | triphysaria\|10v1\|SRR023500S0063788 | 7106 | 620 | 82.8 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3424 | LYM674 | sarracenia\|11v1\|SRR192669.100650_T1 | 7107 | 620 | 82.54 | glotblastn |
| 3425 | LYM674 | b_juncea\|10v2\|BJ1SLX00165391D1_T1 | 7108 | 620 | 82.54 | glotblastn |
| 3426 | LYM674 | oil_palm\|gb166\|CN599767 | 7109 | 620 | 82.54 | glotblastn |
| 3427 | LYM674 | bupleurum\|11v1\|SRR301254.104289XX1_T1 | — | 620 | 82.54 | glotblastn |
| 3428 | LYM674 | cephalotaxus\|11v1\|SRR064395X101889_T1 | — | 620 | 82.54 | glotblastn |
| 3429 | LYM674 | ambrosia\|11v1\|SRR346935.190011_P1 | 7110 | 620 | 82.5 | globlastp |
| 3430 | LYM674 | ambrosia\|11v1\|SRR346935.432767_P1 | 7110 | 620 | 82.5 | globlastp |
| 3431 | LYM674 | ambrosia\|11v1\|SRR346943.139663_P1 | 7110 | 620 | 82.5 | globlastp |
| 3432 | LYM674 | beech\|11v1\|SRR006293.11676_P1 | 7111 | 620 | 82.5 | globlastp |
| 3433 | LYM674 | cirsium\|11v1\|SRR346952.261183_P1 | 7112 | 620 | 82.5 | globlastp |
| 3434 | LYM674 | cirsium\|11v1\|SRR349641.110690_P1 | 7112 | 620 | 82.5 | globlastp |
| 3435 | LYM674 | cirsium\|11v1\|SRR349641.123007_P1 | 7112 | 620 | 82.5 | globlastp |
| 3436 | LYM674 | plantago\|11v2\|AJ843980_P1 | 7113 | 620 | 82.5 | globlastp |
| 3437 | LYM674 | sunflower\|12v1\|CD845926_P1 | 7114 | 620 | 82.5 | globlastp |
| 3438 | LYM674 | artemisia\|10v1\|EY037715_P1 | 7115 | 620 | 82.5 | globlastp |
| 3439 | LYM674 | artemisia\|10v1\|EY055263_P1 | 7115 | 620 | 82.5 | globlastp |
| 3440 | LYM674 | artemisia\|10v1\|SRRO19254S0009767_P1 | 7115 | 620 | 82.5 | globlastp |
| 3441 | LYM674 | artemisia\|10v1\|SRRO19254S0088250_P1 | 7115 | 620 | 82.5 | globlastp |
| 3442 | LYM674 | artemisia\|10v1\|SRRO19550S0004626_P1 | 7115 | 620 | 82.5 | globlastp |
| 3443 | LYM674 | beech\|11v1\|SRR006293.11312_P1 | 7111 | 620 | 82.5 | globlastp |
| 3444 | LYM674 | beech\|gb170\|SRR006293S0003713 | 7111 | 620 | 82.5 | globlastp |
| 3445 | LYM674 | centaurea\|gb166\|EH739812_P1 | 7112 | 620 | 82.5 | globlastp |
| 3446 | LYM674 | cichorium\|gb171\|DT212035_P1 | 7114 | 620 | 82.5 | globlastp |
| 3447 | LYM674 | cynara\|gb167\|GE595140_P1 | 7112 | 620 | 82.5 | globlastp |
| 3448 | LYM674 | gerbera\|09v1\|AJ750498_P1 | 7110 | 620 | 82.5 | globlastp |
| 3449 | LYM674 | gerbera\|09v1\|AJ750942_P1 | 7110 | 620 | 82.5 | globlastp |
| 3450 | LYM674 | lolium\|10v1\|SRR029311S0016269_P1 | 7116 | 620 | 82.5 | globlastp |
| 3451 | LYM674 | petunia\|gb171\|CV296824_P1 | 7117 | 620 | 82.5 | globlastp |
| 3452 | LYM674 | potato\|10v1\|BG592556_P1 | 7118 | 620 | 82.5 | globlastp |
| 3453 | LYM674 | potato\|10v1\|BI406653_P1 | 7118 | 620 | 82.5 | globlastp |
| 3454 | LYM674 | safflower\|gb162\|EL372981 | 7110 | 620 | 82.5 | globlastp |
| 3455 | LYM674 | solanum_phureja\|09v1\|SPHBG124390 | 7118 | 620 | 82.5 | globlastp |
| 3456 | LYM674 | sunflower\|10v1\|DY955654 | 7114 | 620 | 82.5 | globlastp |
| 3457 | LYM674 | tomato\|09v1\|BG124390 | 7119 | 620 | 82.5 | globlastp |
| 3458 | LYM674 | tomato\|11v1\|BG124390_P1 | 7119 | 620 | 82.5 | globlastp |
| 3459 | LYM674 | tragopogon\|10v1\|SRR020205S0037348 | 7120 | 620 | 82.5 | globlastp |
| 3460 | LYM674 | tragopogon\|10v1\|SRR020205S0060119 | 7114 | 620 | 82.5 | globlastp |
| 3461 | LYM674 | triphysaria\|10v1\|EX982507 | 7121 | 620 | 82.5 | globlastp |
| 3462 | LYM674 | walnuts\|gb166\|EL893725 | 7122 | 620 | 82.5 | globlastp |
| 3463 | LYM674 | arnica\|11v1\|SRR099034X549516_T1 | — | 620 | 82.26 | glotblastn |
| 3464 | LYM674 | epimedium\|11v1\|SRR013506.42109_T1 | — | 620 | 81.25 | glotblastn |
| 3465 | LYM674 | cannabis\|12v1\|EW701093_P1 | 7123 | 620 | 81.2 | globlastp |
| 3466 | LYM674 | chelidonium\|11v1\|SRR084752X10734_P1 | 7124 | 620 | 81.2 | globlastp |
| 3467 | LYM674 | chickpea\|11v1\|GR391874_P1 | 7125 | 620 | 81.2 | globlastp |
| 3468 | LYM674 | humulus\|11v1\|ES654110_P1 | 7126 | 620 | 81.2 | globlastp |
| 3469 | LYM674 | oil_palm\|11v1\|EL681728_P1 | 7127 | 620 | 81.2 | globlastp |
| 3470 | LYM674 | platanus\|11v1\|SRR096786X118170_P1 | 7128 | 620 | 81.2 | globlastp |
| 3471 | LYM674 | poppy\|11v1\|SRR030259.105139_P1 | 7129 | 620 | 81.2 | globlastp |
| 3472 | LYM674 | sarracenia\|11v1\|SRR192669.100480_P1 | 7130 | 620 | 81.2 | globlastp |
| 3473 | LYM674 | sarracenia\|11v1\|SRR192669.127001_P1 | 7131 | 620 | 81.2 | globlastp |
| 3474 | LYM674 | sarracenia\|11v1\|SRR192669.140494_P1 | 7130 | 620 | 81.2 | globlastp |
| 3475 | LYM674 | spruce\|11v1\|ES245011_P1 | 7132 | 620 | 81.2 | globlastp |
| 3476 | LYM674 | spruce\|11v1\|ES662265_P1 | 7132 | 620 | 81.2 | globlastp |
| 3477 | LYM674 | spruce\|11v1\|ES861458_P1 | 7132 | 620 | 81.2 | globlastp |
| 3478 | LYM674 | spruce\|11v1\|EX308248_P1 | 7132 | 620 | 81.2 | globlastp |
| 3479 | LYM674 | spruce\|11v1\|EX347962_P1 | 7132 | 620 | 81.2 | globlastp |
| 3480 | LYM674 | spruce\|11v1\|SRR064180X104566_P1 | 7133 | 620 | 81.2 | globlastp |
| 3481 | LYM674 | thellungiella_halophilum\|11v1\|BY814668_P1 | 7134 | 620 | 81.2 | globlastp |
| 3482 | LYM674 | tripterygium\|11v1\|SRR098677X101722_P1 | 7135 | 620 | 81.2 | globlastp |
| 3483 | LYM674 | utricularia\|11v1\|SRR094438.147614_P1 | 7136 | 620 | 81.2 | globlastp |
| 3484 | LYM674 | b_juncea\|10v2\|E6ANDIZ01BP8EC_P1 | 7137 | 620 | 81.2 | globlastp |
| 3485 | LYM674 | b_juncea\|10v2\|OXBJ1SLX00000479D1T1_P1 | 7134 | 620 | 81.2 | globlastp |
| 3486 | LYM674 | b_oleracea\|gb161\|DY027289_P1 | 7134 | 620 | 81.2 | globlastp |
| 3487 | LYM674 | banana\|10v1\|DN239342_P1 | 7138 | 620 | 81.2 | globlastp |
| 3488 | LYM674 | bean\|gb167\|CB542614 | 7139 | 620 | 81.2 | globlastp |
| 3489 | LYM674 | bean\|gb167\|FD784717 | 7140 | 620 | 81.2 | globlastp |
| 3490 | LYM674 | canola\|10v1\|CD812699 | 7134 | 620 | 81.2 | globlastp |
| 3491 | LYM674 | canola\|11v1\|DY006098_P1 | 7134 | 620 | 81.2 | globlastp |
| 3492 | LYM674 | cowpea\|gb166\|FC456845_P1 | 7141 | 620 | 81.2 | globlastp |
| 3493 | LYM674 | cryptomeria\|gb166\|BP174151_P1 | 7142 | 620 | 81.2 | globlastp |
| 3494 | LYM674 | gnetum\|10v1\|SRR064399S0012509_P1 | 7143 | 620 | 81.2 | globlastp |
| 3495 | LYM674 | heritiera\|10v1\|SRR005795S0009522_P1 | 7144 | 620 | 81.2 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3496 | LYM674 | liquorice\|gb171\|FS240048_P1 | 7145 | 620 | 81.2 | globlastp |
| 3497 | LYM674 | liquorice\|gb171\|FS269845_P1 | 7145 | 620 | 81.2 | globlastp |
| 3498 | LYM674 | peanut\|10v1\|CD037541_P1 | 7141 | 620 | 81.2 | globlastp |
| 3499 | LYM674 | pea\|11v1\|GH720947_P1 | 7146 | 620 | 81.2 | globlastp |
| 3500 | LYM674 | pigeonpea\|10v1\|GW346281 | 7145 | 620 | 81.2 | globlastp |
| 3501 | LYM674 | pigeonpea\|11v1\|EE604871_P1 | 7145 | 620 | 81.2 | globlastp |
| 3502 | LYM674 | podocarpus\|10v1\|SRR065014S0043830_P1 | 7147 | 620 | 81.2 | globlastp |
| 3503 | LYM674 | poplar\|10v1\|AI163654_P1 | 7148 | 620 | 81.2 | globlastp |
| 3504 | LYM674 | sciadopitys\|10v1\|SRR065035S0001739 | 7149 | 620 | 81.2 | globlastp |
| 3505 | LYM674 | soybean\|11v1\|GLYMA07G00760 | 7150 | 620 | 81.2 | globlastp |
| 3506 | LYM674 | soybean\|11v1\|GLYMA08G22020 | 7141 | 620 | 81.2 | globlastp |
| 3507 | LYM674 | spruce\|11v1\|GT885557_P1 | 7133 | 620 | 81.2 | globlastp |
| 3508 | LYM674 | spruce\|gb162\|CO215989 | 7132 | 620 | 81.2 | globlastp |
| 3509 | LYM674 | tamarix\|gb166\|CF200182 | 7151 | 620 | 81.2 | globlastp |
| 3510 | LYM674 | thellungiella\|gb167\|BY814668 | 7134 | 620 | 81.2 | globlastp |
| 3511 | LYM674 | bean\|12v1\|CA899342_P1 | 7139 | 620 | 81.2 | globlastp |
| 3512 | LYM674 | catharanthus\|11v1\|EG557229_P1 | 7152 | 620 | 81 | globlastp |
| 3513 | LYM674 | euphorbia\|11v1\|BP959954_P1 | 7153 | 620 | 81 | globlastp |
| 3514 | LYM674 | flaveria\|11v1\|SRR149229.103149_P1 | 7154 | 620 | 81 | globlastp |
| 3515 | LYM674 | flaveria\|11v1\|SRR149229.141868_P1 | 7154 | 620 | 81 | globlastp |
| 3516 | LYM674 | flaveria\|11v1\|SRR149241.71553_P1 | 7155 | 620 | 81 | globlastp |
| 3517 | LYM674 | flax\|11v1\|EU828871_P1 | 7156 | 620 | 81 | globlastp |
| 3518 | LYM674 | flax\|11v1\|JG023940_P1 | 7156 | 620 | 81 | globlastp |
| 3519 | LYM674 | olea\|11v1\|SRR014463.10408_P1 | 7157 | 620 | 81 | globlastp |
| 3520 | LYM674 | sunflower\|12v1\|CX944167_P1 | 7154 | 620 | 81 | globlastp |
| 3521 | LYM674 | sunflower\|12v1\|DY954421_P1 | 7154 | 620 | 81 | globlastp |
| 3522 | LYM674 | catharanthus\|gb166\|EG557229 | 7152 | 620 | 81 | globlastp |
| 3523 | LYM674 | cleome_spinosa\|10v1\|SRR015531S0048063_P1 | 7158 | 620 | 81 | globlastp |
| 3524 | LYM674 | dandelion\|10v1\|DR402597_P1 | 7159 | 620 | 81 | globlastp |
| 3525 | LYM674 | dandelion\|10v1\|DY839578_P1 | 7159 | 620 | 81 | globlastp |
| 3526 | LYM674 | flax\|09v1\|EU828871 | 7156 | 620 | 81 | globlastp |
| 3527 | LYM674 | flax\|11v1\|JG018793_P1 | 7156 | 620 | 81 | globlastp |
| 3528 | LYM674 | lettuce\|10v1\|DW045542_P1 | 7159 | 620 | 81 | globlastp |
| 3529 | LYM674 | lettuce\|10v1\|DW049157_P1 | 7159 | 620 | 81 | globlastp |
| 3530 | LYM674 | lettuce\|10v1\|DW081949_P1 | 7159 | 620 | 81 | globlastp |
| 3531 | LYM674 | lettuce\|10v1\|DW105339_P1 | 7159 | 620 | 81 | globlastp |
| 3532 | LYM674 | oak\|10v1\|CU657033_P1 | 7160 | 620 | 81 | globlastp |
| 3533 | LYM674 | orobanche\|10v1\|SRR023495S0003009_P1 | 7161 | 620 | 81 | globlastp |
| 3534 | LYM674 | sunflower\|10v1\|CX944167 | 7154 | 620 | 81 | globlastp |
| 3535 | LYM674 | sunflower\|12v1\|DY927773_P1 | 7154 | 620 | 81 | globlastp |
| 3536 | LYM674 | tamarix\|gb166\|EG967706 | 7162 | 620 | 81 | globlastp |
| 3537 | LYM674 | tobacco\|gb162\|CV016496 | 7161 | 620 | 81 | globlastp |
| 3538 | LYM674 | amborella\|12v2\|SRR038634.18378_T1 | 7163 | 620 | 80.95 | glotblastn |
| 3539 | LYM674 | cedrus\|11v1\|SRR065007X104650_T1 | 7164 | 620 | 80.95 | glotblastn |
| 3540 | LYM674 | cucurbita\|11v1\|SRR091276X103882_T1 | 7165 | 620 | 80.95 | glotblastn |
| 3541 | LYM674 | cucurbita\|11v1\|SRR091276X113394_T1 | 7165 | 620 | 80.95 | glotblastn |
| 3542 | LYM674 | cucurbita\|11v1\|SRR091276X134114_T1 | 7165 | 620 | 80.95 | glotblastn |
| 3543 | LYM674 | cucurbita\|11v1\|SRR091276X278302_T1 | 7165 | 620 | 80.95 | glotblastn |
| 3544 | LYM674 | euonymus\|11v1\|SRR070038X121832_T1 | 7166 | 620 | 80.95 | glotblastn |
| 3545 | LYM674 | euonymus\|11v1\|SRR070038X177346_T1 | 7166 | 620 | 80.95 | glotblastn |
| 3546 | LYM674 | gossypium_raimondii\|12v1\|AW187456_T1 | 7167 | 620 | 80.95 | glotblastn |
| 3547 | LYM674 | maritime_pine\|10v1\|AL751079_T1 | 7168 | 620 | 80.95 | glotblastn |
| 3548 | LYM674 | maritime_pine\|10v1\|BX249285_T1 | 7169 | 620 | 80.95 | glotblastn |
| 3549 | LYM674 | phyla\|11v2\|SRR099035X175078_T1 | 7170 | 620 | 80.95 | glotblastn |
| 3550 | LYM674 | sarracenia\|11v1\|SRR192669.117747_T1 | 7171 | 620 | 80.95 | glotblastn |
| 3551 | LYM674 | scabiosa\|11v1\|SRR063723X101722_T1 | 7172 | 620 | 80.95 | glotblastn |
| 3552 | LYM674 | spruce\|11v1\|EX337565_T1 | 7173 | 620 | 80.95 | glotblastn |
| 3553 | LYM674 | thalictrum\|11v1\|SRR096787X100350_T1 | 7174 | 620 | 80.95 | glotblastn |
| 3554 | LYM674 | banana\|10v1\|DN239162_T1 | 7175 | 620 | 80.95 | glotblastn |
| 3555 | LYM674 | banana\|10v1\|FL657761_T1 | 7176 | 620 | 80.95 | glotblastn |
| 3556 | LYM674 | cotton\|10v2\|BF274781 | 7167 | 620 | 80.95 | glotblastn |
| 3557 | LYM674 | hevea\|10v1\|CB376964_T1 | 7177 | 620 | 80.95 | glotblastn |
| 3558 | LYM674 | iceplant\|gb164\|BE035656_T1 | 7178 | 620 | 80.95 | glotblastn |
| 3559 | LYM674 | jatropha\|09v1\|GO247022_T1 | 7179 | 620 | 80.95 | glotblastn |
| 3560 | LYM674 | liriodendron\|gb166\|CK745299_T1 | 7180 | 620 | 80.95 | glotblastn |
| 3561 | LYM674 | lotus\|09v1\|LLBW595688_T1 | 7181 | 620 | 80.95 | glotblastn |
| 3562 | LYM674 | monkeyflower\|10v1\|DV209526_T1 | 7182 | 620 | 80.95 | glotblastn |
| 3563 | LYM674 | orobanche\|10v1\|SRR023189S0005134_T1 | 7183 | 620 | 80.95 | glotblastn |
| 3564 | LYM674 | pineapple\|10v1\|CO731246_T1 | 7184 | 620 | 80.95 | glotblastn |
| 3565 | LYM674 | pine\|10v2\|AA739523_T1 | 7185 | 620 | 80.95 | glotblastn |
| 3566 | LYM674 | pine\|10v2\|AL751079_T1 | 7168 | 620 | 80.95 | glotblastn |
| 3567 | LYM674 | pine\|10v2\|AW056549_T1 | 7168 | 620 | 80.95 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3568 | LYM674 | prunus\|10v1\|BU042914 | 7186 | 620 | 80.95 | glotblastn |
| 3569 | LYM674 | pseudotsuga\|10v1\|SRR065119S0000572 | 7187 | 620 | 80.95 | glotblastn |
| 3570 | LYM674 | salvia\|10v1\|SRR014553S0005217 | 7188 | 620 | 80.95 | glotblastn |
| 3571 | LYM674 | wheat\|10v2\|DR737521 | 7189 | 620 | 80.95 | glotblastn |
| 3572 | LYM674 | rose\|12v1\|SRR397984.107520_T1 | — | 620 | 80.95 | glotblastn |
| 3573 | LYM674 | spruce\|11v1\|SRR065813X262115XX1_T1 | — | 620 | 80.95 | glotblastn |
| 3574 | LYM674 | ceratodon\|10v1\|SRR074893S0834293_T1 | — | 620 | 80.95 | glotblastn |
| 3575 | LYM674 | sequoia\|10v1\|SRR065044S0003578 | — | 620 | 80.95 | glotblastn |
| 3576 | LYM674 | flax\|11v1\|JG038241_T1 | 7190 | 620 | 80.65 | glotblastn |
| 3577 | LYM674 | flax\|11v1\|JG089040_T1 | 7191 | 620 | 80.65 | glotblastn |
| 3578 | LYM674 | chestnut\|gb170\|SRR006295S0002353_T1 | 7192 | 620 | 80.65 | glotblastn |
| 3579 | LYM674 | cichorium\|gb171\|FL679916_T1 | 7193 | 620 | 80.65 | glotblastn |
| 3580 | LYM674 | cleome_gynandra\|10v1\|SRR015532S0003740_T1 | 7194 | 620 | 80.65 | glotblastn |
| 3581 | LYM674 | sarracenia\|11v1\|SRR192669.353196_T1 | — | 620 | 80.65 | glotblastn |
| 3582 | LYM674 | orobanche\|11v1\|SRR023189S0000941_P1 | 7195 | 620 | 80 | globlastp |
| 3583 | LYM674 | physcomitrella\|10v1\|AW477225_P1 | 7196 | 620 | 80 | globlastp |
| 3584 | LYM675 | sugarcane\|10v1\|CA070384 | 7197 | 621 | 88.2 | globlastp |
| 3585 | LYM675 | sorghum\|09v1\|SB07G025450 | 7198 | 621 | 87.8 | globlastp |
| 3586 | LYM675 | sorghum\|12v1\|SB07G025450_P1 | 7198 | 621 | 87.8 | globlastp |
| 3587 | LYM675 | maize\|10v1\|AI737083_P1 | 7199 | 621 | 86.6 | globlastp |
| 3588 | LYM675 | foxtail_millet\|11v3\|EC612552_P1 | 7200 | 621 | 85.1 | globlastp |
| 3589 | LYM675 | foxtail_millet\|10v2\|SICRP008086 | 7200 | 621 | 85.1 | globlastp |
| 3590 | LYM675 | millet\|10v1\|EVO454PM039897_P1 | 7201 | 621 | 82.1 | globlastp |
| 3591 | LYM677 | sorghum\|09v1\|SB06G032040 | 7202 | 622 | 99.5 | globlastp |
| 3592 | LYM677 | sorghum\|12v1\|SB06G032040_P1 | 7202 | 622 | 99.5 | globlastp |
| 3593 | LYM677 | sugarcane\|10v1\|CA077520 | 7202 | 622 | 99.5 | globlastp |
| 3594 | LYM677 | maize\|10v1\|T14783_P1 | 7203 | 622 | 98.4 | globlastp |
| 3595 | LYM677 | foxtail_millet\|10v2\|SICRP016599 | 7204 | 622 | 97.3 | globlastp |
| 3596 | LYM677 | switchgrass\|gb167\|FE618307 | 7205 | 622 | 95.7 | globlastp |
| 3597 | LYM677 | rice\|11v1\|AU030396_P1 | 7206 | 622 | 95.2 | globlastp |
| 3598 | LYM677 | rice\|gb170\|OS03G28389 | 7206 | 622 | 95.2 | globlastp |
| 3599 | LYM677 | rice\|11v1\|AA751807_P1 | 7206 | 622 | 95.2 | globlastp |
| 3600 | LYM677 | rice\|gb170\|OS07G44790 | 7206 | 622 | 95.2 | globlastp |
| 3601 | LYM677 | brachypodium\|09v1\|DV469647 | 7207 | 622 | 94.12 | glotblastn |
| 3602 | LYM677 | brachypodium\|12v1\|BRADHG19830_P1 | 7208 | 622 | 94.1 | globlastp |
| 3603 | LYM677 | oat\|11v1\|CN819457_P1 | 7209 | 622 | 94.1 | globlastp |
| 3604 | LYM677 | rye\|12v1\|BE494707_P1 | 7210 | 622 | 93.6 | globlastp |
| 3605 | LYM677 | barley\|10v2\|BG299682_P1 | 7210 | 622 | 93.6 | globlastp |
| 3606 | LYM677 | wheat\|10v2\|BM135008 | 7211 | 622 | 92.5 | globlastp |
| 3607 | LYM677 | pseudoroegneria\|gb167\|FF360551 | 7212 | 622 | 91.9 | globlastp |
| 3608 | LYM677 | coffea\|10v1\|DV663567_P1 | 7213 | 622 | 90.9 | globlastp |
| 3609 | LYM677 | catharanthus\|11v1\|EG557262_P1 | 7214 | 622 | 89.8 | globlastp |
| 3610 | LYM677 | tabernaemontana\|11v1\|SRR098689X208821_P1 | 7215 | 622 | 89.8 | globlastp |
| 3611 | LYM677 | catharanthus\|gb166\|EG557262 | 7214 | 622 | 89.8 | globlastp |
| 3612 | LYM677 | oat\|11v1\|CN820916_P1 | 7216 | 622 | 89.2 | globlastp |
| 3613 | LYM677 | oil_palm\|11v1\|SRR190698.109247_P1 | 7217 | 622 | 88.7 | globlastp |
| 3614 | LYM677 | antirrhinum\|gb166\|AJ558624_P1 | 7218 | 622 | 88.7 | globlastp |
| 3615 | LYM677 | nuphar\|gb166\|ES731316_P1 | 7219 | 622 | 88.6 | globlastp |
| 3616 | LYM677 | oat\|10v2\|CN820916 | 7220 | 622 | 88.6 | globlastp |
| 3617 | LYM677 | olea\|11v1\|SRR014463.24625_P1 | 7221 | 622 | 88.2 | globlastp |
| 3618 | LYM677 | poppy\|11v1\|SRR030259.138488_P1 | 7222 | 622 | 88.2 | globlastp |
| 3619 | LYM677 | aquilegia\|10v2\|DT747028 | 7223 | 622 | 88.2 | globlastp |
| 3620 | LYM677 | aristolochia\|10v1\|SRR039082S0056492_P1 | 7224 | 622 | 88.2 | globlastp |
| 3621 | LYM677 | banana\|10v1\|DT723846_P1 | 7225 | 622 | 88.2 | globlastp |
| 3622 | LYM677 | orobanche\|10v1\|SRR023189S0011635_P1 | 7226 | 622 | 88.2 | globlastp |
| 3623 | LYM677 | rye\|gb164\|BE494707 | 7227 | 622 | 88.2 | globlastp |
| 3624 | LYM677 | vinca\|11v1\|SRR098690X154197_P1 | 7228 | 622 | 87.8 | globlastp |
| 3625 | LYM677 | chelidonium\|11v1\|SRR084752X100611_P1 | 7229 | 622 | 87.6 | globlastp |
| 3626 | LYM677 | gossypium_raimondii\|12v1\|AI725571_P1 | 7230 | 622 | 87.6 | globlastp |
| 3627 | LYM677 | humulus\|11v1\|EX516220_P1 | 7231 | 622 | 87.6 | globlastp |
| 3628 | LYM677 | watermelon\|11v1\|AM720076_P1 | 7232 | 622 | 87.6 | globlastp |
| 3629 | LYM677 | cacao\|10v1\|CU493627_P1 | 7233 | 622 | 87.6 | globlastp |
| 3630 | LYM677 | cotton\|10v2\|DR456565 | 7230 | 622 | 87.6 | globlastp |
| 3631 | LYM677 | cotton\|11v1\|AI725571_P1 | 7230 | 622 | 87.6 | globlastp |
| 3632 | LYM677 | ginger\|gb164\|DY360037_P1 | 7234 | 622 | 87.6 | globlastp |
| 3633 | LYM677 | grape\|11v1\|GSVIVT01002004001_P1 | 7235 | 622 | 87.6 | globlastp |
| 3634 | LYM677 | grape\|gb160\|BQ797758 | 7235 | 622 | 87.6 | globlastp |
| 3635 | LYM677 | euphorbia\|11v1\|DV127349_P1 | 7236 | 622 | 87.2 | globlastp |
| 3636 | LYM677 | cirsium\|11v1\|SRR346952.1037943_P1 | 7237 | 622 | 87.1 | globlastp |
| 3637 | LYM677 | oil_palm\|11v1\|SRR190698.178734_P1 | 7238 | 622 | 87.1 | globlastp |
| 3638 | LYM677 | phyla\|11v2\|SRR099037X115792_P1 | 7239 | 622 | 87.1 | globlastp |
| 3639 | LYM677 | platanus\|11v1\|SRR096786X101972_P1 | 7240 | 622 | 87.1 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3640 | LYM677 | avocado\|10v1\|CK756098_P1 | 7241 | 622 | 87.1 | globlastp |
| 3641 | LYM677 | melon\|10v1\|AM720076_P1 | 7242 | 622 | 87.1 | globlastp |
| 3642 | LYM677 | oak\|10v1\|DB999164_P1 | 7243 | 622 | 87.1 | globlastp |
| 3643 | LYM677 | poplar\|10v1\|AI164377_P1 | 7244 | 622 | 87.1 | globlastp |
| 3644 | LYM677 | spurge\|gb161\|DV127349 | 7245 | 622 | 87.1 | globlastp |
| 3645 | LYM677 | bupleurum\|11v1\|SRR301254.171937_P1 | 7246 | 622 | 86.6 | globlastp |
| 3646 | LYM677 | cirsium\|11v1\|SRR346952.1029416_P1 | 7247 | 622 | 86.6 | globlastp |
| 3647 | LYM677 | cucurbita\|11v1\|FG227637XX1_P1 | 7248 | 622 | 86.6 | globlastp |
| 3648 | LYM677 | flaveria\|11v1\|SRR149229.120871_P1 | 7249 | 622 | 86.6 | globlastp |
| 3649 | LYM677 | flaveria\|11v1\|SRR149229.257301_P1 | 7250 | 622 | 86.6 | globlastp |
| 3650 | LYM677 | flaveria\|11v1\|SRR149241.26086_P1 | 7251 | 622 | 86.6 | globlastp |
| 3651 | LYM677 | phalaenopsis\|11v1\|SRR125771.1013792_P1 | 7252 | 622 | 86.6 | globlastp |
| 3652 | LYM677 | poppy\|11v1\|FE966644_P1 | 7253 | 622 | 86.6 | globlastp |
| 3653 | LYM677 | poppy\|11v1\|SRR030259.12973_P1 | 7253 | 622 | 86.6 | globlastp |
| 3654 | LYM677 | silene\|11v1\|SRR096785X10886_P1 | 7254 | 622 | 86.6 | globlastp |
| 3655 | LYM677 | centaurea\|gb166\|EH715632_P1 | 7255 | 622 | 86.6 | globlastp |
| 3656 | LYM677 | chestnut\|gb170\|SRR006295S0025391_P1 | 7256 | 622 | 86.6 | globlastp |
| 3657 | LYM677 | poppy\|gb166\|FE966644 | 7253 | 622 | 86.6 | globlastp |
| 3658 | LYM677 | strawberry\|11v1\|CO380775 | 7257 | 622 | 86.6 | globlastp |
| 3659 | LYM677 | triphysaria\|10v1\|EY129481 | 7258 | 622 | 86.6 | globlastp |
| 3660 | LYM677 | rose\|12v1\|BQ105782_P1 | 7257 | 622 | 86.6 | globlastp |
| 3661 | LYM677 | momordica\|10v1\|SRR071315S0003440_T1 | 7259 | 622 | 86.56 | glotblastn |
| 3662 | LYM677 | eschscholzia\|11v1\|SRR014116.137043_P1 | 7260 | 622 | 86.5 | globlastp |
| 3663 | LYM677 | triphysaria\|10v1\|EY006476 | 7261 | 622 | 86.1 | globlastp |
| 3664 | LYM677 | apple\|11v1\|CN876233_P1 | 7262 | 622 | 86 | globlastp |
| 3665 | LYM677 | arnica\|11v1\|SRR099034X136477_P1 | 7263 | 622 | 86 | globlastp |
| 3666 | LYM677 | euonymus\|11v1\|SRR070038X166437_P1 | 7264 | 622 | 86 | globlastp |
| 3667 | LYM677 | euphorbia\|11v1\|BP956101_P1 | 7265 | 622 | 86 | globlastp |
| 3668 | LYM677 | flaveria\|11v1\|SRR149244.104981_P1 | 7266 | 622 | 86 | globlastp |
| 3669 | LYM677 | phyla\|11v2\|SRR099035X111531_P1 | 7267 | 622 | 86 | globlastp |
| 3670 | LYM677 | sarracenia\|11v1\|SRR192669.110514_P1 | 7268 | 622 | 86 | globlastp |
| 3671 | LYM677 | sunflower\|12v1\|DY952649_P1 | 7269 | 622 | 86 | globlastp |
| 3672 | LYM677 | acacia\|10v1\|FS584802_P1 | 7270 | 622 | 86 | globlastp |
| 3673 | LYM677 | apple\|gb171\|CN876233 | 7262 | 622 | 86 | globlastp |
| 3674 | LYM677 | castorbean\|09v1\|EE255402 | 7271 | 622 | 86 | globlastp |
| 3675 | LYM677 | castorbean\|11v1\|EE255402_P1 | 7271 | 622 | 86 | globlastp |
| 3676 | LYM677 | centaurea\|gb166\|EH779021_P1 | 7272 | 622 | 86 | globlastp |
| 3677 | LYM677 | monkeyflower\|10v1\|DV208150_P1 | 7273 | 622 | 86 | globlastp |
| 3678 | LYM677 | petunia\|gb171\|CV295259_P1 | 7274 | 622 | 86 | globlastp |
| 3679 | LYM677 | prunus\|10v1\|BU044840 | 7275 | 622 | 86 | globlastp |
| 3680 | LYM677 | rose\|10v1\|BQ105782 | 7276 | 622 | 86 | globlastp |
| 3681 | LYM677 | salvia\|10v1\|CV163987 | 7277 | 622 | 86 | globlastp |
| 3682 | LYM677 | sunflower\|12v1\|CD848737_P1 | 7269 | 622 | 86 | globlastp |
| 3683 | LYM677 | heritiera\|10v1\|SRR005795S0009606_T1 | 7278 | 622 | 85.95 | glotblastn |
| 3684 | LYM677 | beech\|11v1\|SRR006294.11031_P1 | 7279 | 622 | 85.5 | globlastp |
| 3685 | LYM677 | cucurbita\|11v1\|SRR091276X112632_P1 | 7280 | 622 | 85.5 | globlastp |
| 3686 | LYM677 | euonymus\|11v1\|SRR070038X145995_P1 | 7281 | 622 | 85.5 | globlastp |
| 3687 | LYM677 | sarracenia\|11v1\|SRR192669.105920_P1 | 7282 | 622 | 85.5 | globlastp |
| 3688 | LYM677 | sunflower\|12v1\|EE608284_P1 | 7283 | 622 | 85.5 | globlastp |
| 3689 | LYM677 | apple\|gb171\|CN887142 | 7284 | 622 | 85.5 | globlastp |
| 3690 | LYM677 | dandelion\|10v1\|DR400203_P1 | 7285 | 622 | 85.5 | globlastp |
| 3691 | LYM677 | lotus\|09v1\|AV411597_P1 | 7286 | 622 | 85.5 | globlastp |
| 3692 | LYM677 | nicotiana_benthamiana\|gb162\|CN744405_P1 | 7287 | 622 | 85.5 | globlastp |
| 3693 | LYM677 | potato\|10v1\|BE924616_P1 | 7288 | 622 | 85.5 | globlastp |
| 3694 | LYM677 | safflower\|gb162\|EL401519 | 7289 | 622 | 85.5 | globlastp |
| 3695 | LYM677 | solanum_phureja\|09v1\|SPHBG133730 | 7290 | 622 | 85.5 | globlastp |
| 3696 | LYM677 | tobacco\|gb162\|CN949741 | 7291 | 622 | 85.5 | globlastp |
| 3697 | LYM677 | tomato\|09v1\|BG133730 | 7290 | 622 | 85.5 | globlastp |
| 3698 | LYM677 | tomato\|11v1\|BG133730_P1 | 7290 | 622 | 85.5 | globlastp |
| 3699 | LYM677 | flaveria\|11v1\|SRR149229.183404_T1 | 7292 | 622 | 85.41 | glotblastn |
| 3700 | LYM677 | primula\|11v1\|SRR098679X165172_P1 | 7293 | 622 | 85.1 | globlastp |
| 3701 | LYM677 | ambrosia\|11v1\|SRR346935.236909_P1 | 7294 | 622 | 84.9 | globlastp |
| 3702 | LYM677 | ambrosia\|11v1\|SRR346946.102089_P1 | 7295 | 622 | 84.9 | globlastp |
| 3703 | LYM677 | bean\|12v1\|CA907588_P1 | 7296 | 622 | 84.9 | globlastp |
| 3704 | LYM677 | chickpea\|11v1\|FE669068_P1 | 7297 | 622 | 84.9 | globlastp |
| 3705 | LYM677 | eucalyptus\|11v2\|SRR001659X125325_P1 | 7298 | 622 | 84.9 | globlastp |
| 3706 | LYM677 | flax\|11v1\|JG019406_P1 | 7299 | 622 | 84.9 | globlastp |
| 3707 | LYM677 | trigonella\|11v1\|SRR066194X135604_P1 | 7300 | 622 | 84.9 | globlastp |
| 3708 | LYM677 | artemisia\|10v1\|EY075435_P1 | 7301 | 622 | 84.9 | globlastp |
| 3709 | LYM677 | cichorium\|gb171\|EH691297_P1 | 7302 | 622 | 84.9 | globlastp |
| 3710 | LYM677 | eggplant\|10v1\|FS039205_P1 | 7303 | 622 | 84.9 | globlastp |
| 3711 | LYM677 | lettuce\|10v1\|DW067400_P1 | 7304 | 622 | 84.9 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3712 | LYM677 | monkeyflower\|10v1\|CV518652_P1 | 7305 | 622 | 84.9 | globlastp |
| 3713 | LYM677 | pea\|11v1\|EX569416_P1 | 7300 | 622 | 84.9 | globlastp |
| 3714 | LYM677 | potato\|10v1\|BG589677_P1 | 7306 | 622 | 84.9 | globlastp |
| 3715 | LYM677 | solanum_phureja\|09v1\|SPHBG627529 | 7306 | 622 | 84.9 | globlastp |
| 3716 | LYM677 | tragopogon\|10v1\|SRR020205S0006671 | 7307 | 622 | 84.9 | globlastp |
| 3717 | LYM677 | ambrosia\|11v1\|SRR346935.125104_T1 | 7308 | 622 | 84.86 | glotblastn |
| 3718 | LYM677 | flaveria\|11v1\|SRR149229.44212_T1 | 7309 | 622 | 84.86 | glotblastn |
| 3719 | LYM677 | poppy\|11v1\|SRR096789.253655_T1 | 7310 | 622 | 84.86 | glotblastn |
| 3720 | LYM677 | eucalyptus\|11v2\|SRR001658X10263_P1 | 7311 | 622 | 84.5 | globlastp |
| 3721 | LYM677 | eucalyptus\|11v1\|SRR001659X109109 | 7311 | 622 | 84.5 | globlastp |
| 3722 | LYM677 | euonymus\|11v1\|SRR070038X220716_T1 | 7312 | 622 | 84.41 | glotblastn |
| 3723 | LYM677 | flax\|11v1\|JG021135_P1 | 7313 | 622 | 84.4 | globlastp |
| 3724 | LYM677 | hornbeam\|12v1\|SRR364455.130896_P1 | 7314 | 622 | 84.4 | globlastp |
| 3725 | LYM677 | beet\|12v1\|BQ487784_P1 | 7315 | 622 | 84.4 | globlastp |
| 3726 | LYM677 | beet\|gb162\|BQ487784 | 7315 | 622 | 84.4 | globlastp |
| 3727 | LYM677 | chickpea\|09v2\|FE669068 | 7316 | 622 | 84.4 | globlastp |
| 3728 | LYM677 | cichorium\|gb171\|EL359267_P1 | 7317 | 622 | 84.4 | globlastp |
| 3729 | LYM677 | citrus\|gb166\|CF829290 | 7318 | 622 | 84.4 | globlastp |
| 3730 | LYM677 | clementine\|11v1\|CF829290_P1 | 7318 | 622 | 84.4 | globlastp |
| 3731 | LYM677 | eggplant\|10v1\|FS011059_P1 | 7319 | 622 | 84.4 | globlastp |
| 3732 | LYM677 | eucalyptus\|11v1\|SRR001659X100605 | 7320 | 622 | 84.4 | globlastp |
| 3733 | LYM677 | nasturtium\|10v1\|GH169509 | 7321 | 622 | 84.4 | globlastp |
| 3734 | LYM677 | nasturtium\|11v1\|GH169509_P1 | 7321 | 622 | 84.4 | globlastp |
| 3735 | LYM677 | orange\|11v1\|CF829290_P1 | 7318 | 622 | 84.4 | globlastp |
| 3736 | LYM677 | peanut\|10v1\|GO325595_P1 | 7322 | 622 | 84.4 | globlastp |
| 3737 | LYM677 | pepper\|gb171\|GD115586_P1 | 7323 | 622 | 84.4 | globlastp |
| 3738 | LYM677 | sunflower\|10v1\|CD848737 | 7324 | 622 | 84.4 | globlastp |
| 3739 | LYM677 | tobacco\|gb162\|EB443399 | 7325 | 622 | 84.4 | globlastp |
| 3740 | LYM677 | bupleurum\|11v1\|SRR301254.158856_T1 | 7326 | 622 | 84.32 | glotblastn |
| 3741 | LYM677 | guizotia\|10v1\|GE558322_T1 | 7327 | 622 | 84.32 | glotblastn |
| 3742 | LYM677 | onion\|gb162\|CF434763_T1 | 7328 | 622 | 84.32 | glotblastn |
| 3743 | LYM677 | cenchrus\|gb166\|EB654414_P1 | 7329 | 622 | 84.3 | globlastp |
| 3744 | LYM677 | ambrosia\|11v1\|SRR346935.379251_P1 | 7330 | 622 | 83.9 | globlastp |
| 3745 | LYM677 | eucalyptus\|11v2\|SRR001659X100605_P1 | 7331 | 622 | 83.9 | globlastp |
| 3746 | LYM677 | valeriana\|11v1\|SRR099039X158087_P1 | 7332 | 622 | 83.9 | globlastp |
| 3747 | LYM677 | arabidopsis_lyrata\|09v1\|JGIAL030010_P1 | 7333 | 622 | 83.9 | globlastp |
| 3748 | LYM677 | cleome_spinosa\|10v1\|GR932391_P1 | 7334 | 622 | 83.9 | globlastp |
| 3749 | LYM677 | curcuma\|10v1\|DY386428_P1 | 7335 | 622 | 83.9 | globlastp |
| 3750 | LYM677 | lettuce\|10v1\|DW077430_P1 | 7336 | 622 | 83.9 | globlastp |
| 3751 | LYM677 | nasturtium\|10v1\|SRR032558S0015778 | 7337 | 622 | 83.9 | globlastp |
| 3752 | LYM677 | peanut\|10v1\|EE126331_P1 | 7338 | 622 | 83.9 | globlastp |
| 3753 | LYM677 | soybean\|11v1\|GLYMA06G42050 | 7339 | 622 | 83.9 | globlastp |
| 3754 | LYM677 | soybean\|11v1\|GLYMA12G16400 | 7340 | 622 | 83.9 | globlastp |
| 3755 | LYM677 | tomato\|09v1\|BG627529 | 7341 | 622 | 83.9 | globlastp |
| 3756 | LYM677 | trigonella\|11v1\|SRR066194X158071_P1 | 7342 | 622 | 83.3 | globlastp |
| 3757 | LYM677 | arabidopsis\|10v1\|AT5G54750_P1 | 7343 | 622 | 83.3 | globlastp |
| 3758 | LYM677 | cleome_gynandra\|10v1\|SRR015532S0004358_P1 | 7344 | 622 | 83.3 | globlastp |
| 3759 | LYM677 | cowpea\|gb166\|FF382438_P1 | 7345 | 622 | 83.3 | globlastp |
| 3760 | LYM677 | cycas\|gb166\|EX809532_P1 | 7346 | 622 | 83.3 | globlastp |
| 3761 | LYM677 | medicago\|09v1\|AI974266 | 7347 | 622 | 83.3 | globlastp |
| 3762 | LYM677 | medicago\|12v1\|AI974266_P1 | 7347 | 622 | 83.3 | globlastp |
| 3763 | LYM677 | eschscholzia\|11v1\|SRR014116.52507_P1 | 7348 | 622 | 83.2 | globlastp |
| 3764 | LYM677 | spruce\|11v1\|ES249147_P1 | 7349 | 622 | 82.8 | globlastp |
| 3765 | LYM677 | thellungiella_halophilum\|11v1\|BY829428_P1 | 7350 | 622 | 82.8 | globlastp |
| 3766 | LYM677 | pigeonpea\|10v1\|SRR054580S0006090 | 7351 | 622 | 82.8 | globlastp |
| 3767 | LYM677 | pigeonpea\|11v1\|GW351324_P1 | 7351 | 622 | 82.8 | globlastp |
| 3768 | LYM677 | rhizophora\|10v1\|SRR005793S0004856 | 7352 | 622 | 82.8 | globlastp |
| 3769 | LYM677 | spruce\|gb162\|CO215431 | 7349 | 622 | 82.8 | globlastp |
| 3770 | LYM677 | thellungiella\|gb167\|BY829428 | 7350 | 622 | 82.8 | globlastp |
| 3771 | LYM677 | rhizophora\|10v1\|SRR005793S0039343 | 7353 | 622 | 82.7 | glotblastn |
| 3772 | LYM677 | abies\|11v2\|SRR098676X10670_P1 | 7354 | 622 | 82.3 | globlastp |
| 3773 | LYM677 | b_juncea\|10v2\|E6ANDIZ01AFTO1_P1 | 7355 | 622 | 82.3 | globlastp |
| 3774 | LYM677 | b_oleracea\|gb161\|DY025844_P1 | 7355 | 622 | 82.3 | globlastp |
| 3775 | LYM677 | b_rapa\|11v1\|CD818353_P1 | 7355 | 622 | 82.3 | globlastp |
| 3776 | LYM677 | b_rapa\|gb162\|CA992296 | 7355 | 622 | 82.3 | globlastp |
| 3777 | LYM677 | canola\|10v1\|CD818353 | 7355 | 622 | 82.3 | globlastp |
| 3778 | LYM677 | canola\|10v1\|CN736199 | 7355 | 622 | 82.3 | globlastp |
| 3779 | LYM677 | pine\|10v2\|BE451912_P1 | 7356 | 622 | 82.3 | globlastp |
| 3780 | LYM677 | radish\|gb164\|EV527496 | 7355 | 622 | 82.3 | globlastp |
| 3781 | LYM677 | canola\|11v1\|CN736123_P1 | 7355 | 622 | 82.3 | globlastp |
| 3782 | LYM677 | cynodon\|10v1\|ES296622_P1 | 7357 | 622 | 82.2 | globlastp |
| 3783 | LYM677 | flaveria\|11v1\|SRR149232.114650_T1 | 7358 | 622 | 82.16 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3784 | LYM677 | cynara\|gb167\|GE592458_P1 | 7359 | 622 | 81.9 | globlastp |
| 3785 | LYM677 | maritime_pine\|10v1\|SRR073317S0010700_P1 | 7360 | 622 | 81.7 | globlastp |
| 3786 | LYM677 | thellungiella_parvulum\|11v1\|BY829428_P1 | 7361 | 622 | 81.7 | globlastp |
| 3787 | LYM677 | medicago\|09v1\|DW015568 | 7362 | 622 | 81.7 | globlastp |
| 3788 | LYM677 | medicago\|12v1\|DW015568_P1 | 7362 | 622 | 81.7 | globlastp |
| 3789 | LYM677 | vinca\|11v1\|SRR098690X119056_P1 | 7363 | 622 | 81.2 | globlastp |
| 3790 | LYM677 | gnetum\|10v1\|SRR064399S0040420_P1 | 7364 | 622 | 81.2 | globlastp |
| 3791 | LYM677 | podocarpus\|10v1\|SRR065014S0089867_P1 | 7365 | 622 | 81.1 | globlastp |
| 3792 | LYM677 | cryptomeria\|gb166\|BY881835_P1 | 7366 | 622 | 80.6 | globlastp |
| 3793 | LYM677 | ipomoea_nil\|10v1\|CJ738909_P1 | 7367 | 622 | 80.6 | globlastp |
| 3794 | LYM677 | sciadopitys\|10v1\|SRR065035S0003976 | 7368 | 622 | 80.6 | globlastp |
| 3795 | LYM677 | cephalotaxus\|11v1\|SRR064395X108699_P1 | 7369 | 622 | 80.1 | globlastp |
| 3796 | LYM677 | taxus\|10v1\|SRR032523S0001250 | 7370 | 622 | 80.1 | globlastp |
| 3797 | LYM677 | lovegrass\|gb167\|EH189762_P1 | 7371 | 622 | 80 | globlastp |
| 3798 | LYM677 | switchgrass\|gb167\|FL781655 | 7372 | 622 | 80 | globlastp |
| 3799 | LYM677 | zostera\|10v1\|AM767777 | 7373 | 622 | 80 | globlastp |
| 3800 | LYM678 | sugarcane\|10v1\|CA072005 | 7374 | 623 | 89.1 | globlastp |
| 3801 | LYM678 | sorghum\|09v1\|SB04G007110 | 7375 | 623 | 88.6 | globlastp |
| 3802 | LYM678 | sorghum\|12v1\|SB04G007110_P1 | 7376 | 623 | 84 | globlastp |
| 3803 | LYM678 | maize\|10v1\|AI948126_P1 | 7377 | 623 | 83.7 | globlastp |
| 3804 | LYM678 | foxtail_millet\|11v3\|EC611989_P1 | 7378 | 623 | 83.5 | globlastp |
| 3805 | LYM678 | foxtail_millet\|10v2\|EC611989 | 7378 | 623 | 83.5 | globlastp |
| 3806 | LYM678 | millet\|10v1\|CD724329_P1 | 7379 | 623 | 82.1 | globlastp |
| 3807 | LYM678 | switchgrass\|gb167\|DN143342 | 7380 | 623 | 80 | globlastp |
| 3808 | LYM678 | switchgrass\|gb167\|FE600092 | 7381 | 623 | 80 | globlastp |
| 3809 | LYM679 | sugarcane\|10v1\|CA107876 | 7382 | 624 | 90.3 | globlastp |
| 3810 | LYM679 | sorghum\|12v1\|SB03G029180_P1 | 7383 | 624 | 89.8 | globlastp |
| 3811 | LYM679 | maize\|10v1\|ZMU08403_P1 | 7384 | 624 | 89.8 | globlastp |
| 3812 | LYM679 | sorghum\|09v1\|SB03G029170 | 7385 | 624 | 89.05 | glotblastn |
| 3813 | LYM679 | sorghum\|12v1\|SB03G029170_T1 | 7386 | 624 | 86.41 | glotblastn |
| 3814 | LYM679 | maize\|10v1\|MZEORFN_T1 | 7387 | 624 | 85.92 | glotblastn |
| 3815 | LYM679 | sugarcane\|10v1\|CA275057 | 7388 | 624 | 85.9 | globlastp |
| 3816 | LYM679 | sugarcane\|10v1\|CA275015 | 7389 | 624 | 84.95 | glotblastn |
| 3817 | LYM679 | foxtail_millet\|10v2\|OXFXTRMSLX00044084D1T1 | 7390 | 624 | 83.01 | glotblastn |
| 3818 | LYM679 | foxtail_millet\|11v3\|EC612987_T1 | 7391 | 624 | 82.04 | glotblastn |
| 3819 | LYM679 | foxtail_millet\|11v3\|PHY7SI002140M_P1 | 7392 | 624 | 80.1 | globlastp |
| 3820 | LYM679 | brachypodium\|09v1\|DV471640 | 7393 | 624 | 80.1 | globlastp |
| 3821 | LYM679 | brachypodium\|12v1\|BRADI2G44856_T1 | 7393 | 624 | 80.1 | glotblastn |
| 3822 | LYM679 | switchgrass\|gb167\|FL783152 | 7394 | 624 | 80.1 | glotblastn |
| 3823 | LYM680 | sugarcane\|10v1\|CA114943 | 7395 | 625 | 88.4 | globlastp |
| 3824 | LYM680 | sorghum\|09v1\|SB03G006340 | 7396 | 625 | 86.2 | globlastp |
| 3825 | LYM680 | sorghum\|12v1\|SB03G006340_P1 | 7396 | 625 | 86.2 | globlastp |
| 3826 | LYM680 | switchgrass\|gb167\|FE635568_P1 | 7397 | 625 | 80.4 | globlastp |
| 3827 | LYM680 | switchgrass\|gb167\|FE618862 | 7398 | 625 | 80.29 | glotblastn |
| 3828 | LYM682 | maize\|10v1\|CK985738_P1 | 7399 | 626 | 88.9 | globlastp |
| 3829 | LYM682 | foxtail_millet\|11v3\|PHY7SI007620M_P1 | 7400 | 626 | 86.7 | globlastp |
| 3830 | LYM682 | sorghum\|09v1\|SB10G007165 | 7401 | 626 | 85.9 | globlastp |
| 3831 | LYM682 | sorghum\|12v1\|SB10G007165_P1 | 7401 | 626 | 85.9 | globlastp |
| 3832 | LYM682 | wheat\|10v2\|CA622492 | 7402 | 626 | 85.6 | globlastp |
| 3833 | LYM682 | foxtail_millet\|11v3\|PHY7SI008755M_P1 | 7403 | 626 | 83.7 | globlastp |
| 3834 | LYM682 | foxtail_millet\|11v3\|SICRP097492_P1 | 7403 | 626 | 83.7 | globlastp |
| 3835 | LYM682 | foxtail_millet\|10v2\|SICRP004184 | 7404 | 626 | 82.7 | globlastp |
| 3836 | LYM684 | rice\|11v1\|AA754345_P1 | 7405 | 628 | 97.1 | globlastp |
| 3837 | LYM684 | foxtail_millet\|11v3\|PHY7SI014626M_P1 | 7406 | 628 | 81.4 | globlastp |
| 3838 | LYM684 | millet\|10v1\|EVO454PM010276_P1 | 7407 | 628 | 81 | globlastp |
| 3839 | LYM684 | foxtail_millet\|10v2\|SICRP029723 | 7408 | 628 | 80 | globlastp |
| 3840 | LYM685 | rice\|11v1\|BI805724_P1 | 7409 | 629 | 88.9 | globlastp |
| 3841 | LYM686 | foxtail_millet\|11v3\|PHY7SI025848M_P1 | 7410 | 630 | 94.6 | globlastp |
| 3842 | LYM686 | brachypodium\|09v1\|SRR031797S0079359 | 7411 | 630 | 93.9 | globlastp |
| 3843 | LYM686 | brachypodium\|12v1\|BRADI4G23600T2_P1 | 7411 | 630 | 93.9 | globlastp |
| 3844 | LYM686 | sorghum\|09v1\|SB05G005680 | 7412 | 630 | 93.8 | globlastp |
| 3845 | LYM686 | sorghum\|12v1\|SB05G005680_P1 | 7412 | 630 | 93.8 | globlastp |
| 3846 | LYM686 | sorghum\|09v1\|SB04G004200 | 7413 | 630 | 93.7 | globlastp |
| 3847 | LYM686 | sorghum\|12v1\|SB04G004200_P1 | 7413 | 630 | 93.7 | globlastp |
| 3848 | LYM686 | rye\|12v1\|DRR001012.114318_P1 | 7414 | 630 | 93.3 | globlastp |
| 3849 | LYM686 | gossypium_raimondii\|12v1\|DT458184_P1 | 7415 | 630 | 84.7 | globlastp |
| 3850 | LYM686 | eucalyptus\|11v2\|SRR001660X10716_P1 | 7416 | 630 | 84.1 | globlastp |
| 3851 | LYM686 | eucalyptus\|11v1\|SRR001660X10716 | 7416 | 630 | 84.1 | globlastp |
| 3852 | LYM686 | pigeonpea\|11v1\|SRR054580X112069_P1 | 7417 | 630 | 83.8 | globlastp |
| 3853 | LYM686 | watermelon\|11v1\|VMEL03432835211246_P1 | 7418 | 630 | 83.6 | globlastp |
| 3854 | LYM686 | soybean\|11v1\|GLYMA04G38800 | 7419 | 630 | 83.1 | globlastp |
| 3855 | LYM686 | clementine\|11v1\|CX298207_P1 | 7420 | 630 | 83 | globlastp |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3856 | LYM686 | soybean\|11v1\|GLYMA06G16110 | 7421 | 630 | 83 | globlastp |
| 3857 | LYM686 | prunus\|10v1\|BU039281 | 7422 | 630 | 82.8 | globlastp |
| 3858 | LYM686 | chickpea\|11v1\|SRR133517.112456_T1 | 7423 | 630 | 82.75 | glotblastn |
| 3859 | LYM686 | cacao\|10v1\|CGD0027220_P1 | 7424 | 630 | 82.2 | globlastp |
| 3860 | LYM686 | cucumber\|09v1\|CSCRP002267_T1 | 7425 | 630 | 81.83 | glotblastn |
| 3861 | LYM686 | tomato\|11v1\|AW154923_P1 | 7426 | 630 | 81.8 | globlastp |
| 3862 | LYM686 | poplar\|10v1\|CV261943_P1 | 7427 | 630 | 81.6 | globlastp |
| 3863 | LYM686 | aquilegia\|10v2\|DT762298 | 7428 | 630 | 81.5 | globlastp |
| 3864 | LYM686 | bean\|12v1\|CA902038_P1 | 7429 | 630 | 80.7 | globlastp |
| 3865 | LYM686 | thellungiella_parvulum\|11v1\|EPPRD023559_P1 | 7430 | 630 | 80.7 | globlastp |
| 3866 | LYM686 | arabidopsis\|10v1\|AT5G63960_P1 | 7431 | 630 | 80.5 | globlastp |
| 3867 | LYM686 | pine\|10v2\|DN612280_T1 | 7432 | 630 | 80.38 | glotblastn |
| 3868 | LYM686 | arabidopsis_lyrata\|09v1\|JGIAL031065_P1 | 7433 | 630 | 80.2 | globlastp |
| 3869 | LYM686 | monkeyflower\|10v1\|GR006937_P1 | 7434 | 630 | 80 | globlastp |
| 3870 | LYM688 | sugarcane\|10v1\|CA098697 | 7435 | 632 | 93 | globlastp |
| 3871 | LYM688 | maize\|10v1\|AI619320_P1 | 7436 | 632 | 86.9 | globlastp |
| 3872 | LYM688 | millet\|10v1\|PMSLX0065689D1_P1 | 7437 | 632 | 86 | globlastp |
| 3873 | LYM688 | switchgrass\|gb167\|FE646506 | 7438 | 632 | 85.5 | globlastp |
| 3874 | LYM688 | foxtail_millet\|11v3\|EC612848_P1 | 7439 | 632 | 81.3 | globlastp |
| 3875 | LYM688 | rice\|11v1\|OSCRP084058_P1 | 7440 | 632 | 81 | globlastp |
| 3876 | LYM688 | rice\|11v1\|AA750437_P1 | 7440 | 632 | 81 | globlastp |
| 3877 | LYM688 | rice\|gb170\|OS03G55670 | 7440 | 632 | 81 | globlastp |
| 3878 | LYM690 | maize\|10v1\|BM416926_P1 | 7441 | 634 | 90.6 | globlastp |
| 3879 | LYM690 | sorghum\|09v1\|SB01G017170 | 7442 | 634 | 88.8 | globlastp |
| 3880 | LYM690 | sorghum\|12v1\|SB01G017170_P1 | 7442 | 634 | 88.8 | globlastp |
| 3881 | LYM690 | switchgrass\|gb167\|DN143640 | 7443 | 634 | 84.6 | globlastp |
| 3882 | LYM690 | foxtail_millet\|11v3\|PHY7SI035215M_P1 | 7444 | 634 | 84.4 | globlastp |
| 3883 | LYM690 | foxtail_millet\|11v3\|SICRP001534_P1 | 7444 | 634 | 84.4 | globlastp |
| 3884 | LYM690 | foxtail_millet\|10v2\|SICRP017186 | 7445 | 634 | 82.38 | glotblastn |
| 3885 | LYM690 | foxtail_millet\|11v3\|SICRP062528_P1 | 7446 | 634 | 82.2 | globlastp |
| 3886 | LYM690 | foxtail_millet\|11v3\|PHY7SI029490M_P1 | 7447 | 634 | 82 | globlastp |
| 3887 | LYM691 | maize\|10v1\|AI977992_P1 | 7448 | 635 | 96.1 | globlastp |
| 3888 | LYM691 | foxtail_millet\|11v3\|EC612589_P1 | 7449 | 635 | 95.9 | globlastp |
| 3889 | LYM691 | switchgrass\|gb167\|FE599751 | 7450 | 635 | 95.6 | globlastp |
| 3890 | LYM691 | rice\|11v1\|GFXAC069145X21_P1 | 7451 | 635 | 90.8 | globlastp |
| 3891 | LYM691 | rice\|gb170\|OS10G33420 | 7451 | 635 | 90.8 | globlastp |
| 3892 | LYM691 | brachypodium\|09v1\|DV486633 | 7452 | 635 | 89.1 | globlastp |
| 3893 | LYM691 | brachypodium\|12v1\|BRADI3G28580_P1 | 7452 | 635 | 89.1 | globlastp |
| 3894 | LYM691 | wheat\|10v2\|BE431031 | 7453 | 635 | 88.9 | globlastp |
| 3895 | LYM691 | oil_palm\|11v1\|EL692412_P1 | 7454 | 635 | 81.7 | globlastp |
| 3896 | LYM692 | maize\|10v1\|AI941649_P1 | 7455 | 636 | 99 | globlastp |
| 3897 | LYM692 | rice\|11v1\|BI806997_P1 | 7456 | 636 | 92.8 | globlastp |
| 3898 | LYM692 | rice\|gb170\|OS10G25320 | 7456 | 636 | 92.8 | globlastp |
| 3899 | LYM692 | brachypodium\|12v1\|BRADI3G23230_P1 | 7457 | 636 | 91.6 | globlastp |
| 3900 | LYM692 | brachypodium\|09v1\|DV471548 | 7458 | 636 | 91.4 | globlastp |
| 3901 | LYM692 | oat\|10v2\|GR352336 | 7459 | 636 | 90.41 | glotblastn |
| 3902 | LYM692 | oat\|11v1\|GR352336_T1 | 7459 | 636 | 90.41 | glotblastn |
| 3903 | LYM692 | rye\|12v1\|BE636899_P1 | 7460 | 636 | 89.9 | globlastp |
| 3904 | LYM692 | wheat\|10v2\|BE406346 | 7461 | 636 | 89.9 | globlastp |
| 3905 | LYM692 | barley\|10v2\|AV835399_P1 | 7462 | 636 | 89.7 | globlastp |
| 3906 | LYM692 | switchgrass\|gb167\|DN149108 | 7463 | 636 | 84.62 | glotblastn |
| 3907 | LYM692 | oil_palm\|11v1\|SRR190698.115219_T1 | 7464 | 636 | 81.01 | glotblastn |
| 3908 | LYM692 | foxtail_millet\|11v3\|PHY7SI040283M_P1 | 7465 | 636 | 80.5 | globlastp |
| 3909 | LYM694 | sugarcane\|10v1\|CA180305 | 7466 | 638 | 93.9 | globlastp |
| 3910 | LYM694 | foxtail_millet\|11v3\|PHY7SI036577M_P1 | 7467 | 638 | 82.3 | globlastp |
| 3911 | LYM695 | maize\|10v1\|AI586634_P1 | 7468 | 639 | 95 | globlastp |
| 3912 | LYM695 | maize\|10v1\|AI622355_P1 | 7469 | 639 | 94.3 | globlastp |
| 3913 | LYM695 | foxtail_millet\|11v3\|EC613215_P1 | 7470 | 639 | 91 | globlastp |
| 3914 | LYM695 | switchgrass\|gb167\|FE615019 | 7471 | 639 | 89.85 | glotblastn |
| 3915 | LYM695 | foxtail_millet\|10v2\|EC613215 | 7472 | 639 | 85.8 | globlastp |
| 3916 | LYM695 | millet\|10v1\|EVO454PM035183_P1 | 7473 | 639 | 85.4 | globlastp |
| 3917 | LYM695 | rice\|11v1\|BM420914_P1 | 7474 | 639 | 83.5 | globlastp |
| 3918 | LYM695 | rice\|gb170\|OS03G25970 | 7474 | 639 | 83.5 | globlastp |
| 3919 | LYM695 | oat\|11v1\|GO592482_P1 | 7475 | 639 | 81.5 | globlastp |
| 3920 | LYM695 | oat\|10v2\|CN815746 | 7475 | 639 | 81.5 | globlastp |
| 3921 | LYM695 | brachypodium\|09v1\|DV471651 | 7476 | 639 | 81.1 | globlastp |
| 3922 | LYM695 | brachypodium\|12v1\|BRADI1G61240_P1 | 7477 | 639 | 80.8 | globlastp |
| 3923 | LYM695 | brachypodium\|12v1\|BRADI1G61230T2_P1 | 7478 | 639 | 80.2 | globlastp |
| 3924 | LYM695 | wheat\|10v2\|BE400923 | 7479 | 639 | 80 | globlastp |
| 3925 | LYM697 | maize\|10v1\|AW400131_P1 | 7480 | 640 | 94.6 | globlastp |
| 3926 | LYM697 | foxtail_millet\|11v3\|PHY7SI035194M_P1 | 7481 | 640 | 90.3 | globlastp |
| 3927 | LYM697 | switchgrass\|gb167\|DN142379 | 7482 | 640 | 90.3 | globlastp |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3928 | LYM697 | barley\|10v2\|BF620011_P1 | 7483 | 640 | 82.5 | globlastp |
| 3929 | LYM697 | brachypodium\|09v1\|GT775205 | 7484 | 640 | 82.3 | globlastp |
| 3930 | LYM697 | brachypodium\|12v1\|BRADI1G63460_P1 | 7484 | 640 | 82.3 | globlastp |
| 3931 | LYM697 | rye\|12v1\|DRR001012.175511_P1 | 7485 | 640 | 81.4 | globlastp |
| 3932 | LYM698 | foxtail_millet\|11v3\|EC613540_P1 | 7486 | 641 | 92.3 | globlastp |
| 3933 | LYM698 | millet\|10v1\|EVO454PM029595_P1 | 7487 | 641 | 91.5 | globlastp |
| 3934 | LYM698 | maize\|10v1\|BM336637_P1 | 7488 | 641 | 90.6 | globlastp |
| 3935 | LYM698 | sugarcane\|10v1\|BQ534279 | 7489 | 641 | 89 | globlastp |
| 3936 | LYM698 | maize\|10v1\|W21716_T1 | 7490 | 641 | 88.33 | glotblastn |
| 3937 | LYM698 | rice\|11v1\|GFXAC079633X19_P1 | 7491 | 641 | 86 | globlastp |
| 3938 | LYM698 | rice\|gb170\|OS03G08430 | 7492 | 641 | 85.9 | globlastp |
| 3939 | LYM698 | brachypodium\|09v1\|DV470400 | 7493 | 641 | 85.8 | globlastp |
| 3940 | LYM698 | brachypodium\|12v1\|BRADI1G72490_P1 | 7493 | 641 | 85.8 | globlastp |
| 3941 | LYM698 | barley\|10v2\|BI950205_P1 | 7494 | 641 | 84.9 | globlastp |
| 3942 | LYM698 | oat\|10v2\|GR323328 | 7495 | 641 | 84.9 | globlastp |
| 3943 | LYM698 | rye\|12v1\|DRR001012.175542_T1 | 7496 | 641 | 84.44 | glotblastn |
| 3944 | LYM698 | rye\|12v1\|DRR001012.138647_P1 | 7497 | 641 | 84.4 | globlastp |
| 3945 | LYM698 | rye\|12v1\|DRR001012.169487_P1 | 7498 | 641 | 84.4 | globlastp |
| 3946 | LYM698 | wheat\|10v2\|BE418843 | 7499 | 641 | 83.65 | glotblastn |
| 3947 | LYM699 | maize\|10v1\|AW313142_P1 | 7500 | 642 | 92.1 | globlastp |
| 3948 | LYM699 | switchgrass\|gb167\|FE644672 | 7501 | 642 | 91.7 | globlastp |
| 3949 | LYM699 | foxtail_millet\|11v3\|PHY7SI037050M_P1 | 7502 | 642 | 90.6 | globlastp |
| 3950 | LYM699 | foxtail_millet\|10v2\|FXTRMSLX00105561D1 | 7502 | 642 | 90.6 | globlastp |
| 3951 | LYM699 | rice\|gb170\|OS03G05270 | 7503 | 642 | 87.2 | globlastp |
| 3952 | LYM699 | sugarcane\|10v1\|CA111273 | 7504 | 642 | 83.39 | glotblastn |
| 3953 | LYM701 | brachypodium\|09v1\|DV481080 | 7505 | 644 | 85 | globlastp |
| 3954 | LYM701 | brachypodium\|12v1\|BRADI1G54650_P1 | 7505 | 644 | 85 | globlastp |
| 3955 | LYM701 | rice\|11v1\|CV730758_P1 | 7506 | 644 | 82.1 | globlastp |
| 3956 | LYM701 | rice\|gb170\|OS07G09670 | 7506 | 644 | 82.1 | globlastp |
| 3957 | LYM703 | maize\|10v1\|BG268618_P1 | 7507 | 646 | 95.6 | globlastp |
| 3958 | LYM703 | maize\|10v1\|BM333127_P1 | 7508 | 646 | 95.1 | globlastp |
| 3959 | LYM703 | foxtail_millet\|11v3\|GT228310_P1 | 7509 | 646 | 94.2 | globlastp |
| 3960 | LYM703 | switchgrass\|gb167\|FE598821 | 7510 | 646 | 91.1 | globlastp |
| 3961 | LYM703 | sugarcane\|10v1\|CA096456 | 7511 | 646 | 90.6 | globlastp |
| 3962 | LYM703 | brachypodium\|09v1\|DV478121 | 7512 | 646 | 90.1 | globlastp |
| 3963 | LYM703 | brachypodium\|12v1\|BRADI4G36880_P1 | 7512 | 646 | 90.1 | globlastp |
| 3964 | LYM703 | rice\|11v1\|BE039673_P1 | 7513 | 646 | 89.8 | globlastp |
| 3965 | LYM703 | rice\|gb170\|OS09G37230 | 7513 | 646 | 89.8 | globlastp |
| 3966 | LYM703 | barley\|10v2\|AV833260_P1 | 7514 | 646 | 85.9 | globlastp |
| 3967 | LYM703 | rye\|12v1\|DRR001012.104477_T1 | 7515 | 646 | 83.36 | glotblastn |
| 3968 | LYM703 | rye\|12v1\|BE586340_T1 | 7516 | 646 | 83.22 | glotblastn |
| 3969 | LYM703 | wheat\|10v2\|BF200601 | 7517 | 646 | 80 | globlastp |
| 3970 | LYM704 | rice\|11v1\|CA760512_P1 | 7518 | 647 | 82.8 | globlastp |
| 3971 | LYM704 | rice\|gb170\|OS06G07010 | 7518 | 647 | 82.8 | globlastp |
| 3972 | LYM705 | maize\|10v1\|DN226591_P1 | 7519 | 648 | 85.3 | globlastp |
| 3973 | LYM705 | maize\|10v1\|DV020636_P1 | 7520 | 648 | 83.7 | globlastp |
| 3974 | LYM705 | foxtail_millet\|11v3\|PHY7SI029903M_P1 | 7521 | 648 | 81.2 | globlastp |
| 3975 | LYM705 | switchgrass\|gb167\|DN144329 | 7522 | 648 | 80.4 | glotblastn |
| 3976 | LYM706 | maize\|10v1\|AW066558_P1 | 7523 | 649 | 97.9 | globlastp |
| 3977 | LYM706 | switchgrass\|gb167\|DN141533 | 7524 | 649 | 97 | globlastp |
| 3978 | LYM706 | millet\|10v1\|EVO454PM007397_P1 | 7525 | 649 | 96.8 | globlastp |
| 3979 | LYM706 | foxtail_millet\|11v3\|PHY7SI029911M_P1 | 7526 | 649 | 96.7 | globlastp |
| 3980 | LYM706 | foxtail_millet\|10v2\|SICRP002176 | 7526 | 649 | 96.7 | globlastp |
| 3981 | LYM706 | maize\|10v1\|BM498927_P1 | 7527 | 649 | 96.5 | globlastp |
| 3982 | LYM706 | barley\|10v2\|BE413453_P1 | 7528 | 649 | 92.4 | globlastp |
| 3983 | LYM706 | rye\|12v1\|DRR001012.171379_P1 | 7529 | 649 | 92 | globlastp |
| 3984 | LYM706 | wheat\|10v2\|BE403351 | 7529 | 649 | 92 | globlastp |
| 3985 | LYM706 | rice\|11v1\|BI808461_P1 | 7530 | 649 | 91.4 | globlastp |
| 3986 | LYM706 | rice\|gb170\|OS07G49040 | 7530 | 649 | 91.4 | globlastp |
| 3987 | LYM706 | brachypodium\|09v1\|GT808814 | 7531 | 649 | 91 | globlastp |
| 3988 | LYM706 | brachypodium\|12v1\|BRADHG16810_P1 | 7531 | 649 | 91 | globlastp |
| 3989 | LYM706 | foxtail_millet\|11v3\|PHY7SI035800M_P1 | 7532 | 649 | 87 | globlastp |
| 3990 | LYM706 | rice\|11v1\|AU160985_P1 | 7533 | 649 | 86.6 | globlastp |
| 3991 | LYM706 | rice\|gb170\|OS03G18970 | 7533 | 649 | 86.6 | globlastp |
| 3992 | LYM706 | sorghum\|09v1\|SB01G037810 | 7534 | 649 | 85.6 | globlastp |
| 3993 | LYM706 | sorghum\|12v1\|SB01G037810_P1 | 7534 | 649 | 85.6 | globlastp |
| 3994 | LYM706 | brachypodium\|09v1\|GT833085 | 7535 | 649 | 85.5 | globlastp |
| 3995 | LYM706 | brachypodium\|12v1\|BRADI1G64780_P1 | 7535 | 649 | 85.5 | globlastp |
| 3996 | LYM706 | rye\|12v1\|BE704716_T1 | 7536 | 649 | 84.3 | glotblastn |
| 3997 | LYM708 | brachypodium\|12v1\|SOLX00061016_T1 | 7537 | 651 | 87.08 | glotblastn |
| 3997 | LYM670 | brachypodium\|12v1\|SOLX00061016_T1 | 7537 | 716 | 90.3 | glotblastn |
| 3998 | LYM708 | pigeonpea\|11v1\|SRR054580X519963_T1 | 7538 | 651 | 80.13 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 3999 | LYM709 | maize\|10v1\|AW231372_P1 | 7539 | 652 | 96.1 | globlastp |
| 4000 | LYM709 | millet\|10v1\|EVO454PM000622_P1 | 7540 | 652 | 92.9 | globlastp |
| 4001 | LYM709 | switchgrass\|gb167\|DN151776 | 7541 | 652 | 91.7 | globlastp |
| 4002 | LYM709 | rice\|11v1\|BI800490_P1 | 7542 | 652 | 90.1 | globlastp |
| 4003 | LYM709 | foxtail_millet\|10v2\|SICRP003330 | 7543 | 652 | 89.9 | globlastp |
| 4004 | LYM709 | rice\|gb170\|OS01G54030 | 7544 | 652 | 88.7 | globlastp |
| 4005 | LYM709 | brachypodium\|12v1\|BRADI2G49540_P1 | 7545 | 652 | 88.6 | globlastp |
| 4006 | LYM709 | wheat\|10v2\|BE604295 | 7546 | 652 | 88 | globlastp |
| 4007 | LYM709 | brachypodium\|09v1\|GT864163 | 7547 | 652 | 87.2 | globlastp |
| 4008 | LYM709 | barley\|10v2\|BI948169_P1 | 7548 | 652 | 86.6 | globlastp |
| 4009 | LYM709 | foxtail_millet\|11v3\|PHY7SI000808M_P1 | 7549 | 652 | 85.7 | globlastp |
| 4010 | LYM709 | brachypodium\|12v1\|GT864163_T1 | 7550 | 652 | 80.41 | glotblastn |
| 4011 | LYM710 | maize\|10v1\|AI668327_P1 | 7551 | 653 | 85.7 | globlastp |
| 4012 | LYM710 | foxtail_millet\|11v3\|PHY7SI003822M_P1 | 7552 | 653 | 81.6 | globlastp |
| 4013 | LYM711 | maize\|10v1\|AW055988_P1 | 7553 | 654 | 83.8 | globlastp |
| 4014 | LYM711 | switchgrass\|gb167\|FL703610_T1 | 7554 | 654 | 83.71 | glotblastn |
| 4015 | LYM711 | foxtail_millet\|11v3\|SOLX00023920_P1 | 7555 | 654 | 82.8 | globlastp |
| 4016 | LYM712 | foxtail_millet\|11v3\|PHY7SI019853M_P1 | 7556 | 655 | 84.7 | globlastp |
| 4017 | LYM712 | rice\|11v1\|C19393_T1 | — | 655 | 84.44 | glotblastn |
| 4018 | LYM712 | rice\|gb170\|OS02G10080 | 7557 | 655 | 84.4 | globlastp |
| 4019 | LYM712 | sugarcane\|10v1\|AA080627 | 7558 | 655 | 80.5 | globlastp |
| 4020 | LYM713 | maize\|10v1\|BM660506_P1 | 7559 | 656 | 92.4 | globlastp |
| 4021 | LYM713 | foxtail_millet\|11v3\|EC612684_P1 | 7560 | 656 | 90.6 | globlastp |
| 4022 | LYM713 | foxtail_millet\|11v3\|PHY7SI025871M_P1 | 7561 | 656 | 90.5 | globlastp |
| 4023 | LYM713 | sorghum\|09v1\|SB08G001260 | 7562 | 656 | 89.7 | globlastp |
| 4024 | LYM713 | sorghum\|12v1\|SB08G001260_P1 | 7562 | 656 | 89.7 | globlastp |
| 4025 | LYM713 | rice\|11v1\|BI808936_T1 | 7563 | 656 | 87.02 | glotblastn |
| 4026 | LYM713 | brachypodium\|09v1\|GT762130 | 7564 | 656 | 87 | globlastp |
| 4027 | LYM713 | brachypodium\|12v1\|BRADI4G43300_P1 | 7564 | 656 | 87 | globlastp |
| 4028 | LYM713 | rice\|11v1\|CA766334_P1 | 7565 | 656 | 86.6 | globlastp |
| 4029 | LYM713 | rice\|gb170\|OS12G04220 | 7565 | 656 | 86.6 | globlastp |
| 4030 | LYM713 | rice\|gb170\|OS11G04460 | 7566 | 656 | 85.5 | globlastp |
| 4031 | LYM713 | oat\|10v2\|CN815947 | 7567 | 656 | 84.32 | glotblastn |
| 4032 | LYM713 | millet\|10v1\|EVO454PM000493_P1 | 7568 | 656 | 84.1 | globlastp |
| 4033 | LYM714 | foxtail_millet\|11v3\|PHY7SI009328M_T1 | 7569 | 657 | 82.05 | glotblastn |
| 4034 | LYM715 | foxtail_millet\|11v3\|PHY7SI029664M_P1 | 7570 | 658 | 83.7 | globlastp |
| 4035 | LYM715 | foxtail_millet\|10v2\|SICRP012612 | 7571 | 658 | 81.7 | globlastp |
| 4036 | LYM716 | switchgrass\|gb167\|DN152507 | 7572 | 659 | 91.2 | globlastp |
| 4037 | LYM716 | maize\|10v1\|BM417588_P1 | 7573 | 659 | 90.7 | globlastp |
| 4038 | LYM716 | foxtail_millet\|11v3\|PHY7SI011224M_P1 | 7574 | 659 | 90.6 | globlastp |
| 4039 | LYM716 | foxtail_millet\|10v2\|SICRP000100 | 7575 | 659 | 90.6 | globlastp |
| 4040 | LYM716 | sugarcane\|10v1\|CA093825 | 7576 | 659 | 89.38 | glotblastn |
| 4041 | LYM716 | millet\|10v1\|PMSLX0039181D2_P1 | 7577 | 659 | 87.5 | globlastp |
| 4042 | LYM716 | maize\|10v1\|AI861116_P1 | 7578 | 659 | 84.4 | globlastp |
| 4043 | LYM716 | wheat\|10v2\|BE413786 | 7579 | 659 | 84.2 | globlastp |
| 4044 | LYM716 | pseudoroegneria\|gb167\|FF345192 | 7580 | 659 | 83.4 | globlastp |
| 4045 | LYM716 | leymus\|gb166\|EG388433_P1 | 7581 | 659 | 82.8 | globlastp |
| 4046 | LYM716 | wheat\|10v2\|BE423792 | 7582 | 659 | 81 | globlastp |
| 4047 | LYM716 | rye\|12v1\|DRR001016.527591_T1 | 7583 | 659 | 80.12 | glotblastn |
| 4048 | LYM717 | maize\|10v1\|CF046464_P1 | 7584 | 660 | 83.6 | globlastp |
| 4049 | LYM718 | maize\|10v1\|CF032989_P1 | 7585 | 661 | 84.1 | globlastp |
| 4050 | LYM719 | sugarcane\|10v1\|BQ478958 | 7586 | 662 | 98.7 | globlastp |
| 4051 | LYM719 | foxtail_millet\|10v2\|SICRP036358 | 7587 | 662 | 90.2 | globlastp |
| 4052 | LYM719 | switchgrass\|gb167\|DN149929 | 7588 | 662 | 90 | globlastp |
| 4053 | LYM719 | millet\|10v1\|CD725672_P1 | 7589 | 662 | 88.3 | globlastp |
| 4054 | LYM719 | maize\|10v1\|BU101389_T1 | 7590 | 662 | 88.21 | glotblastn |
| 4055 | LYM719 | foxtail_millet\|11v3\|PHY7SI013599M_T1 | 7591 | 662 | 84.73 | glotblastn |
| 4056 | LYM719 | rice\|11v1\|BI806794_P1 | 7592 | 662 | 82.7 | globlastp |
| 4057 | LYM719 | rice\|gb170\|OS08G42740T3 | 7592 | 662 | 82.7 | globlastp |
| 4058 | LYM719 | wheat\|10v2\|BE403726 | 7593 | 662 | 80.4 | globlastp |
| 4059 | LYM721 | maize\|10v1\|ZMCRP2V003729_P1 | 7594 | 664 | 99.4 | globlastp |
| 4060 | LYM721 | foxtail_millet\|11v3\|PHY7SI020861M_T1 | 7595 | 664 | 98.84 | glotblastn |
| 4061 | LYM721 | rice\|11v1\|CI745404_T1 | 7596 | 664 | 98.84 | glotblastn |
| 4062 | LYM721 | rice\|gb170\|OS04G16804 | 7596 | 664 | 98.84 | glotblastn |
| 4063 | LYM721 | rice\|gb170\|OSP1G00800 | 7597 | 664 | 98.84 | glotblastn |
| 4064 | LYM721 | rice\|11v1\|OSCRP021109_T1 | — | 664 | 98.84 | glotblastn |
| 4065 | LYM721 | rice\|11v1\|OSCRP167245_T1 | — | 664 | 98.84 | glotblastn |
| 4066 | LYM721 | rice\|11v1\|OSPRD087046_T1 | — | 664 | 98.84 | glotblastn |
| 4067 | LYM721 | rice\|gb170\|OS05G22868 | 7598 | 664 | 98.27 | glotblastn |
| 4068 | LYM721 | rice\|11v1\|OSCRP111880_T1 | — | 664 | 98.27 | glotblastn |
| 4069 | LYM721 | maize\|10v1\|DN560320_T1 | 7599 | 664 | 97.71 | glotblastn |
| 4070 | LYM721 | maize\|10v1\|GRMZM2G474515T01_T1 | 7600 | 664 | 97.11 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4071 | LYM721 | foxtail_millet\|11v3\|GT090903_T1 | — | 664 | 97.11 | glotblastn |
| 4072 | LYM721 | rice\|gb170\|GFXAC092750X9 | 7601 | 664 | 96.53 | glotblastn |
| 4073 | LYM721 | rice\|11v1\|OSCRP026625_T1 | — | 664 | 96.53 | glotblastn |
| 4074 | LYM721 | brachypodium\|09v1\|CRPBD006459 | 7602 | 664 | 93.71 | glotblastn |
| 4075 | LYM721 | brachypodium\|12v1\|BDPRD12V1000513_T1 | — | 664 | 93.71 | glotblastn |
| 4076 | LYM721 | brachypodium\|12v1\|BDPRD12V1002850_T1 | — | 664 | 93.71 | glotblastn |
| 4076 | LYM745 | brachypodium\|12v1\|BDPRD12V1002850_T1 | — | 687 | 97.44 | glotblastn |
| 4076 | LYM530 | brachypodium\|12v1\|BDPRD12V1002850_T1 | — | 699 | 93.91 | glotblastn |
| 4077 | LYM721 | brachypodium\|09v1\|CRPBD010137 | 7603 | 664 | 92.57 | glotblastn |
| 4078 | LYM721 | brachypodium\|12v1\|BDCRP12V1047739_T1 | — | 664 | 92.57 | glotblastn |
| 4079 | LYM722 | maize\|10v1\|AW324687_P1 | 7604 | 665 | 92.8 | globlastp |
| 4080 | LYM722 | switchgrass\|gb167\|FE600976 | 7605 | 665 | 92 | globlastp |
| 4081 | LYM722 | foxtail_millet\|11v3\|PHY7SI009631M_P1 | 7606 | 665 | 90.9 | globlastp |
| 4082 | LYM722 | foxtail_millet\|10v2\|SICRP009170 | 7607 | 665 | 87.6 | globlastp |
| 4083 | LYM722 | oat\|10v2\|GR343028 | 7608 | 665 | 83.9 | globlastp |
| 4084 | LYM722 | rye\|12v1\|DRR001012.171596_P1 | 7609 | 665 | 83.6 | globlastp |
| 4085 | LYM722 | rice\|11v1\|BM420357_P1 | 7610 | 665 | 83.6 | globlastp |
| 4086 | LYM722 | rice\|gb170\|OS12G07150 | 7610 | 665 | 83.6 | globlastp |
| 4087 | LYM722 | wheat\|10v2\|BE412127 | 7611 | 665 | 83.6 | globlastp |
| 4088 | LYM722 | brachypodium\|09v1\|DV473390 | 7612 | 665 | 83.4 | globlastp |
| 4089 | LYM722 | brachypodium\|12v1\|BRADI4G41550_P1 | 7612 | 665 | 83.4 | globlastp |
| 4090 | LYM723 | foxtail_millet\|11v3\|PHY7SI021418M_P1 | 7613 | 666 | 81.5 | globlastp |
| 4091 | LYM724 | maize\|10v1\|AI491594_P1 | 7614 | 667 | 96.6 | globlastp |
| 4092 | LYM724 | foxtail_millet\|11v3\|PHY7SI021645M_P1 | 7615 | 667 | 96.2 | globlastp |
| 4093 | LYM724 | switchgrass\|gb167\|DN151456 | 7616 | 667 | 95 | globlastp |
| 4094 | LYM724 | foxtail_millet\|10v2\|SICRP007323 | 7617 | 667 | 94.1 | globlastp |
| 4095 | LYM724 | millet\|10v1\|EVO454PM015167_P1 | 7618 | 667 | 93 | globlastp |
| 4096 | LYM724 | maize\|10v1\|AW787842_P1 | 7619 | 667 | 92.4 | globlastp |
| 4097 | LYM724 | rice\|11v1\|BI809532_P1 | 7620 | 667 | 86 | globlastp |
| 4098 | LYM724 | rice\|gb170\|OS05G05160 | 7620 | 667 | 86 | globlastp |
| 4099 | LYM724 | rice\|11v1\|AA749635_T1 | 7621 | 667 | 85.33 | glotblastn |
| 4100 | LYM724 | rice\|gb170\|OSHG17080 | 7621 | 667 | 85.33 | glotblastn |
| 4101 | LYM724 | brachypodium\|12v1\|BRADI2G36470_P1 | 7622 | 667 | 83.8 | globlastp |
| 4102 | LYM724 | foxtail_millet\|11v3\|PHY7SI026197M_P1 | 7623 | 667 | 83.5 | globlastp |
| 4103 | LYM724 | barley\|10v2\|AV836613_P1 | 7624 | 667 | 83 | globlastp |
| 4104 | LYM724 | rye\|12v1\|BE496211_T1 | 7625 | 667 | 82.8 | glotblastn |
| 4105 | LYM724 | wheat\|10v2\|BE400523 | 7626 | 667 | 82.8 | globlastp |
| 4106 | LYM724 | rye\|12v1\|DRR001012.133023_P1 | 7627 | 667 | 82.4 | globlastp |
| 4107 | LYM724 | rye\|12v1\|DRR001012.301113_P1 | 7627 | 667 | 82.4 | globlastp |
| 4108 | LYM724 | rye\|12v1\|DRR001012.119583_P1 | 7628 | 667 | 82.3 | globlastp |
| 4109 | LYM724 | sorghum\|09v1\|SB05G010000 | 7629 | 667 | 82.2 | globlastp |
| 4110 | LYM724 | sorghum\|12v1\|SB05G010000_P1 | 7629 | 667 | 82.2 | globlastp |
| 4111 | LYM724 | wheat\|10v2\|BE470969 | 7630 | 667 | 82.1 | globlastp |
| 4112 | LYM724 | wheat\|10v2\|BF482328 | 7631 | 667 | 81.4 | globlastp |
| 4113 | LYM725 | maize\|10v1\|AI734661_P1 | 7632 | 668 | 86.7 | globlastp |
| 4114 | LYM725 | foxtail_millet\|11v3\|PHY7SI025029M_P1 | 7633 | 668 | 84.6 | globlastp |
| 4115 | LYM725 | foxtail_millet\|10v2\|SICRP041430 | 7634 | 668 | 83.99 | glotblastn |
| 4116 | LYM726 | maize\|10v1\|AI947940_P1 | 7635 | 669 | 92.5 | globlastp |
| 4117 | LYM726 | foxtail_millet\|11v3\|PHY7SI024545M_P1 | 7636 | 669 | 89.6 | globlastp |
| 4118 | LYM726 | brachypodium\|12v1\|BRADI2G22320_T1 | 7637 | 669 | 80.23 | glotblastn |
| 4119 | LYM726 | rye\|12v1\|DRR001012.224605_P1 | 7638 | 669 | 80.2 | globlastp |
| 4120 | LYM727 | sorghum\|12v1\|SB09G026270_P1 | 7639 | 670 | 85.6 | globlastp |
| 4121 | LYM731 | maize\|10v1\|DV540487_P1 | 7640 | 674 | 89.2 | globlastp |
| 4122 | LYM731 | sugarcane\|10v1\|CA069954 | 7641 | 674 | 85.8 | globlastp |
| 4123 | LYM732 | maize\|10v1\|AI600558_P1 | 7642 | 675 | 88.2 | globlastp |
| 4124 | LYM732 | foxtail_millet\|11v3\|PHY7SI017313M_P1 | 7643 | 675 | 87.9 | globlastp |
| 4125 | LYM732 | sorghum\|09v1\|SB04G007170 | 7644 | 675 | 87.9 | globlastp |
| 4126 | LYM732 | sorghum\|12v1\|SB04G007170_P1 | 7644 | 675 | 87.9 | globlastp |
| 4127 | LYM732 | rice\|11v1\|BE040375_P1 | 7645 | 675 | 87.8 | globlastp |
| 4128 | LYM732 | rice\|gb170\|OS02G11050 | 7645 | 675 | 87.8 | globlastp |
| 4129 | LYM732 | switchgrass\|gb167\|FE612096 | 7646 | 675 | 87.8 | globlastp |
| 4130 | LYM732 | barley\|10v2\|BF624269_P1 | 7647 | 675 | 87.7 | globlastp |
| 4131 | LYM732 | maize\|10v1\|W49855_P1 | 7648 | 675 | 87.7 | globlastp |
| 4132 | LYM732 | switchgrass\|gb167\|FE641383 | 7649 | 675 | 87.7 | globlastp |
| 4133 | LYM732 | wheat\|10v2\|BE422591 | 7647 | 675 | 87.7 | globlastp |
| 4134 | LYM732 | wheat\|10v2\|BQ237242 | 7647 | 675 | 87.7 | globlastp |
| 4135 | LYM732 | rye\|12v1\|BE494211_P1 | 7650 | 675 | 87.6 | globlastp |
| 4136 | LYM732 | barley\|10v2\|BE421969XX1_P1 | 7651 | 675 | 87.6 | globlastp |
| 4137 | LYM732 | brachypodium\|09v1\|DV485498 | 7652 | 675 | 87.6 | globlastp |
| 4138 | LYM732 | brachypodium\|12v1\|BRADI3G07700_P1 | 7652 | 675 | 87.6 | globlastp |
| 4139 | LYM732 | leymus\|gb166\|EG389317_P1 | 7651 | 675 | 87.6 | globlastp |
| 4140 | LYM732 | millet\|10v1\|EVO454PM017118_P1 | 7653 | 675 | 87.6 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4141 | LYM732 | wheat\|10v2\|BE416312 | 7651 | 675 | 87.6 | globlastp |
| 4142 | LYM732 | rye\|12v1\|DRR001012.112840_P1 | 7654 | 675 | 87.5 | globlastp |
| 4143 | LYM732 | rye\|12v1\|DRR001012.134226_P1 | 7654 | 675 | 87.5 | globlastp |
| 4144 | LYM732 | pseudoroegneria\|gb167\|FF340342 | 7655 | 675 | 87.4 | globlastp |
| 4145 | LYM732 | wheat\|10v2\|CA620330 | 7656 | 675 | 87.4 | globlastp |
| 4146 | LYM732 | brachypodium\|12v1\|BRADHG36830_P1 | 7657 | 675 | 87 | globlastp |
| 4147 | LYM732 | oat\|10v2\|CN817787 | 7658 | 675 | 86.9 | globlastp |
| 4148 | LYM732 | oat\|11v1\|CN817787_P1 | 7658 | 675 | 86.9 | globlastp |
| 4149 | LYM732 | oat\|10v2\|GO582156 | 7659 | 675 | 86.9 | globlastp |
| 4150 | LYM732 | oat\|11v1\|GO582123_P1 | 7659 | 675 | 86.9 | globlastp |
| 4151 | LYM732 | phalaenopsis\|11v1\|CK858753_P1 | 7660 | 675 | 86 | globlastp |
| 4152 | LYM732 | phalaenopsis\|11v1\|SRR125771.1026916_P1 | 7661 | 675 | 86 | globlastp |
| 4153 | LYM732 | aristolochia\|10v1\|FD752980_P1 | 7662 | 675 | 86 | globlastp |
| 4154 | LYM732 | grape\|gb160\|CB004906 | 7663 | 675 | 86 | globlastp |
| 4155 | LYM732 | ambrosia\|11v1\|SRR346943.112590_P1 | 7664 | 675 | 85.7 | globlastp |
| 4156 | LYM732 | cotton\|11v1\|BE052760_P1 | 7665 | 675 | 85.7 | globlastp |
| 4157 | LYM732 | gossypium_raimondii\|12v1\|BE055647_P1 | 7666 | 675 | 85.7 | globlastp |
| 4158 | LYM732 | olea\|11v1\|SRR014463.16487_P1 | 7667 | 675 | 85.7 | globlastp |
| 4159 | LYM732 | platanus\|11v1\|SRR096786X101189_P1 | 7668 | 675 | 85.7 | globlastp |
| 4160 | LYM732 | cotton\|10v2\|BE055642 | 7666 | 675 | 85.7 | globlastp |
| 4161 | LYM732 | cotton\|11v1\|BE055642_P1 | 7666 | 675 | 85.7 | globlastp |
| 4162 | LYM732 | oak\|10v1\|FP030715_P1 | 7669 | 675 | 85.7 | globlastp |
| 4163 | LYM732 | amorphophallus\|11v2\|SRR089351X154410_P1 | 7670 | 675 | 85.6 | globlastp |
| 4164 | LYM732 | euonymus\|11v1\|SRR070038X108655_P1 | 7671 | 675 | 85.5 | globlastp |
| 4165 | LYM732 | gossypium_raimondii\|12v1\|BE052760_P1 | 7672 | 675 | 85.5 | globlastp |
| 4166 | LYM732 | grape\|11v1\|GSVIVT01017222001_P1 | 7673 | 675 | 85.5 | globlastp |
| 4167 | LYM732 | artemisia\|10v1\|EY035921_P1 | 7674 | 675 | 85.5 | globlastp |
| 4168 | LYM732 | cotton\|10v2\|BE052760 | 7672 | 675 | 85.5 | globlastp |
| 4169 | LYM732 | cotton\|11v1\|DT048786_P1 | 7672 | 675 | 85.5 | globlastp |
| 4170 | LYM732 | grape\|11v1\|GSVIVT01035767001_P1 | 7675 | 675 | 85.5 | globlastp |
| 4171 | LYM732 | grape\|gb160\|BQ796970 | 7675 | 675 | 85.5 | globlastp |
| 4172 | LYM732 | monkeyflower\|10v1\|GO973088_P1 | 7676 | 675 | 85.5 | globlastp |
| 4173 | LYM732 | prunus\|10v1\|BU039992 | 7677 | 675 | 85.5 | globlastp |
| 4174 | LYM732 | foxtail_millet\|11v3\|PHY7SI006523M_T1 | 7678 | 675 | 85.48 | globtblastn |
| 4175 | LYM732 | ambrosia\|11v1\|SRR346935.102367_P1 | 7679 | 675 | 85.3 | globlastp |
| 4176 | LYM732 | ambrosia\|11v1\|SRR346935.102836_P1 | 7679 | 675 | 85.3 | globlastp |
| 4177 | LYM732 | chelidonium\|11v1\|SRR084752X10130XX1_P1 | 7680 | 675 | 85.3 | globlastp |
| 4178 | LYM732 | tabernaemontana\|11v1\|SRR098689X102019_P1 | 7681 | 675 | 85.3 | globlastp |
| 4179 | LYM732 | utricularia\|11v1\|SRR094438.100168_P1 | 7682 | 675 | 85.3 | globlastp |
| 4180 | LYM732 | cassava\|09v1\|CK644652_P1 | 7683 | 675 | 85.3 | globlastp |
| 4181 | LYM732 | cassava\|09v1\|DR087232_P1 | 7684 | 675 | 85.3 | globlastp |
| 4182 | LYM732 | cotton\|11v1\|CO103563XX1_T1 | 7685 | 675 | 85.27 | globtblastn |
| 4183 | LYM732 | ipomoea_nil\|10v1\|BJ560298_T1 | 7686 | 675 | 85.24 | globtblastn |
| 4184 | LYM732 | apple\|11v1\|CN493163_P1 | 7687 | 675 | 85.2 | globlastp |
| 4185 | LYM732 | orobanche\|10v1\|SRR023189S0024830_P1 | 7688 | 675 | 85.2 | globlastp |
| 4186 | LYM732 | catharanthus\|11v1\|EG558267_P1 | 7689 | 675 | 85.1 | globlastp |
| 4187 | LYM732 | citrus\|gb166\|CB611197 | 7690 | 675 | 85.04 | globtblastn |
| 4188 | LYM732 | apple\|11v1\|CN890053_P1 | 7691 | 675 | 85 | globlastp |
| 4189 | LYM732 | cannabis\|12v1\|JK495288_P1 | 7692 | 675 | 85 | globlastp |
| 4190 | LYM732 | flaveria\|11v1\|SRR149229.100470_P1 | 7693 | 675 | 85 | globlastp |
| 4191 | LYM732 | flaveria\|11v1\|SRR149229.126130_P1 | 7693 | 675 | 85 | globlastp |
| 4192 | LYM732 | flaveria\|11v1\|SRR149232.108448_P1 | 7693 | 675 | 85 | globlastp |
| 4193 | LYM732 | gossypium_raimondii\|12v1\|AI727523_P1 | 7694 | 675 | 85 | globlastp |
| 4194 | LYM732 | phyla\|11v2\|SRR099035X100142_P1 | 7695 | 675 | 85 | globlastp |
| 4195 | LYM732 | platanus\|11v1\|SRR096786X101928_P1 | 7696 | 675 | 85 | globlastp |
| 4196 | LYM732 | trigonella\|11v1\|SRR066194X106107_P1 | 7697 | 675 | 85 | globlastp |
| 4197 | LYM732 | centaurea\|gb166\|EH726046_P1 | 7698 | 675 | 85 | globlastp |
| 4198 | LYM732 | clementine\|11v1\|CB611197_P1 | 7699 | 675 | 85 | globlastp |
| 4199 | LYM732 | lotus\|09v1\|LLB1418881_P1 | 7700 | 675 | 85 | globlastp |
| 4200 | LYM732 | millet\|10v1\|EVO454PM005100_P1 | 7701 | 675 | 85 | globlastp |
| 4201 | LYM732 | monkeyflower\|10v1\|GO982695_P1 | 7702 | 675 | 85 | globlastp |
| 4202 | LYM732 | nasturtium\|10v1\|SRR032558S0002899 | 7703 | 675 | 85 | globlastp |
| 4203 | LYM732 | nasturtium\|11v1\|SRR032558.102915_P1 | 7703 | 675 | 85 | globlastp |
| 4204 | LYM732 | orange\|11v1\|CB611197_P1 | 7699 | 675 | 85 | globlastp |
| 4205 | LYM732 | nasturtium\|10v1\|GH168766 | 7704 | 675 | 84.9 | globlastp |
| 4206 | LYM732 | nasturtium\|11v1\|GH168766_P1 | 7704 | 675 | 84.9 | globlastp |
| 4207 | LYM732 | arnica\|11v1\|SRR099034X108350_P1 | 7705 | 675 | 84.8 | globlastp |
| 4208 | LYM732 | canola\|11v1\|CN725971_T1 | 7706 | 675 | 84.8 | globtblastn |
| 4209 | LYM732 | canola\|11v1\|EE436954_P1 | 7707 | 675 | 84.8 | globlastp |
| 4210 | LYM732 | canola\|11v1\|EE476649_P1 | 7708 | 675 | 84.8 | globlastp |
| 4211 | LYM732 | chickpea\|11v1\|FE671678_P1 | 7709 | 675 | 84.8 | globlastp |
| 4212 | LYM732 | flaveria\|11v1\|SRR149229.122029_P1 | 7710 | 675 | 84.8 | globlastp |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4213 | LYM732 | phyla\|11v2\|SRR099037X106234_P1 | 7711 | 675 | 84.8 | globlastp |
| 4214 | LYM732 | sunflower\|12v1\|CD845885_P1 | 7712 | 675 | 84.8 | globlastp |
| 4215 | LYM732 | vinca\|11v1\|SRR098690X124323_P1 | 7713 | 675 | 84.8 | globlastp |
| 4216 | LYM732 | watermelon\|11v1\|DV632112_P1 | 7714 | 675 | 84.8 | globlastp |
| 4217 | LYM732 | arabidopsis\|10v1\|AT5G19990_P1 | 7715 | 675 | 84.8 | globlastp |
| 4218 | LYM732 | b_oleracea\|gb161\|AM385131_P1 | 7716 | 675 | 84.8 | globlastp |
| 4219 | LYM732 | b_rapa\|gb162\|CV433791 | 7708 | 675 | 84.8 | globlastp |
| 4220 | LYM732 | banana\|10v1\|AY463021_T1 | 7717 | 675 | 84.8 | glotblastn |
| 4221 | LYM732 | canola\|10v1\|CD815847 | 7718 | 675 | 84.8 | globlastp |
| 4222 | LYM732 | canola\|11v1\|EE452913_P1 | 7718 | 675 | 84.8 | globlastp |
| 4223 | LYM732 | cotton\|10v2\|AI727523 | 7719 | 675 | 84.8 | globlastp |
| 4224 | LYM732 | cotton\|11v1\|AI727523_P1 | 7719 | 675 | 84.8 | globlastp |
| 4225 | LYM732 | medicago\|09v1\|LLAA660628 | 7720 | 675 | 84.8 | globlastp |
| 4226 | LYM732 | medicago\|12v1\|AA660628_P1 | 7720 | 675 | 84.8 | globlastp |
| 4227 | LYM732 | melon\|10v1\|DV632112_P1 | 7721 | 675 | 84.8 | globlastp |
| 4228 | LYM732 | melon\|10v1\|DV633274_T1 | 7722 | 675 | 84.8 | glotblastn |
| 4229 | LYM732 | poplar\|10v1\|BU825403_P1 | 7723 | 675 | 84.8 | globlastp |
| 4230 | LYM732 | momordica\|10v1\|SRR071315S0011108_T1 | 7724 | 675 | 84.76 | glotblastn |
| 4231 | LYM732 | amsonia\|11v1\|SRR098688X10079_P1 | 7725 | 675 | 84.6 | globlastp |
| 4232 | LYM732 | amsonia\|11v1\|SRR098688X111547_P1 | 7726 | 675 | 84.6 | globlastp |
| 4233 | LYM732 | arnica\|11v1\|SRR099034X108322_P1 | 7727 | 675 | 84.6 | globlastp |
| 4234 | LYM732 | cirsium\|11v1\|SRR346952.1011032XX1_P1 | 7728 | 675 | 84.6 | globlastp |
| 4235 | LYM732 | sunflower\|12v1\|CF097925_P1 | 7729 | 675 | 84.6 | globlastp |
| 4236 | LYM732 | watermelon\|11v1\|DV633274_P1 | 7730 | 675 | 84.6 | globlastp |
| 4237 | LYM732 | arabidopsis\|10v1\|AT5G20000_P1 | 7731 | 675 | 84.6 | globlastp |
| 4238 | LYM732 | b_rapa\|11v1\|CD815847_P1 | 7732 | 675 | 84.6 | globlastp |
| 4239 | LYM732 | b_rapa\|gb162\|CV544357 | 7732 | 675 | 84.6 | globlastp |
| 4240 | LYM732 | cucumber\|09v1\|DN910444_P1 | 7733 | 675 | 84.6 | globlastp |
| 4241 | LYM732 | cucumber\|09v1\|DV633274_P1 | 7734 | 675 | 84.6 | globlastp |
| 4242 | LYM732 | eschscholzia\|11v1\|CD480449_P1 | 7735 | 675 | 84.5 | globlastp |
| 4243 | LYM732 | eucalyptus\|11v2\|CD668547_P1 | 7736 | 675 | 84.5 | globlastp |
| 4244 | LYM732 | euphorbia\|11v1\|SRR098678X106410_P1 | 7737 | 675 | 84.5 | globlastp |
| 4245 | LYM732 | pigeonpea\|11v1\|SRR054580X100279_P1 | 7738 | 675 | 84.5 | globlastp |
| 4246 | LYM732 | cichorium\|gb171\|DT212089_P1 | 7739 | 675 | 84.5 | globlastp |
| 4247 | LYM732 | coffea\|10v1\|CF588948_P1 | 7740 | 675 | 84.5 | globlastp |
| 4248 | LYM732 | potato\|10v1\|BF459871_P1 | 7741 | 675 | 84.5 | globlastp |
| 4249 | LYM732 | rice\|11v1\|BM420871_P1 | 7742 | 675 | 84.5 | globlastp |
| 4250 | LYM732 | rice\|gb170\|OS06G39870 | 7742 | 675 | 84.5 | globlastp |
| 4251 | LYM732 | solanum_phureja\|09v1\|SPHBG130427 | 7741 | 675 | 84.5 | globlastp |
| 4252 | LYM732 | soybean\|11v1\|GLYMA08G24000 | 7743 | 675 | 84.5 | globlastp |
| 4253 | LYM732 | sugarcane\|10v1\|BU102866 | 7744 | 675 | 84.5 | globlastp |
| 4254 | LYM732 | triphysaria\|10v1\|CB815068 | 7745 | 675 | 84.5 | globlastp |
| 4255 | LYM732 | canola\|11v1\|CN828972_P1 | 7746 | 675 | 84.4 | globlastp |
| 4256 | LYM732 | canola\|11v1\|EE479032_P1 | 7747 | 675 | 84.4 | globlastp |
| 4257 | LYM732 | cirsium\|11v1\|SRR346952.103555_P1 | 7748 | 675 | 84.4 | globlastp |
| 4258 | LYM732 | rose\|12v1\|BI978986_P1 | 7749 | 675 | 84.4 | globlastp |
| 4259 | LYM732 | sunflower\|12v1\|CF098017_P1 | 7750 | 675 | 84.4 | globlastp |
| 4260 | LYM732 | b_rapa\|11v1\|CD817817_P1 | 7751 | 675 | 84.4 | globlastp |
| 4261 | LYM732 | b_rapa\|gb162\|CX273134 | 7747 | 675 | 84.4 | globlastp |
| 4262 | LYM732 | radish\|gb164\|EV527043 | 7752 | 675 | 84.4 | globlastp |
| 4263 | LYM732 | radish\|gb164\|EV566516 | 7753 | 675 | 84.4 | globlastp |
| 4264 | LYM732 | cotton\|11v1\|CO082793_P1 | 7754 | 675 | 84.3 | globlastp |
| 4265 | LYM732 | poppy\|11v1\|SRR030259.110320_P1 | 7755 | 675 | 84.3 | globlastp |
| 4266 | LYM732 | beech\|11v1\|AJ251819_P1 | 7756 | 675 | 84.3 | globlastp |
| 4267 | LYM732 | tomato\|11v1\|BG629755_P1 | 7757 | 675 | 84.3 | globlastp |
| 4268 | LYM732 | cucurbita\|11v1\|SRR091276X104784_T1 | 7758 | 675 | 84.29 | glotblastn |
| 4269 | LYM732 | centaurea\|gb166\|EH714022_P1 | 7759 | 675 | 84.2 | globlastp |
| 4270 | LYM732 | tragopogon\|10v1\|SRR020205S0013091 | 7760 | 675 | 84.16 | glotblastn |
| 4271 | LYM732 | sunflower\|12v1\|DY922301_T1 | 7761 | 675 | 84.12 | glotblastn |
| 4272 | LYM732 | aquilegia\|10v1\|DR912932_P1 | 7762 | 675 | 84.1 | globlastp |
| 4273 | LYM732 | thellungiella_halophilum\|11v1\|DN773759_P1 | 7763 | 675 | 84.1 | globlastp |
| 4274 | LYM732 | b_rapa\|11v1\|CD813845_P1 | 7764 | 675 | 84.1 | globlastp |
| 4275 | LYM732 | strawberry\|11v1\|CO381023 | 7765 | 675 | 84.1 | globlastp |
| 4276 | LYM732 | cichorium\|gb171\|EH701464_T1 | 7766 | 675 | 84.09 | glotblastn |
| 4277 | LYM732 | eschscholzia\|11v1\|CD481664_P1 | 7767 | 675 | 84 | globlastp |
| 4278 | LYM732 | poplar\|10v1\|BI120145_P1 | 7768 | 675 | 84 | globlastp |
| 4279 | LYM732 | soybean\|11v1\|GLYMA07G00420 | 7769 | 675 | 84 | globlastp |
| 4280 | LYM732 | flaveria\|11v1\|SRR149232.14242_P1 | 7770 | 675 | 83.9 | globlastp |
| 4281 | LYM732 | vinca\|11v1\|SRR098690X117569 | 7771 | 675 | 83.85 | glotblastn |
| 4282 | LYM732 | ambrosia\|11v1\|SRR346935.120689_P1 | 7772 | 675 | 83.8 | globlastp |
| 4283 | LYM732 | distylium\|11v1\|SRR065077X10332_P1 | 7773 | 675 | 83.8 | globlastp |
| 4284 | LYM732 | valeriana\|11v1\|SRR099039X102285_P1 | 7774 | 675 | 83.8 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4285 | LYM732 | aquilegia\|10v2\|DR912932 | 7775 | 675 | 83.8 | globlastp |
| 4286 | LYM732 | bean\|12v1\|CA905844_P1 | 7776 | 675 | 83.8 | globlastp |
| 4287 | LYM732 | bean\|gb167\|CA905844 | 7776 | 675 | 83.8 | globlastp |
| 4288 | LYM732 | fescue\|gb161\|DT683905_P1 | 7777 | 675 | 83.8 | globlastp |
| 4289 | LYM732 | peanut\|10v1\|EE124392_P1 | 7778 | 675 | 83.8 | globlastp |
| 4290 | LYM732 | plantago\|11v2\|SRR066373X111867_T1 | 7779 | 675 | 83.76 | glotblastn |
| 4291 | LYM732 | cephalotaxus\|11v1\|SRR064395X111026_P1 | 7780 | 675 | 83.7 | globlastp |
| 4292 | LYM732 | vinca\|11v1\|SRR098690X111800_P1 | 7781 | 675 | 83.7 | globlastp |
| 4293 | LYM732 | tomato\|09v1\|BG130427 | 7782 | 675 | 83.7 | globlastp |
| 4294 | LYM732 | tomato\|11v1\|BG130427_P1 | 7782 | 675 | 83.7 | globlastp |
| 4295 | LYM732 | amborella\|12v2\|FD426294_P1 | 7783 | 675 | 83.6 | globlastp |
| 4296 | LYM732 | amborella\|12v2\|FD432605_P1 | 7784 | 675 | 83.6 | globlastp |
| 4297 | LYM732 | cephalotaxus\|11v1\|SRR064395X14548_P1 | 7785 | 675 | 83.6 | globlastp |
| 4298 | LYM732 | oil_palm\|11v1\|EE593289_P1 | 7786 | 675 | 83.6 | globlastp |
| 4299 | LYM732 | brachypodium\|09v1\|DV469847 | 7787 | 675 | 83.41 | glotblastn |
| 4300 | LYM732 | maritime_pine\|10v1\|CT574903_P1 | 7788 | 675 | 83.4 | globlastp |
| 4301 | LYM732 | pine\|10v2\|AI813002_P1 | 7788 | 675 | 83.4 | globlastp |
| 4302 | LYM732 | pine\|10v2\|AW009983_P1 | 7788 | 675 | 83.4 | globlastp |
| 4303 | LYM732 | pine\|10v2\|DR072525_P1 | 7788 | 675 | 83.4 | globlastp |
| 4304 | LYM732 | zostera\|10v1\|AM770544 | 7789 | 675 | 83.4 | globlastp |
| 4305 | LYM732 | ambrosia\|11v1\|SRR346943.101350_T1 | 7790 | 675 | 83.33 | glotblastn |
| 4306 | LYM732 | cowpea\|gb166\|FF388322_P1 | 7791 | 675 | 83.3 | globlastp |
| 4307 | LYM732 | gnetum\|10v1\|SRR064399S0017610_P1 | 7792 | 675 | 83.3 | globlastp |
| 4308 | LYM732 | marchantia\|gb166\|BJ852337_P1 | 7793 | 675 | 83.3 | globlastp |
| 4309 | LYM732 | taxus\|10v1\|SRR032523S0001172 | 7794 | 675 | 83.3 | globlastp |
| 4310 | LYM732 | ambrosia\|11v1\|SRR346935.103060_T1 | 7795 | 675 | 83.1 | globlastp |
| 4311 | LYM732 | cedrus\|11v1\|SRR065007X103547_P1 | 7796 | 675 | 83.1 | globlastp |
| 4312 | LYM732 | fraxinus\|11v1\|SRR058827.12308_T1 | 7797 | 675 | 83.1 | glotblastn |
| 4313 | LYM732 | zostera\|10v1\|SRR057351S0018576 | 7798 | 675 | 83.1 | globlastp |
| 4314 | LYM732 | beet\|12v1\|BI096091_P1 | 7799 | 675 | 83 | globlastp |
| 4315 | LYM732 | ceratodon\|10v1\|AW086694_P1 | 7800 | 675 | 82.9 | globlastp |
| 4316 | LYM732 | podocarpus\|10v1\|SRR065014S0003863_P1 | 7801 | 675 | 82.9 | globlastp |
| 4317 | LYM732 | artemisia\|10v1\|EY114257_P1 | 7802 | 675 | 82.8 | globlastp |
| 4318 | LYM732 | ambrosia\|11v1\|SRR346935.427394_P1 | 7803 | 675 | 82.6 | globlastp |
| 4319 | LYM732 | ambrosia\|11v1\|SRR346943.171955_P1 | 7804 | 675 | 82.6 | globlastp |
| 4320 | LYM732 | nuphar\|gb166\|CD473821_P1 | 7805 | 675 | 82.6 | globlastp |
| 4321 | LYM732 | beech\|gb170\|AJ251819 | 7806 | 675 | 82.51 | glotblastn |
| 4322 | LYM732 | beet\|12v1\|BQ490531_P1 | 7807 | 675 | 82.3 | globlastp |
| 4323 | LYM732 | amborella\|gb166\|FD426360 | 7808 | 675 | 82.1 | globlastp |
| 4324 | LYM732 | rye\|12v1\|DRR001013.288275_T1 | 7809 | 675 | 81.82 | glotblastn |
| 4325 | LYM732 | abies\|11v2\|SRR098676X104019_P1 | 7810 | 675 | 81.8 | globlastp |
| 4326 | LYM732 | silene\|11v1\|GH292895_P1 | 7811 | 675 | 81.8 | globlastp |
| 4327 | LYM732 | pseudotsuga\|10v1\|SRR065119SO001943 | 7812 | 675 | 81.8 | globlastp |
| 4328 | LYM732 | sciadopitys\|10v1\|SRR065035S0039368 | 7813 | 675 | 81.8 | globlastp |
| 4329 | LYM732 | chickpea\|11v1\|SRR133517.110130_P1 | 7814 | 675 | 81.7 | globlastp |
| 4330 | LYM732 | physcomitrella\|10v1\|BY960531_P1 | 7815 | 675 | 81.7 | globlastp |
| 4331 | LYM732 | flaveria\|11v1\|SRR149229.147122_T1 | 7816 | 675 | 81.52 | glotblastn |
| 4332 | LYM732 | arabidopsis_lyrata\|09v1\|JGIAL021741_T1 | 7817 | 675 | 81.52 | glotblastn |
| 4333 | LYM732 | poppy\|11v1\|FG610521_P1 | 7818 | 675 | 81.5 | globlastp |
| 4334 | LYM732 | cryptomeria\|gb166\|BP175599_P1 | 7819 | 675 | 81.5 | globlastp |
| 4335 | LYM732 | kiwi\|gb166\|FG406821_P1 | 7820 | 675 | 81.5 | globlastp |
| 4336 | LYM732 | cycas\|gb166\|CB088913_P1 | 7821 | 675 | 81.2 | globlastp |
| 4337 | LYM732 | spikemoss\|gb165\|FE446127 | 7822 | 675 | 81.2 | globlastp |
| 4338 | LYM732 | spikemoss\|gb165\|FE449444 | 7823 | 675 | 81.2 | globlastp |
| 4339 | LYM732 | solanum_phureja\|09v1\|SPHBG132493 | 7824 | 675 | 81.1 | globlastp |
| 4340 | LYM732 | spruce\|11v1\|AF051251_P1 | 7825 | 675 | 80.8 | globlastp |
| 4341 | LYM732 | spruce\|gb162\|AF051251 | 7825 | 675 | 80.8 | globlastp |
| 4342 | LYM732 | tomato\|09v1\|BG629755 | 7826 | 675 | 80.8 | globlastp |
| 4343 | LYM732 | euphorbia\|11v1\|SRR098678X139562_T1 | 7827 | 675 | 80.71 | glotblastn |
| 4344 | LYM732 | humulus\|11v1\|FG346179_P1 | 7828 | 675 | 80.5 | globlastp |
| 4345 | LYM732 | pteridium\|11v1\|GW574939_P1 | 7829 | 675 | 80.5 | globlastp |
| 4346 | LYM732 | sequoia\|10v1\|SRR065044S0002707 | 7830 | 675 | 80.5 | globlastp |
| 4347 | LYM732 | silene\|11v1\|SRR096785X140908_P1 | 7831 | 675 | 80.3 | globlastp |
| 4348 | LYM732 | poppy\|11v1\|SRR030259.288771_T1 | 7832 | 675 | 80 | glotblastn |
| 4349 | LYM734 | maize\|10v1\|CF003105_P1 | 7833 | 677 | 95.4 | globlastp |
| 4350 | LYM734 | maize\|10v1\|DW835384_P1 | 7834 | 677 | 91.6 | globlastp |
| 4351 | LYM734 | foxtail_millet\|11v3\|PHY7SI030285M_P1 | 7835 | 677 | 87.9 | globlastp |
| 4352 | LYM734 | brachypodium\|12v1\|BRADI1G23510_P1 | 7836 | 677 | 85.7 | globlastp |
| 4353 | LYM734 | switchgrass\|gb167\|DN141284_T1 | 7837 | 677 | 83.11 | glotblastn |
| 4354 | LYM734 | rye\|12v1\|BE588050_P1 | 7838 | 677 | 83.1 | globlastp |
| 4355 | LYM734 | rice\|11v1\|BQ908579_P1 | 7839 | 677 | 83 | globlastp |
| 4356 | LYM734 | wheat\|10v2\|CA601486_P1 | 7840 | 677 | 82.5 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4357 | LYM735 | wheat\|10v2\|BE404166 | 7841 | 678 | 96.77 | glotblastn |
| 4358 | LYM735 | b_rapa\|11v1\|BRARAPRD100942_T1 | 7842 | 678 | 95.31 | glotblastn |
| 4359 | LYM735 | b_rapa\|11v1\|SOLX00075735_T1 | 7843 | 678 | 95.31 | glotblastn |
| 4360 | LYM736 | rye\|12v1\|DRR001012.109929_P1 | 679 | 679 | 100 | globlastp |
| 4361 | LYM736 | pseudoroegneria\|gb167\|FF340042 | 679 | 679 | 100 | globlastp |
| 4362 | LYM736 | rye\|12v1\|BE495770_P1 | 7844 | 679 | 99.3 | globlastp |
| 4363 | LYM736 | leymus\|gb166\|CD809029_P1 | 7845 | 679 | 99.3 | globlastp |
| 4364 | LYM736 | rye\|gb164\|BE495770 | 7846 | 679 | 98.6 | globlastp |
| 4365 | LYM736 | oat\|11v1\|CN817222_P1 | 7847 | 679 | 91.7 | globlastp |
| 4366 | LYM736 | oat\|10v2\|CN817222 | 7847 | 679 | 91.7 | globlastp |
| 4367 | LYM736 | oat\|11v1\|CN817582_P1 | 7847 | 679 | 91.7 | globlastp |
| 4368 | LYM736 | fescue\|gb161\|CK800822_P1 | 7848 | 679 | 91 | globlastp |
| 4369 | LYM736 | lolium\|10v1\|AU246424_P1 | 7849 | 679 | 91 | globlastp |
| 4370 | LYM739 | rye\|12v1\|DRR001012.179917_P1 | 7850 | 681 | 99.2 | globlastp |
| 4371 | LYM739 | rye\|12v1\|DRR001012.341099_P1 | 7851 | 681 | 98.5 | globlastp |
| 4372 | LYM739 | rye\|12v1\|DRR001012.439165_P1 | 7852 | 681 | 97.7 | globlastp |
| 4373 | LYM739 | barley\|10v2\|BE602109_P1 | 7853 | 681 | 96.9 | globlastp |
| 4374 | LYM739 | pseudoroegneria\|gb167\|FF350119 | 7854 | 681 | 96.2 | globlastp |
| 4375 | LYM739 | oat\|10v2\|GO596443 | 7855 | 681 | 93.13 | glotblastn |
| 4376 | LYM739 | oat\|11v1\|GO596443_T1 | 7856 | 681 | 88.55 | glotblastn |
| 4377 | LYM739 | brachypodium\|09v1\|GT765667 | 7857 | 681 | 87.8 | globlastp |
| 4378 | LYM739 | brachypodium\|12v1\|BRADI4G35390_P1 | 7857 | 681 | 87.8 | globlastp |
| 4379 | LYM739 | rye\|gb164\|BE705354 | 7858 | 681 | 83.97 | glotblastn |
| 4380 | LYM739 | cynodon\|10v1\|ES300861_P1 | 7859 | 681 | 80.9 | globlastp |
| 4381 | LYM739 | rice\|11v1\|AU097200_P1 | 7860 | 681 | 80.9 | globlastp |
| 4382 | LYM739 | rice\|gb170\|OS09G34850 | 7860 | 681 | 80.9 | globlastp |
| 4383 | LYM740 | rye\|12v1\|DRR001012.212513_P1 | 7861 | 682 | 89.1 | globlastp |
| 4384 | LYM740 | rye\|12v1\|DRR001012.117478_P1 | 7862 | 682 | 82.1 | globlastp |
| 4385 | LYM741 | wheat\|10v2\|BM134749 | 7863 | 683 | 97.7 | globlastp |
| 4386 | LYM741 | rye\|12v1\|DRR001012.383108_T1 | 7864 | 683 | 91.09 | glotblastn |
| 4387 | LYM741 | rye\|12v1\|DRR001012.402448_T1 | 7865 | 683 | 89.94 | glotblastn |
| 4388 | LYM741 | brachypodium\|12v1\|BRADI3G02730_P1 | 7866 | 683 | 89.1 | globlastp |
| 4389 | LYM741 | brachypodium\|09v1\|GT765922 | 7866 | 683 | 89.1 | globlastp |
| 4390 | LYM742 | leymus\|gb166\|EG389023_P1 | 7867 | 684 | 97.5 | globlastp |
| 4391 | LYM742 | wheat\|10v2\|BM134693 | 7868 | 684 | 96.8 | globlastp |
| 4392 | LYM742 | wheat\|10v2\|BE498269 | 7869 | 684 | 96.5 | globlastp |
| 4393 | LYM742 | rye\|12v1\|DRR001012.110932_P1 | 7870 | 684 | 96.2 | globlastp |
| 4394 | LYM742 | wheat\|10v2\|BE499790 | 7871 | 684 | 95.9 | globlastp |
| 4395 | LYM742 | rye\|12v1\|BE705529_P1 | 7872 | 684 | 95.6 | globlastp |
| 4396 | LYM742 | pseudoroegneria\|gb167\|FF346294 | 7873 | 684 | 95.6 | globlastp |
| 4397 | LYM742 | oat\|10v2\|GO588827 | 7874 | 684 | 89.7 | globlastp |
| 4398 | LYM742 | oat\|11v1\|GO588827_P1 | 7874 | 684 | 89.7 | globlastp |
| 4399 | LYM742 | brachypodium\|09v1\|DV478227 | 7875 | 684 | 88.1 | globlastp |
| 4400 | LYM742 | brachypodium\|12v1\|BRADI1G02960_P1 | 7875 | 684 | 88.1 | globlastp |
| 4401 | LYM743 | barley\|10v2\|BI959370_P1 | 7876 | 685 | 90.4 | globlastp |
| 4402 | LYM743 | rye\|12v1\|DRR001012.316165_P1 | 7877 | 685 | 87.7 | globlastp |
| 4403 | LYM743 | wheat\|10v2\|BE425228 | 7878 | 685 | 87.7 | globlastp |
| 4404 | LYM743 | oat\|10v2\|SRR020741S0038528 | 7879 | 685 | 85.77 | glotblastn |
| 4405 | LYM743 | oat\|11v1\|SRR020741.119245_T1 | 7880 | 685 | 85.77 | glotblastn |
| 4406 | LYM745 | sugarcane\|10v1\|CA167334_T1 | 7881 | 687 | 99.63 | glotblastn |
| 4407 | LYM745 | sorghum\|12v1\|GFXNC008602X25_P1 | 7882 | 687 | 98.9 | globlastp |
| 4408 | LYM745 | maize\|10v1\|AI065541_T1 | 7883 | 687 | 98.53 | glotblastn |
| 4409 | LYM745 | foxtail_millet\|11v3\|SICRP015276_T1 | — | 687 | 98.17 | glotblastn |
| 4410 | LYM745 | lolium\|10v1\|GFXAM777385X23_T1 | 7884 | 687 | 97.8 | glotblastn |
| 4411 | LYM745 | barley\|10v2\|BE437649_P1 | 7885 | 687 | 97.8 | globlastp |
| 4412 | LYM745 | wheat\|10v2\|CA593542 | 7885 | 687 | 97.8 | globlastp |
| 4413 | LYM745 | rye\|12v1\|GFXAY115960X1_T1 | — | 687 | 97.8 | glotblastn |
| 4414 | LYM745 | brachypodium\|12v1\|BDPRD12V1004106_T1 | 7886 | 687 | 97.44 | glotblastn |
| 4415 | LYM745 | brachypodium\|12v1\|BRADI4G08053_T1 | — | 687 | 97.44 | glotblastn |
| 4416 | LYM745 | rice\|gb170\|OS04G16772 | 7887 | 687 | 97.4 | globlastp |
| 4417 | LYM745 | rice\|gb170\|OS08G15262 | 7888 | 687 | 97.4 | globlastp |
| 4418 | LYM745 | rice\|11v1\|GFXRICCPRPMX1_P1 | 7887 | 687 | 97.4 | globlastp |
| 4419 | LYM745 | rice\|gb170\|OS10G21354 | 7889 | 687 | 97.07 | globlastp |
| 4420 | LYM745 | rice\|11v1\|OSPRD098636_T1 | — | 687 | 97.07 | glotblastn |
| 4421 | LYM745 | sorghum\|12v1\|SB0506S002020_P1 | 7890 | 687 | 96.8 | globlastp |
| 4422 | LYM745 | rice\|11v1\|OSCRP026632_T1 | — | 687 | 96.7 | glotblastn |
| 4423 | LYM745 | maize\|10v1\|BI245198_T1 | 7891 | 687 | 96.45 | glotblastn |
| 4424 | LYM745 | brachypodium\|12v1\|BRADI1G05800_P1 | 7892 | 687 | 95.7 | globlastp |
| 4425 | LYM745 | rice\|11v1\|CB619074_T1 | — | 687 | 94.68 | glotblastn |
| 4426 | LYM745 | rice\|11v1\|CB662204_T1 | — | 687 | 94.68 | glotblastn |
| 4427 | LYM745 | brachypodium\|09v1\|GFXEU325680X23 | 7893 | 687 | 94.33 | glotblastn |
| 4428 | LYM745 | brachypodium\|12v1\|BDCRP12V1063443_T1 | — | 687 | 94.33 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4429 | LYM745 | rice\|11v1\|OSCRP021034_T1 | — | 687 | 94.33 | glotblastn |
| 4430 | LYM745 | brachypodium\|12v1\|SOLX00008440_T1 | — | 687 | 94.33 | glotblastn |
| 4431 | LYM745 | pseudoroegneria\|gb167\|FF350971_T1 | 7894 | 687 | 93.41 | glotblastn |
| 4432 | LYM745 | rice\|11v1\|CA766685_P1 | 7895 | 687 | 93 | globlastp |
| 4433 | LYM745 | brachypodium\|12v1\|BDCRP12V1040005_P1 | 7896 | 687 | 92.7 | globlastp |
| 4434 | LYM745 | rice\|11v1\|OSCRP099684_P1 | 7897 | 687 | 92.6 | globlastp |
| 4435 | LYM745 | oil_palm\|11v1\|GFXEU016904X1_T1 | 7898 | 687 | 91.58 | glotblastn |
| 4436 | LYM745 | amorphophallus\|11v2\|SRR089351X115215_T1 | 7899 | 687 | 90.84 | glotblastn |
| 4437 | LYM745 | oil_palm\|11v1\|CN601318XX1_P1 | 7900 | 687 | 90.5 | globlastp |
| 4438 | LYM745 | rice\|11v1\|OSCRP155559_P1 | 7901 | 687 | 89.9 | globlastp |
| 4439 | LYM745 | amborella\|12v2\|FD428869_T1 | — | 687 | 89.89 | glotblastn |
| 4440 | LYM745 | arabidopsis\|10v1\|ATCG00740_T1 | 7902 | 687 | 89.74 | glotblastn |
| 4441 | LYM745 | banana\|10v1\|GFXEU017004X1_T1 | 7903 | 687 | 89.74 | glotblastn |
| 4442 | LYM745 | tabernaemontana\|11v1\|SRR098689X10070_T1 | — | 687 | 89.38 | glotblastn |
| 4443 | LYM745 | vinca\|11v1\|SRR098690X100243XX2_T1 | — | 687 | 89.38 | glotblastn |
| 4444 | LYM745 | gossypium_raimondii\|12v1\|BF276612_P1 | 7904 | 687 | 89.1 | globlastp |
| 4445 | LYM745 | gossypium_raimondii\|12v1\|DT460790_P1 | 7904 | 687 | 89.1 | globlastp |
| 4446 | LYM745 | gossypium_raimondii\|12v1\|SRR391534.857701_P1 | 7904 | 687 | 89.1 | globlastp |
| 4447 | LYM745 | petunia\|gb171\|CV300349_P1 | 7905 | 687 | 89.1 | globlastp |
| 4448 | LYM745 | potato\|10v1\|BE922679_P1 | 7906 | 687 | 89.1 | globlastp |
| 4449 | LYM745 | solanum_phureja\|09v1\|SPHBG134352_P1 | 7906 | 687 | 89.1 | globlastp |
| 4450 | LYM745 | tobacco\|gb162\|CN949757_P1 | 7907 | 687 | 89.1 | globlastp |
| 4451 | LYM745 | poppy\|11v1\|FG598695XX1_T1 | 7908 | 687 | 89.05 | glotblastn |
| 4452 | LYM745 | catharanthus\|11v1\|SRR098691X100542_P1 | 7909 | 687 | 88.7 | globlastp |
| 4453 | LYM745 | eggplant\|10v1\|FS001598_P1 | 7910 | 687 | 88.7 | globlastp |
| 4454 | LYM745 | grape\|11v1\|GSVIVT01023979001_P1 | 7911 | 687 | 88.7 | globlastp |
| 4455 | LYM745 | heritiera\|10v1\|SRR005794S0008515_P1 | 7912 | 687 | 88.7 | globlastp |
| 4456 | LYM745 | radish\|gb164\|EV526012_P1 | 7913 | 687 | 88.7 | globlastp |
| 4457 | LYM745 | cucumber\|09v1\|GFXAJ970307X24_P1 | 7914 | 687 | 88.3 | globlastp |
| 4458 | LYM745 | ginseng\|10v1\|GFXAY582139X24_P1 | 7915 | 687 | 88.3 | globlastp |
| 4459 | LYM745 | poppy\|11v1\|SRR030259.152815_P1 | 7916 | 687 | 88.3 | globlastp |
| 4460 | LYM745 | silene\|11v1\|GFXAB189069X7_T1 | 7917 | 687 | 88.28 | glotblastn |
| 4461 | LYM745 | canola\|11v1\|DY010946XX1_T1 | — | 687 | 88.28 | glotblastn |
| 4462 | LYM745 | arabidopsis_lyrata\|09v1\|JGIAL003215_T1 | 7918 | 687 | 88.09 | glotblastn |
| 4463 | LYM745 | antirrhinum\|gb166\|AJ558610_P1 | 7919 | 687 | 88 | globlastp |
| 4464 | LYM745 | apple\|11v1\|CN857372_T1 | 7920 | 687 | 87.91 | glotblastn |
| 4465 | LYM745 | ambrosia\|11v1\|SRR346935.101008_T1 | — | 687 | 87.91 | glotblastn |
| 4466 | LYM745 | grape\|11v1\|BQ792705_T1 | — | 687 | 87.73 | glotblastn |
| 4467 | LYM745 | guizotia\|10v1\|GE552365_P1 | 7921 | 687 | 87.6 | globlastp |
| 4468 | LYM745 | euphorbia\|11v1\|DV143422_T1 | 7922 | 687 | 87.55 | glotblastn |
| 4469 | LYM745 | zostera\|10v1\|AM766297_T1 | 7923 | 687 | 87.55 | glotblastn |
| 4470 | LYM745 | sunflower\|12v1\|CD848067_T1 | — | 687 | 87.55 | glotblastn |
| 4471 | LYM745 | triphysaria\|10v1\|DR171572_P1 | 7924 | 687 | 87.2 | globlastp |
| 4472 | LYM745 | cannabis\|12v1\|GR222152_T1 | 7925 | 687 | 87.18 | glotblastn |
| 4473 | LYM745 | cynara\|gb167\|GE580888_T1 | 7926 | 687 | 87.18 | glotblastn |
| 4474 | LYM745 | thellungiella_halophilum\|11v1\|EHJGI11000012_T1 | 7927 | 687 | 87.18 | glotblastn |
| 4475 | LYM745 | oak\|10v1\|GFXGQ998675X1_T1 | — | 687 | 87.18 | glotblastn |
| 4476 | LYM745 | castorbean\|11v1\|XM_002514958_P1 | 7928 | 687 | 87 | globlastp |
| 4477 | LYM745 | cowpea\|gb166\|GFXAF536225X1_P1 | 7929 | 687 | 86.9 | globlastp |
| 4478 | LYM745 | lettuce\|10v1\|GFXAP007232X27_P1 | 7930 | 687 | 86.9 | globlastp |
| 4479 | LYM745 | tripterygium\|11v1\|SRR098677X118761XX3_T1 | 7931 | 687 | 86.81 | glotblastn |
| 4480 | LYM745 | thellungiella_halophilum\|11v1\|EHPRD058324_T1 | — | 687 | 86.81 | glotblastn |
| 4481 | LYM745 | amborella\|12v2\|AMB12V2CRP112003_T1 | — | 687 | 86.64 | glotblastn |
| 4482 | LYM745 | thellungiella_halophilum\|11v1\|EHJGI11000033_T1 | — | 687 | 86.64 | glotblastn |
| 4483 | LYM745 | bean\|12v1\|CA897065_P1 | 7932 | 687 | 86.5 | globlastp |
| 4484 | LYM745 | arabidopsis_lyrata\|09v1\|JGIAL006480_P1 | 7933 | 687 | 86.3 | globlastp |
| 4485 | LYM745 | cannabis\|12v1\|MDCRP100988_P1 | 7934 | 687 | 86.3 | globlastp |
| 4486 | LYM745 | soybean\|11v1\|BM107765_P1 | 7935 | 687 | 86.3 | globlastp |
| 4487 | LYM745 | arabidopsis_lyrata\|09v1\|JGIAL003213_T1 | 7936 | 687 | 86.28 | glotblastn |
| 4488 | LYM745 | bean\|12v1\|SRR001334.102521_P1 | 7937 | 687 | 86.1 | globlastp |
| 4489 | LYM745 | trigonella\|11v1\|SRR066194X102109_P1 | 7938 | 687 | 86.1 | globlastp |
| 4490 | LYM745 | plantago\|11v2\|SRR066373X101440_T1 | 7939 | 687 | 86.08 | glotblastn |
| 4491 | LYM745 | thellungiella_halophilum\|11v1\|EHJGI11009861_P1 | 7940 | 687 | 86 | globlastp |
| 4492 | LYM745 | lotus\|09v1\|GFXAP002983X29_P1 | 7941 | 687 | 85.6 | globlastp |
| 4493 | LYM745 | fagopyrum\|11v1\|GFXEU254477X24_T1 | — | 687 | 85.35 | glotblastn |
| 4494 | LYM745 | tabernaemontana\|11v1\|SRR098689X115121_T1 | 7942 | 687 | 84.98 | glotblastn |
| 4495 | LYM745 | cassava\|09v1\|TMPLFM887223T1_T1 | 7943 | 687 | 84.64 | glotblastn |
| 4496 | LYM745 | castorbean\|11v1\|RCPRD015773_T1 | — | 687 | 84.64 | glotblastn |
| 4497 | LYM745 | pineapple\|10v1\|GFXAY147693X1_T1 | 7944 | 687 | 84.62 | glotblastn |
| 4498 | LYM745 | pea\|11v1\|GFXAY007495X1_T1 | 7945 | 687 | 84.25 | glotblastn |
| 4499 | LYM745 | jatropha\|09v1\|GFXFJ695500X22_P1 | 7946 | 687 | 84 | globlastp |
| 4500 | LYM745 | canola\|11v1\|EE566866_T1 | 7947 | 687 | 83.88 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4501 | LYM745 | tripterygium\|11v1\|SRR098677X100034XX1_P1 | 7948 | 687 | 83.2 | globlastp |
| 4502 | LYM745 | medicago\|12v1\|MTPRD043867_T1 | 7949 | 687 | 83.15 | glotblastn |
| 4503 | LYM745 | castorbean\|11v1\|EG659525_P1 | 7950 | 687 | 83.1 | globlastp |
| 4504 | LYM745 | leymus\|gb166\|DY895747_T1 | 7951 | 687 | 82.78 | glotblastn |
| 4505 | LYM745 | lotus\|09v1\|CRPLJ020612_T1 | 7952 | 687 | 82.67 | glotblastn |
| 4506 | LYM745 | liriodendron\|gb166\|GFXAF123796X1_P1 | 7953 | 687 | 82.4 | globlastp |
| 4507 | LYM745 | cassava\|09v1\|DB949589_T1 | 7954 | 687 | 81.79 | glotblastn |
| 4508 | LYM745 | soybean\|11v1\|BM107730_P1 | 7955 | 687 | 81.7 | globlastp |
| 4509 | LYM745 | castorbean\|11v1\|SRR020784.101388_T1 | 7956 | 687 | 81.07 | glotblastn |
| 4510 | LYM745 | melon\|10v1\|DV633575_P1 | 7957 | 687 | 81 | globlastp |
| 4511 | LYM745 | brachypodium\|12v1\|SOLX00058314_P1 | 7958 | 687 | 80.7 | globlastp |
| 4512 | LYM746 | switchgrass\|gb167\|FE605357 | 7959 | 688 | 93.9 | globlastp |
| 4513 | LYM746 | foxtail_millet\|11v3\|PHY7SI002693M_P1 | 7960 | 688 | 93.1 | globlastp |
| 4514 | LYM746 | foxtail_millet\|10v2\|SICRP035625 | 7960 | 688 | 93.1 | globlastp |
| 4515 | LYM746 | millet\|10v1\|EVO454PM020658_P1 | 7961 | 688 | 93.1 | globlastp |
| 4516 | LYM746 | brachypodium\|09v1\|GT763524 | 7962 | 688 | 86.2 | globlastp |
| 4517 | LYM746 | brachypodium\|12v1\|BRADI4G11670_P1 | 7962 | 688 | 86.2 | globlastp |
| 4518 | LYM746 | rice\|11v1\|AA750636_P1 | 7963 | 688 | 85.6 | globlastp |
| 4519 | LYM746 | rice\|gb170\|OS04G06790 | 7963 | 688 | 85.6 | globlastp |
| 4520 | LYM746 | rye\|12v1\|DRR001012.107420_P1 | 7964 | 688 | 84.6 | globlastp |
| 4521 | LYM746 | barley\|10v2\|AV833511_P1 | 7965 | 688 | 84.6 | globlastp |
| 4522 | LYM746 | wheat\|10v2\|BE426721 | 7966 | 688 | 83.7 | globlastp |
| 4523 | LYM746 | oat\|11v1\|BE439057_P1 | 7967 | 688 | 82.9 | globlastp |
| 4524 | LYM746 | oat\|10v2\|BE439057 | 7968 | 688 | 82.52 | glotblastn |
| 4525 | LYM747 | maize\|10v1\|AI395922_T1 | 7969 | 689 | 84.95 | glotblastn |
| 4526 | LYM747 | maize\|10v1\|AI902085_P1 | 7970 | 689 | 80.3 | globlastp |
| 4527 | LYM748 | foxtail_millet\|11v3\|PHY7SI006345M_P1 | 7971 | 690 | 88 | globlastp |
| 4528 | LYM748 | maize\|10v1\|EC856046_P1 | 7972 | 690 | 85.8 | globlastp |
| 4529 | LYM749 | sorghum\|09v1\|SB03G030830 | 7973 | 691 | 92.9 | globlastp |
| 4530 | LYM749 | sorghum\|12v1\|SB03G030830_P1 | 7973 | 691 | 92.9 | globlastp |
| 4531 | LYM749 | sugarcane\|10v1\|BQ535821 | 7974 | 691 | 92.65 | glotblastn |
| 4532 | LYM749 | switchgrass\|gb167\|FL743504 | 7975 | 691 | 92.4 | globlastp |
| 4533 | LYM749 | maize\|10v1\|AI944087_P1 | 7976 | 691 | 91.1 | globlastp |
| 4534 | LYM749 | rice\|11v1\|AU055909_P1 | 7977 | 691 | 88.8 | globlastp |
| 4535 | LYM749 | rice\|gb170\|OS01G48270 | 7977 | 691 | 88.8 | globlastp |
| 4536 | LYM749 | brachypodium\|09v1\|GT792764 | 7978 | 691 | 86.2 | globlastp |
| 4537 | LYM749 | brachypodium\|12v1\|BRADI2G46277_P1 | 7978 | 691 | 86.2 | globlastp |
| 4538 | LYM749 | wheat\|10v2\|BE403474 | 7979 | 691 | 86 | globlastp |
| 4539 | LYM749 | rye\|12v1\|BE495584_P1 | 7980 | 691 | 85.7 | globlastp |
| 4540 | LYM749 | oat\|10v2\|GR351452 | 7981 | 691 | 85.7 | globlastp |
| 4541 | LYM749 | oat\|11v1\|GR351452_P1 | 7981 | 691 | 85.7 | globlastp |
| 4542 | LYM749 | barley\|10v2\|BE437488_P1 | 7982 | 691 | 85.5 | globlastp |
| 4543 | LYM749 | maize\|10v1\|AY107250_T1 | 7983 | 691 | 80 | glotblastn |
| 4544 | LYM750 | amorphophallus\|11v2\|SRR089351X105880_P1 | 7984 | 692 | 80 | globlastp |
| 4545 | LYM522 | rice\|11v1\|BI796416_T1 | 7985 | 696 | 81.72 | glotblastn |
| 4546 | LYM522 | rice\|gb170\|OS08G08820 | 7985 | 696 | 81.72 | glotblastn |
| 4547 | LYM522 | sorghum\|09v1\|SB07G005180 | 7986 | 696 | 80.34 | glotblastn |
| 4548 | LYM522 | sorghum\|12v1\|SB07G005180_T1 | 7986 | 696 | 80.34 | glotblastn |
| 4549 | LYM522 | switchgrass\|gb167\|FL704309 | 7987 | 696 | 80.3 | globlastp |
| 4550 | LYM522 | maize\|10v1\|AI734422_T1 | 7988 | 696 | 80.27 | glotblastn |
| 4551 | LYM529 | rye\|12v1\|DRR001012.178161_T1 | 7989 | 698 | 99.18 | glotblastn |
| 4552 | LYM529 | rye\|12v1\|DRR001012.198916_T1 | 7990 | 698 | 98.77 | glotblastn |
| 4553 | LYM529 | brachypodium\|09v1\|DV477678 | 7991 | 698 | 94.26 | glotblastn |
| 4554 | LYM529 | sorghum\|09v1\|SB04G037460 | 7992 | 698 | 86.94 | glotblastn |
| 4555 | LYM529 | millet\|10v1\|PMSLX0029507D1_T1 | 7993 | 698 | 83.87 | glotblastn |
| 4556 | LYM530 | brachypodium\|09v1\|CRPBD010426 | 5261 | 699 | 93.91 | glotblastn |
| 4557 | LYM530 | brachypodium\|12v1\|SOLX00039853_T1 | — | 699 | 93.91 | glotblastn |
| 4557 | LYM721 | brachypodium\|12v1\|SOLX00039853_T1 | — | 728 | 90.91 | glotblastn |
| 4557 | LYM745 | brachypodium\|12v1\|SOLX00039853_T1 | — | 733 | 92.9 | glotblastn |
| 4558 | LYM530 | brachypodium\|12v1\|BDPRD12V1000412_P1 | 7994 | 699 | 93.9 | globlastp |
| 4559 | LYM531 | rye\|12v1\|DRR001012.124816_T1 | 7995 | 700 | 97.62 | glotblastn |
| 4560 | LYM531 | brachypodium\|12v1\|BRADI1G47050_T1 | 7996 | 700 | 92.01 | glotblastn |
| 4561 | LYM531 | brachypodium\|09v1\|SRR031797S0149787 | 7996 | 700 | 92.01 | glotblastn |
| 4562 | LYM531 | rye\|12v1\|DRR001012.574074_P1 | 7997 | 700 | 90.3 | globlastp |
| 4563 | LYM531 | maize\|10v1\|BM074329_T1 | 7998 | 700 | 88.77 | glotblastn |
| 4564 | LYM531 | foxtail_millet\|11v3\|PHY7SI005876M_T1 | — | 700 | 88.55 | glotblastn |
| 4565 | LYM531 | sorghum\|09v1\|SB10G005910 | 7999 | 700 | 88.34 | glotblastn |
| 4566 | LYM531 | sorghum\|12v1\|SB10G005910_T1 | 7999 | 700 | 88.34 | glotblastn |
| 4567 | LYM531 | rice\|gb170\|OS06G08790 | 8000 | 700 | 88.12 | glotblastn |
| 4568 | LYM531 | rice\|11v1\|AU174293_T1 | — | 700 | 88.12 | glotblastn |
| 4569 | LYM531 | switchgrass\|gb167\|FL690317 | 8001 | 700 | 87.9 | glotblastn |
| 4570 | LYM541 | switchgrass\|gb167\|FL735921 | 8002 | 701 | 82.35 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4571 | LYM544 | switchgrass\|gb167\|FE607989 | 8003 | 702 | 81.94 | glotblastn |
| 4572 | LYM544 | sorghum\|12v1\|SB01G002350_T1 | 8004 | 702 | 80.56 | glotblastn |
| 4573 | LYM544 | sorghum\|12v1\|SB12V1CRP000248_T1 | 8005 | 702 | 80.56 | glotblastn |
| 4574 | LYM544 | sorghum\|09v1\|SB01G002340 | 8005 | 702 | 80.56 | glotblastn |
| 4575 | LYM564 | foxtail_millet\|10v2\|SICRP012933 | 8006 | 705 | 93.8 | globlastp |
| 4576 | LYM564 | foxtail_millet\|11v3\|SOLX00011677_P1 | 8007 | 705 | 91.1 | globlastp |
| 4577 | LYM564 | millet\|10v1\|EVO454PM424359_T1 | 8008 | 705 | 88.8 | glotblastn |
| 4578 | LYM570 | switchgrass\|gb167\|FL692342 | 8009 | 706 | 80.08 | glotblastn |
| 4579 | LYM642 | maize\|10v1\|EU944193_T1 | 8010 | 708 | 94.95 | glotblastn |
| 4580 | LYM642 | sorghum\|09v1\|SB02G034180 | 8011 | 708 | 88.46 | glotblastn |
| 4581 | LYM642 | sorghum\|12v1\|SB02G034180_T1 | 8011 | 708 | 88.46 | glotblastn |
| 4582 | LYM650 | foxtail_millet\|10v2\|FXTRMSLX02911418D1 | 8012 | 711 | 99.19 | glotblastn |
| 4583 | LYM650 | millet\|10v1\|EVO454PM086729_P1 | 8013 | 711 | 95.7 | globlastp |
| 4584 | LYM650 | rye\|12v1\|DRR001012.290741_T1 | 8014 | 711 | 94.74 | glotblastn |
| 4585 | LYM650 | wheat\|10v2\|CA484427 | 8015 | 711 | 94.74 | glotblastn |
| 4586 | LYM667 | sorghum\|09v1\|SB06G020470 | 8016 | 713 | 95.5 | globlastp |
| 4587 | LYM667 | sorghum\|12v1\|SB06G020470_P1 | 8016 | 713 | 95.5 | globlastp |
| 4588 | LYM667 | maize\|10v1\|CD573002_P1 | 8017 | 713 | 91 | globlastp |
| 4589 | LYM668 | sorghum\|12v1\|SB10G006400_T1 | 8018 | 714 | 98.46 | glotblastn |
| 4590 | LYM668 | maize\|10v1\|BM348103_P1 | 8019 | 714 | 88.5 | globlastp |
| 4591 | LYM668 | cannabis\|12v1\|SOLX00047290_T1 | 8020 | 714 | 84.62 | glotblastn |
| 4592 | LYM668 | eschscholzia\|11v1\|CK759888_T1 | 8021 | 714 | 84.62 | glotblastn |
| 4593 | LYM668 | apple\|gb171\|CN906716 | 8022 | 714 | 84.62 | glotblastn |
| 4594 | LYM668 | amborella\|12v2\|SRR038637.200754_P1 | 8023 | 714 | 84.6 | globlastp |
| 4595 | LYM668 | abies\|11v2\|SRR098676X204510_T1 | 8024 | 714 | 83.85 | glotblastn |
| 4596 | LYM668 | cannabis\|12v1\|JK498546_T1 | 8025 | 714 | 83.85 | glotblastn |
| 4597 | LYM668 | humulus\|11v1\|SRR098684X111065_T1 | 8026 | 714 | 83.85 | glotblastn |
| 4598 | LYM668 | poplar\|10v1\|BU814436_T1 | 8027 | 714 | 83.85 | glotblastn |
| 4599 | LYM668 | soybean\|11v1\|GLYMA13G17370 | 8028 | 714 | 83.46 | glotblastn |
| 4600 | LYM668 | amorphophallus\|11v2\|SRR089351X113896_T1 | 8029 | 714 | 83.08 | glotblastn |
| 4601 | LYM668 | oil_palm\|11v1\|SRR190698.296095_T1 | 8030 | 714 | 83.08 | glotblastn |
| 4602 | LYM668 | soybean\|11v1\|GLYMA17G05130 | 8031 | 714 | 82.71 | glotblastn |
| 4603 | LYM668 | pigeonpea\|11v1\|SRR054580X100880_T1 | 8032 | 714 | 82.71 | glotblastn |
| 4604 | LYM668 | maritime_pine\|10v1\|SRR073317S0031341_T1 | 8033 | 714 | 82.31 | glotblastn |
| 4605 | LYM668 | pine\|10v2\|BF221069_T1 | 8034 | 714 | 82.31 | glotblastn |
| 4606 | LYM668 | poplar\|10v1\|BU878791_T1 | 8035 | 714 | 82.31 | glotblastn |
| 4607 | LYM668 | sequoia\|10v1\|SRR065044S0195288 | 8036 | 714 | 82.31 | glotblastn |
| 4608 | LYM668 | spruce\|11v1\|ES671248_T1 | 8037 | 714 | 82.31 | glotblastn |
| 4609 | LYM668 | spruce\|gb162\|CO486574 | 8038 | 714 | 82.31 | glotblastn |
| 4610 | LYM668 | taxus\|10v1\|SRR032523S0026526 | 8039 | 714 | 82.31 | glotblastn |
| 4611 | LYM668 | platanus\|11v1\|SRR096786X262173_P1 | 8040 | 714 | 82.3 | globlastp |
| 4612 | LYM668 | tobacco\|gb162\|AM817735 | 8041 | 714 | 82.3 | globlastp |
| 4613 | LYM668 | canola\|11v1\|EE451910_T1 | 8042 | 714 | 81.54 | glotblastn |
| 4614 | LYM668 | eucalyptus\|11v2\|CT986494_T1 | 8043 | 714 | 81.54 | glotblastn |
| 4615 | LYM668 | foxtail_millet\|11v3\|PHY7SI031622M_T1 | 8044 | 714 | 81.54 | glotblastn |
| 4616 | LYM668 | gossypium_raimondii\|12v1\|SRR032367.174585_T1 | 8045 | 714 | 81.54 | glotblastn |
| 4617 | LYM668 | hornbeam\|12v1\|SRR364455.120144_T1 | 8046 | 714 | 81.54 | glotblastn |
| 4618 | LYM668 | maritime_pine\|10v1\|CR393505_T1 | 8047 | 714 | 81.54 | glotblastn |
| 4619 | LYM668 | spruce\|11v1\|ES259643_T1 | 8048 | 714 | 81.54 | glotblastn |
| 4620 | LYM668 | foxtail_millet\|10v2\|SICRP002011 | 8049 | 714 | 81.54 | glotblastn |
| 4621 | LYM668 | guizotia\|10v1\|GE557732_T1 | 8050 | 714 | 81.54 | glotblastn |
| 4622 | LYM668 | lotus\|09v1\|CRPLJ004951_T1 | 8051 | 714 | 81.54 | glotblastn |
| 4623 | LYM668 | pigeonpea\|10v1\|SRR054580S0047273 | 8052 | 714 | 81.54 | glotblastn |
| 4624 | LYM668 | sciadopitys\|10v1\|SRR065035S0161405 | 8053 | 714 | 81.54 | glotblastn |
| 4625 | LYM668 | cephalotaxus\|11v1\|SRR064395X196722_P1 | 8054 | 714 | 81.5 | globlastp |
| 4626 | LYM668 | chestnut\|gb170\|SRR006300S0024280_P1 | 8055 | 714 | 81.5 | globlastp |
| 4627 | LYM668 | strawberry\|11v1\|DY673440 | 8056 | 714 | 81.34 | glotblastn |
| 4628 | LYM668 | trigonella\|11v1\|SRR066194X265059_T1 | 8057 | 714 | 81.2 | glotblastn |
| 4629 | LYM668 | bean\|12v1\|SRR001334.152798_T1 | 8058 | 714 | 81.2 | glotblastn |
| 4630 | LYM668 | bean\|gb167\|FE695052 | 8058 | 714 | 81.2 | glotblastn |
| 4631 | LYM668 | castorbean\|09v1\|EG685855 | 8059 | 714 | 81.2 | glotblastn |
| 4632 | LYM668 | castorbean\|11v1\|EG685855_T1 | 8059 | 714 | 81.2 | glotblastn |
| 4633 | LYM668 | peanut\|10v1\|EE125934_T1 | 8060 | 714 | 81.16 | glotblastn |
| 4634 | LYM668 | tripterygium\|11v1\|SRR098677X113789_P1 | 8061 | 714 | 81.1 | globlastp |
| 4635 | LYM668 | watermelon\|11v1\|AM715941_T1 | 8062 | 714 | 81.06 | glotblastn |
| 4636 | LYM668 | tripterygium\|11v1\|SRR098677X225048_P1 | 8063 | 714 | 80.8 | globlastp |
| 4637 | LYM668 | cannabis\|12v1\|JK501057_T1 | 8064 | 714 | 80.77 | glotblastn |
| 4638 | LYM668 | humulus\|11v1\|SRR098684X164760_T1 | 8065 | 714 | 80.77 | glotblastn |
| 4639 | LYM668 | canola\|10v1\|DY025012 | 8066 | 714 | 80.77 | glotblastn |
| 4640 | LYM668 | canola\|11v1\|DY025012_T1 | 8067 | 714 | 80.77 | glotblastn |
| 4641 | LYM668 | cichorium\|gb171\|EH700156_T1 | 8068 | 714 | 80.77 | glotblastn |
| 4642 | LYM668 | pine\|10v2\|AW736908_T1 | 8069 | 714 | 80.77 | glotblastn |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4643 | LYM668 | pseudotsuga\|10v1\|SRR065119S0002637 | 8070 | 714 | 80.77 | glotblastn |
| 4644 | LYM668 | eucalyptus\|11v1\|CT986494 | — | 714 | 80.77 | glotblastn |
| 4645 | LYM668 | brachypodium\|09v1\|GT759895 | 8071 | 714 | 80.71 | glotblastn |
| 4646 | LYM668 | brachypodium\|12v1\|BRADI1G46640T2_T1 | 8071 | 714 | 80.71 | glotblastn |
| 4647 | LYM668 | papaya\|gb165\|EX256125_T1 | 8072 | 714 | 80.6 | glotblastn |
| 4648 | LYM668 | bean\|12v1\|SRR001334.139328_T1 | 8073 | 714 | 80.45 | glotblastn |
| 4649 | LYM668 | beech\|11v1\|SRR006293.18600_T1 | 8074 | 714 | 80.45 | glotblastn |
| 4650 | LYM668 | lettuce\|10v1\|DW090021_T1 | 8075 | 714 | 80.45 | glotblastn |
| 4651 | LYM668 | melon\|10v1\|AM715941_T1 | 8076 | 714 | 80.3 | glotblastn |
| 4652 | LYM668 | cucurbita\|11v1\|SRR091276X123019_T1 | 8077 | 714 | 80.15 | glotblastn |
| 4653 | LYM668 | rice\|11v1\|CF321426_T1 | 8078 | 714 | 80.15 | glotblastn |
| 4654 | LYM668 | rice\|gb170\|OS09G26650 | 8078 | 714 | 80.15 | glotblastn |
| 4655 | LYM668 | euonymus\|11v1\|SRR070038X164269_T1 | 8079 | 714 | 80 | glotblastn |
| 4656 | LYM668 | olea\|11v1\|SRR014464.38760_T1 | 8080 | 714 | 80 | glotblastn |
| 4657 | LYM668 | vinca\|11v1\|SRR098690X22825_T1 | 8081 | 714 | 80 | glotblastn |
| 4658 | LYM668 | arabidopsis\|10v1\|AT4G21090_T1 | 8082 | 714 | 80 | glotblastn |
| 4659 | LYM668 | cucumber\|09v1\|AM715941_T1 | 8083 | 714 | 80 | glotblastn |
| 4660 | LYM668 | millet\|10v1\|EVO454PM067685_T1 | 8084 | 714 | 80 | glotblastn |
| 4661 | LYM668 | physcomitrella\|10v1\|AW145591_T1 | 8085 | 714 | 80 | glotblastn |
| 4662 | LYM668 | rose\|10v1\|BQ106539 | 8086 | 714 | 80 | globlastp |
| 4663 | LYM668 | rose\|12v1\|BQ106539_P1 | 8086 | 714 | 80 | globlastp |
| 4664 | LYM670 | maize\|10v1\|CF011760_T1 | 8087 | 715 | 81.31 | glotblastn |
| 4665 | LYM670 | sugarcane\|10v1\|CA236985 | 8088 | 715 | 81.31 | glotblastn |
| 4666 | LYM689 | sugarcane\|10v1\|BQ537171 | 8089 | 722 | 92.8 | globlastp |
| 4667 | LYM689 | maize\|10v1\|BU037187_P1 | 8090 | 722 | 89.1 | globlastp |
| 4668 | LYM689 | foxtail_millet\|11v3\|PHY7SI036039M_P1 | 8091 | 722 | 88.3 | globlastp |
| 4669 | LYM689 | maize\|10v1\|AI948187_P1 | 8092 | 722 | 87.6 | globlastp |
| 4670 | LYM689 | rice\|11v1\|AI978441_P1 | 8093 | 722 | 82.3 | globlastp |
| 4671 | LYM689 | rice\|gb170\|OS03G53050 | 8093 | 722 | 82.3 | globlastp |
| 4672 | LYM700 | sorghum\|09v1\|SB02G003530 | 8094 | 724 | 97.1 | globlastp |
| 4673 | LYM700 | sorghum\|12v1\|SB02G003530_P1 | 8094 | 724 | 97.1 | globlastp |
| 4674 | LYM700 | sugarcane\|10v1\|CA098469 | 8095 | 724 | 94.8 | globlastp |
| 4675 | LYM700 | maize\|10v1\|AI901919_P1 | 8096 | 724 | 94.5 | globlastp |
| 4676 | LYM700 | maize\|10v1\|AI619119_P1 | 8097 | 724 | 92.3 | globlastp |
| 4677 | LYM700 | millet\|10v1\|EVO454PM005298_P1 | 8098 | 724 | 86.5 | globlastp |
| 4678 | LYM700 | foxtail_millet\|11v3\|EC612450_P1 | 8099 | 724 | 86.2 | globlastp |
| 4679 | LYM700 | switchgrass\|gb167\|FE609578 | 8100 | 724 | 83.9 | globlastp |
| 4680 | LYM700 | rice\|11v1\|BE230084_T1 | 8101 | 724 | 80.96 | glotblastn |
| 4681 | LYM700 | rice\|gb170\|OS02G20360 | 8101 | 724 | 80.96 | glotblastn |
| 4682 | LYM721 | maize\|10v1\|GRMZM2G065016T01_T1 | 8102 | 728 | 96.36 | glotblastn |
| 4683 | LYM721 | maize\|10v1\|GRMZM2G108362T01_T1 | 8103 | 728 | 96.36 | glotblastn |
| 4684 | LYM721 | maize\|10v1\|GRMZM2G417523T01_T1 | 8104 | 728 | 96.36 | glotblastn |
| 4685 | LYM721 | rye\|12v1\|DRR001012.144513_T1 | 8105 | 728 | 89.47 | glotblastn |
| 4686 | LYM721 | foxtail_millet\|11v3\|PHY7SI020884M_T1 | 8106 | 728 | 83.64 | glotblastn |
| 4687 | LYM744 | foxtail_millet\|11v3\|PHY7SI029484M_T1 | 8107 | 732 | 81.5 | glotblastn |
| 4688 | LYM745 | maize\|10v1\|BE639329_T1 | 8108 | 733 | 98.91 | glotblastn |
| 4689 | LYM745 | maize\|10v1\|AI444745_T1 | 8109 | 733 | 97.27 | glotblastn |
| 4690 | LYM745 | maize\|10v1\|BI096827_T1 | 8110 | 733 | 97.27 | glotblastn |
| 4691 | LYM745 | maize\|10v1\|EG116126_T1 | 8111 | 733 | 97.27 | glotblastn |
| 4692 | LYM745 | foxtail_millet\|11v3\|GFXFJ766320X1_T1 | — | 733 | 97.27 | glotblastn |
| 4693 | LYM745 | foxtail_millet\|11v3\|PHY7SI020886M_T1 | — | 733 | 97.27 | glotblastn |
| 4694 | LYM745 | millet\|10v1\|CD726710_T1 | — | 733 | 97.27 | glotblastn |
| 4695 | LYM745 | maize\|10v1\|SRR014549S0096484_T1 | 8112 | 733 | 96.72 | glotblastn |
| 4696 | LYM745 | maize\|10v1\|DW909238_T1 | 8113 | 733 | 96.17 | glotblastn |
| 4697 | LYM745 | rice\|gb170\|OSP1G00730 | 8114 | 733 | 96.17 | glotblastn |
| 4698 | LYM745 | foxtail_millet\|11v3\|SOLX00021157_T1 | — | 733 | 96.17 | glotblastn |
| 4699 | LYM745 | rice\|11v1\|BI796291_T1 | — | 733 | 96.17 | glotblastn |
| 4700 | LYM745 | rice\|11v1\|CI751746_T1 | — | 733 | 96.17 | glotblastn |
| 4701 | LYM745 | rice\|11v1\|OSCRP167596_T1 | — | 733 | 96.17 | glotblastn |
| 4702 | LYM745 | rice\|11v1\|BI795166_T1 | — | 733 | 96.17 | glotblastn |
| 4703 | LYM745 | sorghum\|12v1\|BG048733_T1 | — | 733 | 95.63 | glotblastn |
| 4704 | LYM745 | sorghum\|12v1\|SB12V1CUFF43842T1P2_T1 | — | 733 | 95.63 | glotblastn |
| 4705 | LYM745 | foxtail_millet\|11v3\|PHY7SI012211M_T1 | — | 733 | 93.99 | glotblastn |
| 4706 | LYM745 | brachypodium\|09v1\|SRR031795S0021480 | 8115 | 733 | 92.9 | glotblastn |
| 4707 | LYM745 | brachypodium\|12v1\|BDCRP12V1033046_T1 | — | 733 | 92.9 | glotblastn |
| 4708 | LYM745 | lovegrass\|gb167\|EH190665_T1 | 8116 | 733 | 92.35 | glotblastn |
| 4709 | LYM745 | maize\|10v1\|BI478992_T1 | 8117 | 733 | 92.35 | glotblastn |
| 4710 | LYM745 | maize\|10v1\|BQ293870_P1 | 8118 | 733 | 90.2 | globlastp |
| 4711 | LYM745 | brachypodium\|09v1\|CRPBD020292 | 8119 | 733 | 90.16 | glotblastn |
| 4712 | LYM745 | sorghum\|09v1\|SBGWP040163 | 8120 | 733 | 89.6 | globlastp |
| 4713 | LYM745 | rice\|11v1\|BM421245_P1 | 8121 | 733 | 88 | globlastp |
| 4714 | LYM745 | rice\|11v1\|CB681406_T1 | 8122 | 733 | 87.43 | glotblastn |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4715 | LYM745 | oil_palm\|gb166\|GFXEU016904X1 | 8123 | 733 | 87.43 | glotblastn |
| 4716 | LYM745 | oil_palm\|11v1\|GH637135_T1 | — | 733 | 86.34 | glotblastn |
| 4717 | LYM745 | oil_palm\|11v1\|SRR190698.185164XX1_T1 | 8124 | 733 | 85.25 | glotblastn |
| 4718 | LYM745 | grape\|11v1\|BQ792101_T1 | 8125 | 733 | 84.24 | glotblastn |
| 4719 | LYM745 | grape\|gb160\|BQ792101 | 8125 | 733 | 84.24 | glotblastn |
| 4720 | LYM745 | grape\|gb160\|BQ792399 | 8126 | 733 | 84.24 | glotblastn |
| 4721 | LYM745 | amborella\|12v2\|GFXAF235047X1_T1 | 8127 | 733 | 84.15 | glotblastn |
| 4722 | LYM745 | amborella\|12v2\|GFXAJ506156X22_T1 | — | 733 | 84.15 | glotblastn |
| 4723 | LYM745 | platanus\|11v1\|GFXDQ923116X23_T1 | 8128 | 733 | 83.7 | glotblastn |
| 4724 | LYM745 | amborella\|12v2\|SRR038634.10442_T1 | 8129 | 733 | 83.61 | glotblastn |
| 4725 | LYM745 | amsonia\|11v1\|SRR098688X100366_T1 | 8130 | 733 | 83.06 | glotblastn |
| 4726 | LYM745 | aristolochia\|10v1\|GFXAF528893X1_T1 | — | 733 | 83.06 | glotblastn |
| 4727 | LYM745 | apple\|11v1\|CN855347_T1 | 8131 | 733 | 82.51 | glotblastn |
| 4728 | LYM745 | apple\|gb171\|CN848687 | 8132 | 733 | 82.51 | glotblastn |
| 4729 | LYM745 | tragopogon\|10v1\|SRR020205S0000675 | 8133 | 733 | 82.51 | glotblastn |
| 4730 | LYM745 | apple\|11v1\|CN848687_T1 | — | 733 | 82.51 | glotblastn |
| 4731 | LYM745 | nasturtium\|10v1\|SRR032558S0003041 | 8134 | 733 | 81.82 | glotblastn |
| 4732 | LYM745 | medicago\|12v1\|AW256478_T1 | 8135 | 733 | 81.62 | glotblastn |
| 4733 | LYM745 | medicago\|12v1\|AW559313_T1 | 8135 | 733 | 81.62 | glotblastn |
| 4734 | LYM745 | oil_palm\|11v1\|SRR190699.654961_T1 | 8136 | 733 | 81.62 | glotblastn |
| 4735 | LYM745 | rhizophora\|10v1\|SRR005792S0004605 | 8137 | 733 | 81.42 | glotblastn |
| 4736 | LYM745 | euonymus\|11v1\|GFXGQ998190X1_T1 | — | 733 | 81.42 | glotblastn |
| 4737 | LYM745 | castorbean\|09v1\|SRR020784S0000204 | 8138 | 733 | 81.28 | glotblastn |
| 4738 | LYM745 | maize\|10v1\|BU093266_P1 | 8139 | 733 | 80.9 | globlastp |
| 4739 | LYM745 | sorghum\|09v1\|SB0506S002020 | 8139 | 733 | 80.9 | globlastp |
| 4740 | LYM745 | cucurbita\|11v1\|SRR091276X10414_T1 | 8140 | 733 | 80.87 | glotblastn |
| 4741 | LYM745 | prunus\|10v1\|CN848687_T1 | 8141 | 733 | 80.87 | glotblastn |
| 4742 | LYM745 | maize\|10v1\|DW960265_T1 | 8142 | 733 | 80.87 | glotblastn |
| 4743 | LYM745 | salvia\|10v1\|FE536543 | 8143 | 733 | 80.87 | glotblastn |
| 4744 | LYM745 | cannabis\|12v1\|GR221477_T1 | — | 733 | 80.87 | glotblastn |
| 4745 | LYM745 | watermelon\|11v1\|VMEL00019515920119_T1 | 8144 | 733 | 80.75 | glotblastn |
| 4746 | LYM745 | castorbean\|11v1\|SRR020784.117261_T1 | — | 733 | 80.75 | glotblastn |
| 4747 | LYM745 | hornbeam\|12v1\|SRR364455.100793_T1 | — | 733 | 80.75 | glotblastn |
| 4748 | LYM745 | tomato\|11v1\|BG124774_T1 | 8145 | 733 | 80.42 | glotblastn |
| 4749 | LYM745 | momordica\|10v1\|SRR071315S0000098_T1 | 8146 | 733 | 80.33 | glotblastn |
| 4750 | LYM745 | poppy\|gb166\|FG598929 | 8147 | 733 | 80.32 | glotblastn |
| 4751 | LYM745 | euphorbia\|11v1\|DV124656_T1 | 8148 | 733 | 80.21 | glotblastn |
| 4752 | LYM745 | pepper\|gb171\|BM062022_T1 | 8149 | 733 | 80.21 | glotblastn |
| 4753 | LYM745 | tabernaemontana\|11v1\|SRR098689X100380_T1 | — | 733 | 80.21 | glotblastn |
| 4754 | LYM745 | b_rapa\|11v1\|BG544136_T1 | 8150 | 733 | 80.1 | glotblastn |
| 4755 | LYM745 | b_rapa\|11v1\|CV545773_T1 | 8151 | 733 | 80.1 | glotblastn |
| 4756 | LYM745 | b_juncea\|10v2\|E7FJH303C1ZH42_T1 | 8152 | 733 | 80.1 | glotblastn |
| 4757 | LYM745 | b_oleracea\|gb161\|AM394621_T1 | 8153 | 733 | 80.1 | glotblastn |
| 4758 | LYM745 | b_rapa\|gb162\|BG544136 | 8154 | 733 | 80.1 | glotblastn |
| 4759 | LYM745 | canola\|10v1\|CN729435 | 8154 | 733 | 80.1 | glotblastn |
| 4760 | LYM745 | b_rapa\|11v1\|AT000620_T1 | — | 733 | 80.1 | glotblastn |
| 4761 | LYM522 | sorghum\|12v1\|SB06G029270_P1 | 8155 | 734 | 80.3 | globlastp |
| 4762 | LYM523 | rye\|12v1\|DRR001012.18480_P1 | 8156 | 735 | 95 | globlastp |
| 4763 | LYM523 | wheat\|10v2\|BE401228 | 8157 | 735 | 93.1 | globlastp |
| 4764 | LYM528 | rye\|12v1\|DRR001012.116265_P1 | 8158 | 736 | 96.1 | globlastp |
| 4765 | LYM543 | spruce\|11v1\|SRR064180X557368_P1 | 8159 | 737 | 89.8 | globlastp |
| 4766 | LYM543 | spruce\|11v1\|ES252261_P1 | 8160 | 737 | 88.9 | globlastp |
| 4767 | LYM543 | spruce\|11v1\|ES260391_P1 | 8160 | 737 | 88.9 | globlastp |
| 4768 | LYM543 | pine\|10v2\|AW042577_P1 | 8161 | 737 | 88.9 | globlastp |
| 4769 | LYM543 | pseudotsuga\|10v1\|SRR065119SO049481 | 8162 | 737 | 88.9 | globlastp |
| 4770 | LYM543 | spruce\|gb162\|CO219270 | 8160 | 737 | 88.9 | globlastp |
| 4771 | LYM543 | spruce\|11v1\|SRR065813X15381_T1 | 8163 | 737 | 88.89 | glotblastn |
| 4772 | LYM543 | cedrus\|11v1\|SRR065007X112403_T1 | 8164 | 737 | 88.43 | glotblastn |
| 4773 | LYM543 | abies\|11v2\|SRR098676X100684_P1 | 8165 | 737 | 88.4 | globlastp |
| 4774 | LYM543 | maritime_pine\|10v1\|BX250001_P1 | 8166 | 737 | 88.4 | globlastp |
| 4775 | LYM543 | spruce\|11v1\|SRR064180X217507_T1 | 8167 | 737 | 87.5 | glotblastn |
| 4776 | LYM543 | spruce\|11v1\|SRR065813X15250_T1 | 8168 | 737 | 87.5 | glotblastn |
| 4777 | LYM543 | zostera\|10v1\|AM766384 | 8169 | 737 | 82.4 | globlastp |
| 4778 | LYM543 | spruce\|11v1\|SRR065813X398459XX1_T1 | 8170 | 737 | 81.94 | glotblastn |
| 4779 | LYM544 | foxtail_millet\|11v3\|PHY7SI039847M_P1 | 8171 | 738 | 87.9 | globlastp |
| 4780 | LYM546 | millet\|10v1\|PMSLX003 8646_T1 | 8172 | 739 | 87.46 | glotblastn |
| 4781 | LYM548 | foxtail_millet\|11v3\|PHY7SI006270M_P1 | 8173 | 740 | 99.2 | globlastp |
| 4782 | LYM548 | sorghum\|12v1\|SB10G025110_P1 | 8174 | 740 | 82.2 | globlastp |
| 4783 | LYM552 | sorghum\|09v1\|SB06G025390 | 8175 | 741 | 88.2 | globlastp |
| 4784 | LYM552 | brachypodium\|09v1\|GT799879 | 8176 | 741 | 85 | globlastp |
| 4785 | LYM552 | rice\|gb170\|OS04G47590 | 8177 | 741 | 83.27 | glotblastn |
| 4786 | LYM565 | sorghum\|09v1\|SB01G028150 | 8178 | 743 | 91.9 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4787 | LYM565 | sorghum|12v1|SB01G028150_P1 | 8178 | 743 | 91.9 | globlastp |
| 4788 | LYM570 | barley|10v2|BU985758_P1 | 8179 | 745 | 87.4 | globlastp |
| 4789 | LYM570 | wheat|10v2|BG274796 | 8180 | 745 | 87.4 | globlastp |
| 4790 | LYM570 | rye|12v1|DRR001012.116829_P1 | 8181 | 745 | 83.3 | globlastp |
| 4791 | LYM577 | sorghum|12v1|SB04G024430_T1 | 8182 | 746 | 91.85 | glotblastn |
| 4792 | LYM577 | sorghum|09v1|SB06G028430 | 8183 | 746 | 91.7 | globlastp |
| 4793 | LYM577 | sorghum|12v1|SB06G028430_P1 | 8183 | 746 | 91.7 | globlastp |
| 4794 | LYM577 | sorghum|09v1|SB04G024425 | 8184 | 746 | 91.55 | glotblastn |
| 4795 | LYM577 | maize|10v1|AY027539_P1 | 8185 | 746 | 90.8 | globlastp |
| 4796 | LYM577 | foxtail_millet|11v3|PHY7SI033890M_T1 | 8186 | 746 | 86.27 | glotblastn |
| 4797 | LYM577 | millet|10v1|EVO454PM002339_P1 | 8187 | 746 | 83.9 | globlastp |
| 4798 | LYM580 | sorghum|12v1|SB01G033630_P1 | 8188 | 747 | 87 | globlastp |
| 4799 | LYM582 | sorghum|09v1|SB06G025650 | 8189 | 748 | 88 | globlastp |
| 4800 | LYM582 | sorghum|12v1|SB06G025650_P1 | 8189 | 748 | 88 | globlastp |
| 4801 | LYM583 | rice|11v1|BIS11269_P1 | 8190 | 749 | 80.7 | globlastp |
| 4802 | LYM583 | rice|gb170|OS01G66110 | 8190 | 749 | 80.7 | globlastp |
| 4803 | LYM583 | brachypodium|09v1|GT763030 | 8191 | 749 | 80.1 | globlastp |
| 4804 | LYM583 | brachypodium|12v1|BRADI2G57087_P1 | 8191 | 749 | 80.1 | globlastp |
| 4805 | LYM589 | sugarcane|10v1|CA066616 | 8192 | 750 | 98.8 | globlastp |
| 4806 | LYM589 | sorghum|09v1|SB03G012520 | 8193 | 750 | 97.6 | globlastp |
| 4807 | LYM589 | sorghum|12v1|SB03G012520_P1 | 8193 | 750 | 97.6 | globlastp |
| 4808 | LYM589 | foxtail_millet|10v2|SICRP007101 | 8194 | 750 | 84.8 | globlastp |
| 4809 | LYM589 | rice|11v1|AA751909_T1 | 8195 | 750 | 80.61 | glotblastn |
| 4810 | LYM589 | rice|gb170|OS01G19820 | 8195 | 750 | 80.61 | glotblastn |
| 4811 | LYM591 | wheat|10v2|BE442759 | 8196 | 751 | 83.7 | globlastp |
| 4812 | LYM591 | oat|11v1|GO582747_T1 | 8197 | 751 | 83.62 | glotblastn |
| 4813 | LYM591 | wheat|10v2|BE405359 | 8198 | 751 | 83.3 | globlastp |
| 4814 | LYM591 | wheat|10v2|BE493444 | 8199 | 751 | 83.1 | globlastp |
| 4815 | LYM591 | leymus|gb166|EG384632_P1 | 8200 | 751 | 83.1 | globlastp |
| 4816 | LYM591 | wheat|10v2|CA714711 | 8201 | 751 | 82.9 | globlastp |
| 4817 | LYM591 | rye|12v1|DRR001012.132893_P1 | 8202 | 751 | 82.3 | globlastp |
| 4818 | LYM591 | rye|12v1|DRR001012.232984_P1 | 8203 | 751 | 82.3 | globlastp |
| 4819 | LYM591 | barley|10v2|BI956152_P1 | 8204 | 751 | 82.3 | globlastp |
| 4820 | LYM591 | rye|12v1|DRR001012.319403_T1 | 8205 | 751 | 80.79 | glotblastn |
| 4821 | LYM594 | maize|10v1|CF648433_P1 | 8206 | 754 | 81.4 | globlastp |
| 4822 | LYM594 | sorghum|09v1|SB02G027510 | 8207 | 754 | 81.2 | globlastp |
| 4823 | LYM594 | sorghum|12v1|SB02G027510_P1 | 8207 | 754 | 81.2 | globlastp |
| 4824 | LYM602 | millet|10v1|EVO454PM006476_P1 | 8208 | 755 | 90.3 | globlastp |
| 4825 | LYM602 | brachypodium|09v1|SRR031795S0043310 | 8209 | 755 | 82.8 | globlastp |
| 4826 | LYM602 | brachypodium|12v1|BRADI5G09817_P1 | 8209 | 755 | 82.8 | globlastp |
| 4827 | LYM602 | barley|10v2|BJ469937_T1 | 8210 | 755 | 81.98 | glotblastn |
| 4828 | LYM606 | wheat|10v2|BE419171 | 8211 | 757 | 87.1 | globlastp |
| 4829 | LYM608 | millet|10v1|EVO454PM023380_P1 | 8212 | 758 | 91.5 | globlastp |
| 4830 | LYM608 | foxtail_millet|11v3|PHY7SI002286M_P1 | 8213 | 758 | 88.7 | globlastp |
| 4831 | LYM608 | foxtail_millet|10v2|OXFXTSLX00011421D1T1 | 8214 | 758 | 88.7 | globlastp |
| 4832 | LYM608 | rice|11v1|BI804402_P1 | 8215 | 758 | 80.1 | globlastp |
| 4833 | LYM610 | sorghum|12v1|SB01G007170_P1 | 8216 | 759 | 84.1 | globlastp |
| 4834 | LYM610 | sorghum|09v1|SB01G007170 | 8217 | 759 | 83.73 | glotblastn |
| 4835 | LYM613 | maize|10v1|AI782899_P1 | 8218 | 760 | 97 | globlastp |
| 4836 | LYM613 | switchgrass|gb167|DN141434 | 8219 | 760 | 95.6 | globlastp |
| 4837 | LYM613 | sorghum|09v1|SB03G009700 | 8220 | 760 | 95.1 | globlastp |
| 4838 | LYM613 | sorghum|12v1|SB03G009700_P1 | 8220 | 760 | 95.1 | globlastp |
| 4839 | LYM613 | foxtail_millet|11v3|EC612476_P1 | 8221 | 760 | 94.9 | globlastp |
| 4840 | LYM613 | foxtail_millet|10v2|SICRP010674 | 8221 | 760 | 94.9 | globlastp |
| 4841 | LYM613 | millet|10v1|CD724629_P1 | 8222 | 760 | 93.9 | globlastp |
| 4842 | LYM613 | barley|10v2|AV834710_P1 | 8223 | 760 | 88.8 | globlastp |
| 4843 | LYM613 | wheat|10v2|BE401965 | 8224 | 760 | 88.8 | globlastp |
| 4844 | LYM613 | rye|12v1|DRR001012.101407_P1 | 8225 | 760 | 88.6 | globlastp |
| 4845 | LYM613 | oat|10v2|CN814753 | 8226 | 760 | 87.3 | globlastp |
| 4846 | LYM613 | brachypodium|09v1|DV483417 | 8227 | 760 | 87.1 | globlastp |
| 4847 | LYM613 | brachypodium|12v1|BRADI2G08960_P1 | 8227 | 760 | 87.1 | globlastp |
| 4848 | LYM613 | fescue|gb161|DT679374_P1 | 8228 | 760 | 86.7 | globlastp |
| 4849 | LYM613 | cassava|09v1|DV441758_P1 | 8229 | 760 | 85.3 | globlastp |
| 4850 | LYM613 | eucalyptus|11v2|CD668810_P1 | 8230 | 760 | 85.2 | globlastp |
| 4851 | LYM613 | oil_palm|11v1|EL686708_P1 | 8231 | 760 | 85.2 | globlastp |
| 4852 | LYM613 | eucalyptus|11v1|CD668810 | 8230 | 760 | 85.2 | globlastp |
| 4853 | LYM613 | oil_palm|11v1|EL688441_P1 | 8232 | 760 | 85 | globlastp |
| 4854 | LYM613 | amorphophallus|11v2|SRR089351X2550_P1 | 8233 | 760 | 84.9 | globlastp |
| 4855 | LYM613 | cassava|09v1|JGICASSAVA12817VALIDM1_P1 | 8234 | 760 | 84.8 | globlastp |
| 4856 | LYM613 | aquilegia|10v2|DR928227 | 8235 | 760 | 84.3 | globlastp |
| 4857 | LYM613 | cacao|10v1|CU476740_P1 | 8236 | 760 | 84.3 | globlastp |
| 4858 | LYM613 | aristolochia|10v1|SRR039082S0002761_P1 | 8237 | 760 | 84.2 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4859 | LYM613 | pigeonpea\|11v1\|SRR054580X10008_P1 | 8238 | 760 | 84.1 | globlastp |
| 4860 | LYM613 | soybean\|11v1\|GLYMA10G29000 | 8239 | 760 | 84.1 | globlastp |
| 4861 | LYM613 | grape\|11v1\|GSVIVT01035047001_P1 | 8240 | 760 | 84 | globlastp |
| 4862 | LYM613 | castorbean\|09v1\|XM002512439 | 8241 | 760 | 83.9 | globlastp |
| 4863 | LYM613 | castorbean\|11v1\|XM_002512439_P1 | 8241 | 760 | 83.9 | globlastp |
| 4864 | LYM613 | poplar\|10v1\|BI070314_P1 | 8242 | 760 | 83.8 | globlastp |
| 4865 | LYM613 | soybean\|11v1\|GLYMA20G38320 | 8243 | 760 | 83.7 | globlastp |
| 4866 | LYM613 | amorphophallus\|11v2\|SRR089351X188349_P1 | 8244 | 760 | 83.6 | globlastp |
| 4867 | LYM613 | cirsium\|11v1\|SRR346952.1038670_P1 | 8245 | 760 | 83.6 | globlastp |
| 4868 | LYM613 | cannabis\|12v1\|JK496040_P1 | 8246 | 760 | 83.5 | globlastp |
| 4869 | LYM613 | euphorbia\|11v1\|BI961995_P1 | 8247 | 760 | 83.5 | globlastp |
| 4870 | LYM613 | arnica\|11v1\|SRR099034X100054_P1 | 8248 | 760 | 83.4 | globlastp |
| 4871 | LYM613 | cirsium\|11v1\|SRR346952.206135_P1 | 8249 | 760 | 83.4 | globlastp |
| 4872 | LYM613 | grape\|11v1\|GSVIVT01031205001_P1 | 8250 | 760 | 83.4 | globlastp |
| 4873 | LYM613 | pigeonpea\|11v1\|SRR054580X137243_P1 | 8251 | 760 | 83.4 | globlastp |
| 4874 | LYM613 | centaurea\|gb166\|EH712147_P1 | 8252 | 760 | 83.4 | globlastp |
| 4875 | LYM613 | poplar\|10v1\|AI165556_P1 | 8253 | 760 | 83.3 | globlastp |
| 4876 | LYM613 | spurge\|gb161\|BI961995 | 8254 | 760 | 83.3 | globlastp |
| 4877 | LYM613 | cirsium\|11v1\|SRR346952.1011854_P1 | 8255 | 760 | 83.2 | globlastp |
| 4878 | LYM613 | tabernaemontana\|11v1\|SRR098689X114962_P1 | 8256 | 760 | 83.2 | globlastp |
| 4879 | LYM613 | flaveria\|11v1\|SRR149229.56663_P1 | 8257 | 760 | 83.1 | globlastp |
| 4880 | LYM613 | humulus\|11v1\|GD242787_P1 | 8258 | 760 | 83.1 | globlastp |
| 4881 | LYM613 | medicago\|09v1\|AI974575 | 8259 | 760 | 83 | globlastp |
| 4882 | LYM613 | medicago\|12v1\|AI974575_P1 | 8259 | 760 | 83 | globlastp |
| 4883 | LYM613 | lettuce\|10v1\|DW046351_P1 | 8260 | 760 | 83 | globlastp |
| 4884 | LYM613 | cirsium\|11v1\|SRR346952.145853_P1 | 8261 | 760 | 82.9 | globlastp |
| 4885 | LYM613 | watermelon\|11v1\|AM728431_P1 | 8262 | 760 | 82.9 | globlastp |
| 4886 | LYM613 | soybean\|11v1\|GLYMA09G04430 | 8263 | 760 | 82.9 | globlastp |
| 4887 | LYM613 | soybean\|11v1\|GLYMA15G15480 | 8264 | 760 | 82.9 | globlastp |
| 4888 | LYM613 | sunflower\|10v1\|DY906438 | 8265 | 760 | 82.9 | globlastp |
| 4889 | LYM613 | sunflower\|12v1\|DY906438_P1 | 8265 | 760 | 82.9 | globlastp |
| 4890 | LYM613 | melon\|10v1\|AM728431_P1 | 8262 | 760 | 82.9 | globlastp |
| 4891 | LYM613 | soybean\|11v1\|GLYMA17G03430 | 8266 | 760 | 82.9 | globlastp |
| 4892 | LYM613 | catharanthus\|11v1\|EG558780_P1 | 8267 | 760 | 82.8 | globlastp |
| 4893 | LYM613 | vinca\|11v1\|SRR098690X101115_P1 | 8268 | 760 | 82.8 | globlastp |
| 4894 | LYM613 | bean\|12v1\|FE898145_P1 | 8269 | 760 | 82.7 | globlastp |
| 4895 | LYM613 | flaveria\|11v1\|SRR149229.155880_P1 | 8270 | 760 | 82.7 | globlastp |
| 4896 | LYM613 | watermelon\|11v1\|AM721237_P1 | 8271 | 760 | 82.7 | globlastp |
| 4897 | LYM613 | prunus\|10v1\|BU042321 | 8272 | 760 | 82.7 | globlastp |
| 4898 | LYM613 | sequoia\|10v1\|SRR065044S0000578 | 8273 | 760 | 82.6 | globlastp |
| 4899 | LYM613 | chelidonium\|11v1\|SRR084752X118599_P1 | 8274 | 760 | 82.5 | globlastp |
| 4900 | LYM613 | prunus\|10v1\|BU573305 | 8275 | 760 | 82.5 | globlastp |
| 4901 | LYM613 | cephalotaxus\|11v1\|SRR064395X100052_P1 | 8276 | 760 | 82.4 | globlastp |
| 4902 | LYM613 | medicago\|09v1\|BE187613 | 8277 | 760 | 82.4 | globlastp |
| 4903 | LYM613 | medicago\|12v1\|BE187613_P1 | 8277 | 760 | 82.4 | globlastp |
| 4904 | LYM613 | clover\|gb162\|AB236757_P1 | 8278 | 760 | 82.4 | globlastp |
| 4905 | LYM613 | ambrosia\|11v1\|SRR346935.136110_P1 | 8279 | 760 | 82.3 | globlastp |
| 4906 | LYM613 | melon\|10v1\|DV631718_P1 | 8280 | 760 | 82.3 | globlastp |
| 4907 | LYM613 | pigeonpea\|11v1\|SRR054580X125130_T1 | 8281 | 760 | 82.23 | glotblastn |
| 4908 | LYM613 | amsonia\|11v1\|SRR098688X100899_P1 | 8282 | 760 | 82.2 | globlastp |
| 4909 | LYM613 | eucalyptus\|11v2\|CD668073_P1 | 8283 | 760 | 82.2 | globlastp |
| 4910 | LYM613 | trigonella\|11v1\|SRR066194X146772_P1 | 8284 | 760 | 82.2 | globlastp |
| 4911 | LYM613 | cucumber\|09v1\|AM728431_P1 | 8285 | 760 | 82.2 | globlastp |
| 4912 | LYM613 | eucalyptus\|11v1\|CD668073 | 8283 | 760 | 82.2 | globlastp |
| 4913 | LYM613 | chickpea\|11v1\|FE671245_P1 | 8286 | 760 | 82.1 | globlastp |
| 4914 | LYM613 | gossypium_raimondii\|12v1\|AI728649_P1 | 8287 | 760 | 82.1 | globlastp |
| 4915 | LYM613 | gossypium_raimondii\|12v1\|DT547712_P1 | 8288 | 760 | 82.1 | globlastp |
| 4916 | LYM613 | cichorium\|gb171\|EH673771_P1 | 8289 | 760 | 82.1 | globlastp |
| 4917 | LYM613 | cotton\|10v2\|DT549479 | 8290 | 760 | 82.1 | globlastp |
| 4918 | LYM613 | lotus\|09v1\|CRPLJ011361_P1 | 8291 | 760 | 82.1 | globlastp |
| 4919 | LYM613 | pepper\|gb1711AF369707_P1 | 8292 | 760 | 82.1 | globlastp |
| 4920 | LYM613 | poplar\|10v1\|CA924614_P1 | 8293 | 760 | 82.1 | globlastp |
| 4921 | LYM613 | cotton\|11v1\|AI728649_P1 | 8287 | 760 | 82.1 | globlastp |
| 4922 | LYM613 | cucumber\|09v1\|DN909459_P1 | 8294 | 760 | 82.1 | globlastp |
| 4923 | LYM613 | taxus\|10v1\|SRR032523S0008792 | 8295 | 760 | 82.02 | glotblastn |
| 4924 | LYM613 | catharanthus\|11v1\|EG560749_P1 | 8296 | 760 | 82 | globlastp |
| 4925 | LYM613 | eschscholzia\|11v1\|CK752191_P1 | 8297 | 760 | 82 | globlastp |
| 4926 | LYM613 | euonymus\|11v1\|SRR070038X117930_P1 | 8298 | 760 | 82 | globlastp |
| 4927 | LYM613 | maritime_pine\|10v1\|BX250058_P1 | 8299 | 760 | 82 | globlastp |
| 4928 | LYM613 | strawberry\|11v1\|CO378810 | 8300 | 760 | 82 | globlastp |
| 4929 | LYM613 | soybean\|11v1\|GLYMA03G39210 | 8301 | 760 | 82 | globlastp |
| 4930 | LYM613 | soybean\|11v1\|GLYMA19G41770 | 8302 | 760 | 82 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 4931 | LYM613 | bean\|12v1\|CA899390_P1 | 8303 | 760 | 82 | globlastp |
| 4932 | LYM613 | pine\|10v2\|AA556627_P1 | 8299 | 760 | 82 | globlastp |
| 4933 | LYM613 | podocarpus\|10v1\|SRR065014S0001157_P1 | 8304 | 760 | 82 | globlastp |
| 4934 | LYM613 | spruce\|gb162\|CO216885 | 8305 | 760 | 82 | globlastp |
| 4935 | LYM613 | gossypium_raimondii\|12v1\|AI729294_P1 | 8306 | 760 | 81.9 | globlastp |
| 4936 | LYM613 | cotton\|11v1\|CO082221_P1 | 8307 | 760 | 81.9 | globlastp |
| 4937 | LYM613 | cotton\|10v2\|BG447346 | 8308 | 760 | 81.9 | globlastp |
| 4938 | LYM613 | cotton\|11v1\|AI729294_P1 | 8308 | 760 | 81.9 | globlastp |
| 4939 | LYM613 | peanut\|10v1\|GO258144_T1 | 8309 | 760 | 81.89 | glotblastn |
| 4940 | LYM613 | phalaenopsis\|11v1\|HO059358_P1 | 8310 | 760 | 81.8 | globlastp |
| 4941 | LYM613 | rose\|12v1\|SRR397984.103369_P1 | 8311 | 760 | 81.8 | globlastp |
| 4942 | LYM613 | oak\|10v1\|DB998642_P1 | 8312 | 760 | 81.8 | globlastp |
| 4943 | LYM613 | pseudotsuga\|10v1\|SRR065119S0006823 | 8313 | 760 | 81.8 | globlastp |
| 4944 | LYM613 | bean\|12v1\|FG232922_T1 | 8314 | 760 | 81.77 | glotblastn |
| 4945 | LYM613 | cotton\|10v2\|CA992748 | 8315 | 760 | 81.75 | glotblastn |
| 4946 | LYM613 | potato\|10v1\|BG350070_P1 | 8316 | 760 | 81.7 | globlastp |
| 4947 | LYM613 | solanum_phureja\|09v1\|SPHBG127084 | 8316 | 760 | 81.7 | globlastp |
| 4948 | LYM613 | tomato\|09v1\|BG127084 | 8317 | 760 | 81.7 | globlastp |
| 4949 | LYM613 | bean\|gb167\|CA899390 | 8318 | 760 | 81.61 | glotblastn |
| 4950 | LYM613 | ambrosia\|11v1\|SRR346935.134706_P1 | 8319 | 760 | 81.6 | globlastp |
| 4951 | LYM613 | castorbean\|11v1\|EE257564_P1 | 8320 | 760 | 81.6 | globlastp |
| 4952 | LYM613 | apple\|11v1\|CN491386_P1 | 8321 | 760 | 81.5 | globlastp |
| 4953 | LYM613 | arnica\|11v1\|SRR099034X101482_P1 | 8322 | 760 | 81.5 | globlastp |
| 4954 | LYM613 | beet\|12v1\|BQ489081_P1 | 8323 | 760 | 81.5 | globlastp |
| 4955 | LYM613 | cedrus\|11v1\|SRR065007X104038_P1 | 8324 | 760 | 81.5 | globlastp |
| 4956 | LYM613 | flaveria\|11v1\|SRR149229.11178_P1 | 8325 | 760 | 81.5 | globlastp |
| 4957 | LYM613 | phyla\|11v2\|SRR099035X111448_P1 | 8326 | 760 | 81.5 | globlastp |
| 4958 | LYM613 | sunflower\|12v1\|CD857229_P1 | 8327 | 760 | 81.5 | globlastp |
| 4959 | LYM613 | cacao\|10v1\|CU500965_P1 | 8328 | 760 | 81.5 | globlastp |
| 4960 | LYM613 | chestnut\|gb170\|SRR006295S0025538_P1 | 8329 | 760 | 81.5 | globlastp |
| 4961 | LYM613 | dandelion\|10v1\|DR398918_T1 | 8330 | 760 | 81.5 | glotblastn |
| 4962 | LYM613 | lettuce\|10v1\|DW112072_P1 | 8331 | 760 | 81.5 | globlastp |
| 4963 | LYM613 | arnica\|11v1\|SRR099034X104265_T1 | 8332 | 760 | 81.46 | glotblastn |
| 4964 | LYM613 | poplar\|10v1\|CN523665_P1 | 8333 | 760 | 81.4 | globlastp |
| 4965 | LYM613 | sunflower\|10v1\|CD853290 | 8334 | 760 | 81.4 | globlastp |
| 4966 | LYM613 | sunflower\|12v1\|CD853290_P1 | 8335 | 760 | 81.4 | globlastp |
| 4967 | LYM613 | flaveria\|11v1\|SRR149229.11815_T1 | 8336 | 760 | 81.36 | glotblastn |
| 4968 | LYM613 | abies\|11v2\|SRR098676X100270_P1 | 8337 | 760 | 81.3 | globlastp |
| 4969 | LYM613 | amborella\|12v2\|CK758678_P1 | 8338 | 760 | 81.3 | globlastp |
| 4970 | LYM613 | cirsium\|11v1\|SRR346952.1131212_P1 | 8339 | 760 | 81.3 | globlastp |
| 4971 | LYM613 | citrus\|gb166\|CK665649 | 8340 | 760 | 81.3 | globlastp |
| 4972 | LYM613 | oak\|10v1\|FP042090_P1 | 8341 | 760 | 81.3 | globlastp |
| 4973 | LYM613 | sunflower\|12v1\|CD849801_P1 | 8342 | 760 | 81.3 | globlastp |
| 4974 | LYM613 | eschscholzia\|11v1\|SRR014116.19395_P1 | 8343 | 760 | 81.2 | globlastp |
| 4975 | LYM613 | eucalyptus\|11v2\|ES592214_P1 | 8344 | 760 | 81.2 | globlastp |
| 4976 | LYM613 | grape\|11v1\|GSVIVT01028079001_P1 | 8345 | 760 | 81.2 | globlastp |
| 4977 | LYM613 | phalaenopsis\|11v1\|SRR125771.1003109_P1 | 8346 | 760 | 81.2 | globlastp |
| 4978 | LYM613 | eucalyptus\|11v1\|ES592214 | 8344 | 760 | 81.2 | globlastp |
| 4979 | LYM613 | ambrosia\|11v1\|SRR346935.11371_T1 | 8347 | 760 | 81.19 | glotblastn |
| 4980 | LYM613 | peanut\|10v1\|EE123670_T1 | 8348 | 760 | 81.19 | glotblastn |
| 4981 | LYM613 | beech\|11v1\|SRR006293.17569_P1 | 8349 | 760 | 81.1 | globlastp |
| 4982 | LYM613 | vinca\|11v1\|SRR098690X131031_P1 | 8350 | 760 | 81.1 | globlastp |
| 4983 | LYM613 | apple\|gb171\|CN863481 | 8351 | 760 | 81.1 | globlastp |
| 4984 | LYM613 | oak\|10v1\|DB997296_P1 | 8352 | 760 | 81.1 | globlastp |
| 4985 | LYM613 | orange\|11v1\|CK665649_P1 | 8353 | 760 | 81.1 | globlastp |
| 4986 | LYM613 | tomato\|09v1\|BG131430 | 8354 | 760 | 81.1 | globlastp |
| 4987 | LYM613 | tomato\|11v1\|BG131430_P1 | 8354 | 760 | 81.1 | globlastp |
| 4988 | LYM613 | medicago\|09v1\|AW257189 | 8355 | 760 | 81.1 | globlastp |
| 4989 | LYM613 | medicago\|12v1\|AW257189_P1 | 8355 | 760 | 81.1 | globlastp |
| 4990 | LYM613 | valeriana\|11v1\|SRR099039X106946_T1 | 8356 | 760 | 81.02 | glotblastn |
| 4991 | LYM613 | artemisia\|10v1\|EY111321_T1 | 8357 | 760 | 81.01 | glotblastn |
| 4992 | LYM613 | artemisia\|10v1\|EY085219_P1 | 8358 | 760 | 81 | globlastp |
| 4993 | LYM613 | cacao\|10v1\|CU473459_P1 | 8359 | 760 | 81 | globlastp |
| 4994 | LYM613 | ambrosia\|11v1\|SRR346935.144595_T1 | 8360 | 760 | 80.98 | glotblastn |
| 4995 | LYM613 | trigonella\|11v1\|SRR066194X248935_T1 | 8361 | 760 | 80.9 | glotblastn |
| 4996 | LYM613 | cassava\|09v1\|CK642920_T1 | 8362 | 760 | 80.9 | glotblastn |
| 4997 | LYM613 | citrus\|gb166\|CF419828 | 8363 | 760 | 80.9 | globlastp |
| 4998 | LYM613 | clementine\|11v1\|CF419828_P1 | 8363 | 760 | 80.9 | globlastp |
| 4999 | LYM613 | clementine\|11v1\|CK665649_P1 | 8364 | 760 | 80.9 | globlastp |
| 5000 | LYM613 | orange\|11v1\|CF419828_P1 | 8363 | 760 | 80.9 | globlastp |
| 5001 | LYM613 | strawberry\|11v1\|DY666898 | 8365 | 760 | 80.9 | globlastp |
| 5002 | LYM613 | poppy\|11v1\|SRR030259.106518_P1 | 8366 | 760 | 80.8 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 5003 | LYM613 | cynara\|gb167\|GE577965_P1 | 8367 | 760 | 80.8 | globlastp |
| 5004 | LYM613 | potato\|10v1\|BG594078_P1 | 8368 | 760 | 80.8 | globlastp |
| 5005 | LYM613 | solanum_phureja\|09v1\|SPHBG131430 | 8368 | 760 | 80.8 | globlastp |
| 5006 | LYM613 | soybean\|11v1\|GLYMA07G37180 | 8369 | 760 | 80.8 | globlastp |
| 5007 | LYM613 | cotton\|11v1\|BG444336_P1 | 8370 | 760 | 80.8 | globlastp |
| 5008 | LYM613 | apple\|11v1\|CN489875_P1 | 8371 | 760 | 80.7 | globlastp |
| 5009 | LYM613 | sunflower\|10v1\|CD849801 | 8372 | 760 | 80.7 | globlastp |
| 5010 | LYM613 | gossypium_raimondii\|12v1\|DW491896_P1 | 8373 | 760 | 80.6 | globlastp |
| 5011 | LYM613 | cotton\|10v2\|BG444336 | 8374 | 760 | 80.6 | globlastp |
| 5012 | LYM613 | rice\|11v1\|AU077990_P1 | 8375 | 760 | 80.6 | globlastp |
| 5013 | LYM613 | rice\|gb170\|OS05G06350 | 8375 | 760 | 80.6 | globlastp |
| 5014 | LYM613 | trigonella\|11v1\|SRR066194X168106_P1 | 8376 | 760 | 80.5 | globlastp |
| 5015 | LYM613 | nasturtium\|10v1\|SRR032558S0000067 | 8377 | 760 | 80.5 | globlastp |
| 5016 | LYM613 | orobanche\|10v1\|SRR023189S0019902_P1 | 8378 | 760 | 80.5 | globlastp |
| 5017 | LYM613 | ambrosia\|11v1\|SRR346935.120699_P1 | 8379 | 760 | 80.4 | globlastp |
| 5018 | LYM613 | arabidopsis\|10v1\|AT4G16143_P1 | 8380 | 760 | 80.4 | globlastp |
| 5019 | LYM613 | arabidopsis_lyrata\|09v1\|JGIAL026620_P1 | 8381 | 760 | 80.3 | globlastp |
| 5020 | LYM613 | canola\|11v1\|CN728836_P1 | 8382 | 760 | 80.3 | globlastp |
| 5021 | LYM613 | chickpea\|11v1\|FE668766_P1 | 8383 | 760 | 80.3 | globlastp |
| 5022 | LYM613 | thellungiella_halophilum\|11v1\|BY815722_P1 | 8384 | 760 | 80.3 | globlastp |
| 5023 | LYM613 | b_rapa\|11v1\|L47920_P1 | 8385 | 760 | 80.1 | globlastp |
| 5024 | LYM613 | tabernaemontana\|11v1\|SRR098689X103178XX1_P1 | 8386 | 760 | 80.1 | globlastp |
| 5025 | LYM613 | sugarcane\|10v1\|CA067990 | 8387 | 760 | 80.1 | globlastp |
| 5026 | LYM613 | zostera\|10v1\|SRR057351S0003096_T1 | 8388 | 760 | 80.04 | glotblastn |
| 5027 | LYM613 | castorbean\|11v1\|CF981412_P1 | 8389 | 760 | 80 | globlastp |
| 5028 | LYM613 | gossypium_raimondii\|12v1\|BQ409584_P1 | 8390 | 760 | 80 | globlastp |
| 5029 | LYM613 | cassava\|09v1\|JGICASSAVA23756VALIDM1_P1 | 8391 | 760 | 80 | globlastp |
| 5030 | LYM627 | sorghum\|09v1\|SLXL50313361Dl | 8392 | 764 | 89.8 | globlastp |
| 5031 | LYM627 | sorghum\|12v1\|SB12VlCRP006190_P1 | 8392 | 764 | 89.8 | globlastp |
| 5032 | LYM627 | foxtail_millet\|10v2\|SICRP014424 | 8393 | 764 | 83 | globlastp |
| 5033 | LYM627 | foxtail_millet\|11v3\|PHY7SI000891M_T1 | 8394 | 764 | 82.64 | glotblastn |
| 5034 | LYM627 | foxtail_millet\|11v3\|SICRP013249_P1 | 8395 | 764 | 82.6 | globlastp |
| 5035 | LYM634 | maize\|10v1\|BM332469_T1 | 8396 | 766 | 80.81 | glotblastn |
| 5036 | LYM635 | wheat\|10v2\|BE401041XX2 | 8397 | 767 | 98.04 | glotblastn |
| 5037 | LYM635 | amorphophallus\|11v2\|SRR089351X107338_T1 | 8398 | 767 | 96.47 | glotblastn |
| 5038 | LYM635 | sorghum\|12v1\|GFXEF115542X26_P1 | 8399 | 767 | 95.3 | globlastp |
| 5039 | LYM635 | sugarcane\|10v1\|CA273314 | 8399 | 767 | 95.3 | globlastp |
| 5040 | LYM635 | barley\|10v2\|GFXEF115541X24_P1 | 8400 | 767 | 94.9 | globlastp |
| 5041 | LYM635 | rice\|11v1\|GFXAP006728X29_P1 | 8401 | 767 | 94.7 | globlastp |
| 5042 | LYM635 | brachypodium\|09v1\|TMPLOS04G16714T1 | 8401 | 767 | 94.7 | globlastp |
| 5043 | LYM635 | rice\|gb170\|OS04G16714 | 8401 | 767 | 94.7 | globlastp |
| 5044 | LYM635 | brachypodium\|09v1\|GFXEU325680X24 | 8402 | 767 | 94.7 | globlastp |
| 5045 | LYM635 | brachypodium\|12v1\|BRADI4G37052_P1 | 8402 | 767 | 94.7 | globlastp |
| 5046 | LYM635 | rice\|gb170\|OS04G16742 | 8403 | 767 | 94.5 | globlastp |
| 5047 | LYM635 | rice\|gb170\|OS04G16854 | 8404 | 767 | 94.5 | globlastp |
| 5048 | LYM635 | lolium\|10v1\|GFXAM777385X24_P1 | 8405 | 767 | 94.3 | globlastp |
| 5049 | LYM635 | amorphophallus\|11v2\|SRR089351X300894_P1 | 8406 | 767 | 94.1 | globlastp |
| 5050 | LYM635 | euonymus\|11v1\|GFXAY237135X2_T1 | 8407 | 767 | 93.74 | glotblastn |
| 5051 | LYM635 | pineapple\|10v1\|GFXAY147458X2_P1 | 8408 | 767 | 93.7 | globlastp |
| 5052 | LYM635 | soybean\|11v1\|GFXDQ317523X26 | 8409 | 767 | 92.55 | glotblastn |
| 5053 | LYM635 | cotton\|10v2\|GFXAP009123X1 | 8410 | 767 | 92.2 | globlastp |
| 5054 | LYM635 | gossypium_raimondii\|12v1\|DN799892_P1 | 8411 | 767 | 92 | globlastp |
| 5055 | LYM635 | eucalyptus\|11v2\|CT981419_P1 | 8412 | 767 | 91.6 | globlastp |
| 5056 | LYM635 | eucalyptus\|11v2\|GFXAY780259X26_P1 | 8412 | 767 | 91.6 | globlastp |
| 5057 | LYM635 | potato\|10v1\|GFXDQ231562X23_P1 | 8413 | 767 | 91.6 | globlastp |
| 5058 | LYM635 | solanum_phureja\|09v1\|SPHGFXAM087200X24 | 8414 | 767 | 91.6 | globlastp |
| 5059 | LYM635 | eucalyptus\|11v1\|GFXAY780259X26 | 8412 | 767 | 91.6 | globlastp |
| 5060 | LYM635 | sunflower\|12v1\|AJ519778_P1 | 8415 | 767 | 91.6 | globlastp |
| 5061 | LYM635 | bean\|12v1\|SRR001335.428244_T1 | 8416 | 767 | 91.57 | glotblastn |
| 5062 | LYM635 | gossypium_raimondii\|12v1\|DW487737_P1 | 8417 | 767 | 91.4 | globlastp |
| 5063 | LYM635 | medicago\|12v1\|BG644701_P1 | 8418 | 767 | 91.4 | globlastp |
| 5064 | LYM635 | olea\|11v1\|SRR014465.6187_P1 | 8419 | 767 | 91.4 | globlastp |
| 5065 | LYM635 | ginseng\|10v1\|GFXAY582139X25_P1 | 8420 | 767 | 91.4 | globlastp |
| 5066 | LYM635 | prunus\|10v1\|CN856608 | 8421 | 767 | 91.4 | globlastp |
| 5067 | LYM635 | guizotia\|10v1\|GE572902_P1 | 8422 | 767 | 91.4 | globlastp |
| 5068 | LYM635 | amborella\|12v2\|FD429846_P1 | 8423 | 767 | 91.2 | globlastp |
| 5069 | LYM635 | grape\|11v1\|CD009046_P1 | 8424 | 767 | 91.2 | globlastp |
| 5070 | LYM635 | grape\|11v1\|GFXDQ424856X25_P1 | 8424 | 767 | 91.2 | globlastp |
| 5071 | LYM635 | lettuce\|10v1\|GFXAP007232X29_P1 | 8425 | 767 | 91.2 | globlastp |
| 5072 | LYM635 | b_rapa\|11v1\|GFXAF126026X1_P1 | 8426 | 767 | 91 | globlastp |
| 5073 | LYM635 | fagopyrum\|11v1\|GFXEU254477X25_P1 | 8427 | 767 | 91 | globlastp |
| 5074 | LYM635 | sunflower\|10v1\|AJ519778 | 8428 | 767 | 91 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 5075 | LYM635 | arabidopsis_lyrata\|09v1\|JGIAL003825_P1 | 8429 | 767 | 90.8 | globlastp |
| 5076 | LYM635 | castorbean\|11v1\|SRR020785.64944_P1 | 8430 | 767 | 90.6 | globlastp |
| 5077 | LYM635 | arabidopsis\|10v1\|ATCG00065_P1 | 8431 | 767 | 90.4 | globlastp |
| 5078 | LYM635 | canola\|10v1\|GFXAF126026X1 | 8432 | 767 | 90.2 | globlastp |
| 5079 | LYM635 | chickpea\|09v2\|GFXEU835853X25 | 8433 | 767 | 89.6 | globlastp |
| 5080 | LYM635 | jatropha\|09v1\|GFXFJ695500X23_P1 | 8434 | 767 | 89.4 | globlastp |
| 5081 | LYM635 | pea\|11v1\|GFXAF238072X1_P1 | 8435 | 767 | 88.1 | globlastp |
| 5082 | LYM635 | liriodendron\|gb166\|GFXAF123782X3_P1 | 8436 | 767 | 86.7 | globlastp |
| 5083 | LYM635 | bean\|12v1\|Z80873_P1 | 8437 | 767 | 84.3 | globlastp |
| 5084 | LYM635 | zamia\|gb166\|GFXAF188850X3 | 8438 | 767 | 84 | globlastp |
| 5085 | LYM635 | pine\|10v2\|GFXEF421242X1_P1 | 8439 | 767 | 83.3 | globlastp |
| 5086 | LYM636 | sorghum\|09v1\|SB04G004490 | 8440 | 768 | 89.1 | globlastp |
| 5087 | LYM636 | sorghum\|12v1\|SB04G004490_P1 | 8440 | 768 | 89.1 | globlastp |
| 5088 | LYM636 | switchgrass\|gb167\|FE597550 | 8441 | 768 | 85 | globlastp |
| 5089 | LYM636 | foxtail_millet\|11v3\|PHY7SI017893M_P1 | 8442 | 768 | 84.6 | globlastp |
| 5090 | LYM636 | switchgrass\|gb167\|FE597549 | 8443 | 768 | 84 | globlastp |
| 5091 | LYM636 | cenchrus\|gb166\|EB655195_P1 | 8444 | 768 | 82.7 | globlastp |
| 5092 | LYM636 | oat\|10v2\|GR321147 | 8445 | 768 | 80.1 | globlastp |
| 5093 | LYM636 | oat\|11v1\|GR321147_P1 | 8445 | 768 | 80.1 | globlastp |
| 5094 | LYM638 | sorghum\|09v1\|SB10G025230 | 8446 | 769 | 89.4 | globlastp |
| 5095 | LYM638 | sorghum\|12v1\|SB10G025230_P1 | 8446 | 769 | 89.4 | globlastp |
| 5096 | LYM638 | foxtail_millet\|11v3\|PHY7SI006693M_P1 | 8447 | 769 | 89.1 | globlastp |
| 5097 | LYM638 | millet\|10v1\|PMSLX0008794D1_P1 | 8448 | 769 | 88.3 | globlastp |
| 5098 | LYM645 | switchgrass\|gb167\|FE646200 | 8449 | 772 | 83.7 | globlastp |
| 5099 | LYM645 | foxtail_millet\|11v3\|PHY7SI023114M_P1 | 8450 | 772 | 83.2 | globlastp |
| 5100 | LYM645 | foxtail_millet\|10v2\|SICRP019944 | 8450 | 772 | 83.2 | globlastp |
| 5101 | LYM650 | sorghum\|09v1\|SB10G005880 | 8451 | 775 | 98.9 | globlastp |
| 5102 | LYM650 | foxtail_millet\|11v3\|PHY7SI006087M_P1 | 8452 | 775 | 98.4 | globlastp |
| 5103 | LYM650 | switchgrass\|gb167\|FE621615 | 8453 | 775 | 96.9 | globlastp |
| 5104 | LYM650 | rice\|11v1\|AU182694_P1 | 8454 | 775 | 96.1 | globlastp |
| 5105 | LYM650 | brachypodium\|09v1\|GT799154 | 8455 | 775 | 94.3 | globlastp |
| 5106 | LYM650 | brachypodium\|12v1\|BRADI1G47080_P1 | 8455 | 775 | 94.3 | globlastp |
| 5107 | LYM650 | sorghum\|12v1\|SB10G005880_P1 | 8456 | 775 | 91.2 | globlastp |
| 5108 | LYM650 | rice\|gb170\|OS06G08730 | 8457 | 775 | 90.8 | globlastp |
| 5109 | LYM653 | sorghum\|09v1\|SB01G017340 | 8458 | 776 | 96.4 | globlastp |
| 5110 | LYM653 | sorghum\|12v1\|SB01G017340_P1 | 8458 | 776 | 96.4 | globlastp |
| 5111 | LYM653 | millet\|10v1\|EVO454PM025779_P1 | 8459 | 776 | 93.6 | globlastp |
| 5112 | LYM653 | rye\|12v1\|DRR001012.1142_P1 | 8460 | 776 | 82.4 | globlastp |
| 5113 | LYM653 | wheat\|10v2\|BG274425 | 8461 | 776 | 82.3 | globlastp |
| 5114 | LYM653 | wheat\|10v2\|BF473382 | 8462 | 776 | 82.1 | globlastp |
| 5115 | LYM669 | maize\|10v1\|BM380027_P1 | 8463 | 783 | 97.7 | globlastp |
| 5116 | LYM671 | sorghum\|12v1\|SB10G024680_P1 | 8464 | 784 | 95.8 | globlastp |
| 5117 | LYM671 | switchgrass\|gb167\|FE604403_T1 | 8465 | 784 | 88.6 | glotblastn |
| 5118 | LYM671 | rice\|11v1\|AU032635_P1 | 8466 | 784 | 86.3 | globlastp |
| 5119 | LYM671 | rye\|12v1\|DRR001012.117974_P1 | 8467 | 784 | 83.9 | globlastp |
| 5120 | LYM671 | oat\|11v1\|GR344397_P1 | 8468 | 784 | 83.5 | globlastp |
| 5121 | LYM671 | wheat\|10v2\|BM138514_P1 | 8469 | 784 | 83.5 | globlastp |
| 5122 | LYM671 | brachypodium\|12v1\|BRADI1G35600_P1 | 8470 | 784 | 83.3 | globlastp |
| 5123 | LYM671 | barley\|10v2\|BE214251_P1 | 8471 | 784 | 83.1 | globlastp |
| 5124 | LYM673 | brachypodium\|12v1\|BRADI4G08030_P1 | 8472 | 786 | 85 | globlastp |
| 5125 | LYM673 | brachypodium\|09v1\|DV473324 | 8473 | 786 | 84.74 | glotblastn |
| 5126 | LYM702 | maize\|10v1\|BG901364_P1 | 8474 | 790 | 83.5 | globlastp |
| 5127 | LYM704 | maize\|10v1\|AI855140_P1 | 8475 | 792 | 95.7 | globlastp |
| 5128 | LYM704 | foxtail_millet\|10v2\|SICRP011153 | 8476 | 792 | 91 | globlastp |
| 5129 | LYM704 | foxtail_millet\|11v3\|PHY7SI029002M_P1 | 8477 | 792 | 88.3 | globlastp |
| 5130 | LYM704 | brachypodium\|09v1\|GT779639 | 8478 | 792 | 80.48 | glotblastn |
| 5131 | LYM704 | brachypodium\|12v1\|BRADI1G48350_T1 | 8478 | 792 | 80.48 | glotblastn |
| 5132 | LYM716 | rice\|11v1\|AA749684_P1 | 8479 | 797 | 88.1 | globlastp |
| 5133 | LYM716 | rice\|gb170\|OS04G41570 | 8479 | 797 | 88.1 | globlastp |
| 5134 | LYM716 | leymus\|gb166\|EG379262_P1 | 8480 | 797 | 86.3 | globlastp |
| 5135 | LYM716 | brachypodium\|09v1\|DV485204 | 8481 | 797 | 85.2 | globlastp |
| 5136 | LYM716 | brachypodium\|12v1\|BRADI5G14260_P1 | 8481 | 797 | 85.2 | globlastp |
| 5137 | LYM716 | oat\|10v2\|GO589230 | 8482 | 797 | 83 | globlastp |
| 5138 | LYM716 | oat\|11v1\|GO589230_P1 | 8482 | 797 | 83 | globlastp |
| 5139 | LYM720 | maize\|10v1\|DN230533_P1 | 8483 | 798 | 85.3 | globlastp |
| 5140 | LYM720 | foxtail_millet\|11v3\|PHY7SI013494M_P1 | 8484 | 798 | 83.5 | globlastp |
| 5141 | LYM720 | foxtail_millet\|10v2\|SICRP011571 | 8484 | 798 | 83.5 | globlastp |
| 5142 | LYM731 | maize\|10v1\|BE050512_P1 | 8485 | 801 | 87.8 | globlastp |
| 5143 | LYM736 | barley\|10v2\|BE421336XX1_P1 | 804 | 804 | 100 | globlastp |

TABLE 2-continued

Homologues of the identified genes/polypeptides for increasing yield, seed yield, fiber yield, fiber quality, growth rate, vigor, biomass, growth rate, abiotic stress tolerance, nitrogen use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 5144 | LYM737 | rye\|12v1\|DRR001012.136191_T1 | 8486 | 805 | 96.18 | glotblastn |
| 5145 | LYM737 | rye\|12v1\|DRR001012.280837_T1 | 8487 | 805 | 95.42 | glotblastn |
| 5146 | LYM737 | leymus\|gb166\|EG390543_P1 | 8488 | 805 | 95.3 | globlastp |
| 5147 | LYM737 | barley\|10v2\|BI947744_T1 | 8489 | 805 | 95.08 | glotblastn |
| 5148 | LYM737 | rye\|12v1\|DRR001012.233208_T1 | 8490 | 805 | 93.51 | glotblastn |
| 5149 | LYM737 | rye\|12v1\|DRR001012.413549_P1 | 8491 | 805 | 85.5 | globlastp |
| 5150 | LYM737 | rye\|12v1\|DRR001012.188590_P1 | 8492 | 805 | 82.4 | globlastp |
| 5151 | LYM737 | rye\|12v1\|DRR001012.205247_P1 | 8493 | 805 | 82.1 | globlastp |
| 5152 | LYM737 | rye\|12v1\|DRR001012.183230_P1 | 8494 | 805 | 81 | globlastp |
| 5153 | LYM744 | sorghum\|09v1\|SB02G043130 | 8495 | 809 | 86 | globlastp |
| 5154 | LYM744 | sorghum\|12v1\|SB02G043130_P1 | 8495 | 809 | 86 | globlastp |
| 5155 | LYM746 | sugarcane\|10v1\|CA106251 | 8496 | 810 | 97.2 | globlastp |
| 5156 | LYM746 | maize\|10v1\|AI491693_P1 | 8497 | 810 | 95.9 | globlastp |
| 5157 | LYM746 | maize\|10v1\|AI629829_P1 | 8498 | 810 | 95.9 | globlastp |
| 5158 | LYM750 | maize\|10v1\|AI855202_P1 | 8499 | 812 | 98.6 | globlastp |
| 5159 | LYM750 | sorghum\|09v1\|SB10G001780 | 8499 | 812 | 98.6 | globlastp |
| 5160 | LYM750 | sorghum\|12v1\|SB10G001780_P1 | 8499 | 812 | 98.6 | globlastp |
| 5161 | LYM750 | foxtail_millet\|10v2\|EC612212 | 8500 | 812 | 97.1 | globlastp |
| 5162 | LYM750 | foxtail_millet\|11v3\|EC612212_P1 | 8501 | 812 | 95.7 | globlastp |
| 5163 | LYM750 | millet\|10v1\|EVO454PM039273_T1 | 8502 | 812 | 95.65 | glotblastn |
| 5164 | LYM750 | sugarcane\|10v1\|CF572309_T1 | 8503 | 812 | 94.2 | glotblastn |
| 5165 | LYM750 | switchgrass\|gb167\|DN140668 | 8504 | 812 | 94.2 | globlastp |
| 5166 | LYM750 | switchgrass\|gb167\|FL773601 | 8505 | 812 | 92.8 | globlastp |
| 5167 | LYM750 | rice\|11v1\|AA751440_P1 | 8506 | 812 | 87 | globlastp |
| 5168 | LYM750 | rice\|gb170\|OS04G56540 | 8506 | 812 | 87 | globlastp |
| 5169 | LYM750 | oat\|10v2\|GO587692 | 8507 | 812 | 82.6 | globlastp |
| 5170 | LYM750 | oat\|11v1\|GR341598_P1 | 8507 | 812 | 82.6 | globlastp |
| 5171 | LYM750 | lolium\|10v1\|AU247800_P1 | 8508 | 812 | 81.2 | globlastp |
| 5172 | LYM750 | fescue\|gb161\|DT690833_T1 | 8509 | 812 | 81.16 | glotblastn |
| 5173 | LYM750 | onion\|gb162\|CF449681_P1 | 8510 | 812 | 80 | globlastp |
| 9096 | LYM745 | gossypium_raimondii\|12v1\|GR12V1PRD003294 | 9143 | 8524 | 82.8 | globlastp |
| 9097 | LYM745 | amaranthus\|10v1\|SRR039411S0011389 | 9144 | 8524 | 81.33 | glotblastn |
| 9098 | LYM745 | phyla\|11v2\|SRR099035X115605 | 9145 | 8524 | 84.67 | glotblastn |
| 9099 | LYM745 | ginseng\|10v1\|EC599983 | 9146 | 8524 | 86 | glotblastn |
| 9100 | LYM745 | strawberry\|11v1\|GFXDQ768221X1 | — | 8524 | 82 | glotblastn |
| 9101 | LYM745 | medicago\|12v1\|MTPRD023600 | 9147 | 8524 | 87.33 | glotblastn |
| 9102 | LYM745 | clover\|gb162\|BB920596 | 9148 | 8524 | 84.8 | globlastp |
| 9103 | LYM745 | centaurea\|gb166\|EH785657 | 9149 | 8524 | 83.33 | glotblastn |
| 9104 | LYM745 | pigeonpea\|11v1\|SRR054580X130289 | — | 8524 | 84 | glotblastn |
| 9105 | LYM745 | lotus\|09v1\|CRPLJ011653 | 9150 | 8524 | 86.67 | glotblastn |
| 9106 | LYM745 | phyla\|11v2\|SRR099037X11582 | 9151 | 8524 | 82.1 | globlastp |
| 9107 | LYM745 | arnica\|11v1\|SRR099034X10033 | 9152 | 8524 | 84.67 | glotblastn |
| 9108 | LYM745 | castorbean\|11v1\|SRR020784.10090 | 9153 | 8524 | 85.33 | glotblastn |
| 9109 | LYM745 | poppy\|11v1\|FG599496 | — | 8524 | 86 | glotblastn |
| 9110 | LYM745 | pigeonpea\|11v1\|GW350557 | 9154 | 8524 | 82.1 | globlastp |
| 9111 | LYM745 | maize\|10v1\|ZMCRP2V177380 | 9155 | 8524 | 85.3 | globlastp |
| 9112 | LYM745 | brachypodium\|12v1\|BDPRD12V1004628 | — | 8524 | 86 | glotblastn |
| 9113 | LYM745 | castorbean\|11v1\|SOLX00036571 | 9156 | 8524 | 80.67 | glotblastn |
| 9114 | LYM745 | ceratodon\|10v1\|SRR074891S0680381XX1 | 9157 | 8524 | 81.33 | glotblastn |
| 9115 | LYM745 | tripterygium\|11v1\|SRR098677XI00669XX1 | 9158 | 8524 | 83.33 | glotblastn |
| 9116 | LYM745 | bean\|12v1\|CA903678 | — | 8524 | 84.67 | glotblastn |
| 9117 | LYM745 | castorbean\|11v1\|SRR020784.3466 | 9159 | 8524 | 83.33 | glotblastn |
| 9118 | LYM745 | gossypium_raimondii\|12v1\|AI728038 | — | 8524 | 86.67 | glotblastn |
| 9119 | LYM745 | medicago\|12v1\|MTPRDO17482 | 9160 | 8524 | 85.71 | glotblastn |
| 9120 | LYM745 | pigeonpea\|11v1\|CCIIPG11044979 | 9161 | 8524 | 82.1 | globlastp |
| 9121 | LYM745 | orobanche\|10v1\|SRR023189S0001383 | 9162 | 8524 | 82.67 | glotblastn |
| 9122 | LYM745 | artemisia\|10v1\|SRR019254S0053783 | 9163 | 8524 | 81.17 | glotblastn |
| 9123 | LYM745 | lotus\|09v1\|CRPLJ040450 | 9164 | 8524 | 87.7 | globlastp |
| 9124 | LYM745 | tripterygium\|11v1\|SRR098677X106141 | — | 8524 | 83.33 | glotblastn |
| 9125 | LYM745 | lotus\|09v1\|CRPLJ003115 | 9165 | 8524 | 82.1 | globlastp |
| 9126 | LYM745 | walnuts\|gb166\|CB303946 | 9166 | 8524 | 84.1 | globlastp |
| 9127 | LYM745 | conyza\|10v1\|SRR035294S0015476 | 9167 | 8524 | 90 | glotblastn |
| 9128 | LYM745 | eucalyptus\|11v2\|SRR001659X124697 | 9168 | 8524 | 83.4 | globlastp |
| 9129 | LYM745 | phyla\|11v2\|SRR099035X10108 | — | 8524 | 84 | glotblastn |
| 9130 | LYM745 | castorbean\|11v1\|EE258340 | — | 8524 | 85.33 | glotblastn |
| 9131 | LYM745 | coffea\|10v1\|CF588735 | 9169 | 8524 | 86 | glotblastn |
| 9132 | LYM745 | peanut\|10v1\|EG029006 | 9170 | 8524 | 84.67 | glotblastn |
| 9133 | LYM745 | vinca\|11v1\|SRR098690X109897XX3 | — | 8524 | 86 | glotblastn |
| 9134 | LYM745 | gossypium_raimondii\|12v1\|ES806126 | — | 8524 | 86.67 | glotblastn |
| 9135 | LYM745 | sorghum\|12v1\|SB12V1CRP123950 | — | 8524 | 82.67 | glotblastn |
| 9136 | LYM745 | avocado\|10v1\|CK743333 | 9171 | 8524 | 83.33 | glotblastn |
| 9137 | LYM745 | bean\|12v1\|SRR001334.14961 | 9172 | 8524 | 84.67 | glotblastn |

TABLE 2-continued

Homologues of the identified genes/polypeptides for increasing yield, seed yield, fiber yield,
fiber quality, growth rate, vigor, biomass, growth rate, abiotic stress tolerance, nitrogen
use efficiency, water use efficiency and/or fertilizer use efficiency of a plant

| Nucl. SEQ ID NO: | Hom. to Gene Name | cluster name | Polyp. SEQ ID NO: | Hom. to SEQ ID NO: | % global iden. | Algor. |
|---|---|---|---|---|---|---|
| 9138 | LYM745 | ipomoea_batatas\|10v1\|CB330910 | 9173 | 8524 | 88 | glotblastn |
| 9139 | LYM745 | lotus\|09v1\|CRPLJ016207 | 9174 | 8524 | 84.1 | globlastp |
| 9140 | LYM745 | medicago\|12v1\|MTPRD016895 | 9175 | 8524 | 86.36 | glotblastn |
| 9141 | LYM745 | tobacco\|gb162\|AM840441 | 9176 | 8524 | 84.1 | globlastp |
| 9142 | LYM745 | lotus\|09v1\|CRPLJ031511 | 9177 | 8524 | 84.1 | globlastp |

Table 2: Provided are the homologous polypeptides and polynucleotides of the genes for increasing yield (e.g., oil yield, seed yield, fiber yield and/or quality), growth rate, vigor, biomass, abiotic stress tolerance, nitrogen use efficiency, water use efficiency and/or fertilizer use efficiency genes of a plant which are listed in Table 1 above and in Table 51 of the cloned genes below. Homology was calculated as % of identity over the aligned sequences. The query sequences were polynucleotide sequences SEQ ID NOs: 1-277 and 8511, 8513, 8515, 8517, 8519, 8521, 8523 and 277-479; and polypeptide SEQ ID NOs: 480-733, 8512, 8514, 8516, 8518, 8520, 8522, 8524 and 734-812 and the subject sequences are protein sequences identified in the database based on greater than 80% global identity to the predicted translated sequences of the query nucleotide sequences or to the polypeptide sequences. "Nucl." = polynucleotide; "polyp." = polypeptide; "Algor." = algorithm (used for sequence alignment and determination of percent homology); "Hom."—homology; "iden."—identity.

The output of the functional genomics approach described herein is a set of genes highly predicted to improve yield and/or other agronomic important traits such as growth rate, vigor, oil content, fiber yield and/or quality, biomass, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described herein alone or a set of genes together increases the overall yield and/or other agronomic important traits, hence expects to increase agricultural productivity.

Example 3

Production of Barley Transcriptom and High Throughput Correlation Analysis Using 44K Barley Oligonucleotide Micro-Array In order to produce a high throughput correlation analysis, the present inventors utilized a Barley oligonucleotide micro-array, produced by Agilent Technologies [Hypertext Transfer Protocol://World Wide Web(dot)chem.(dot)agilent (dot)com/Scripts/PDS(dot)asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web(dot)davidmlane(dot)com/hyperstat/A34739 (dot) html].

Experimental Procedures

Five tissues at different developmental stages [meristem, flower, booting spike, and stem], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 3 below.

TABLE 3

Barley transcriptom expression sets

| Expression Set | Set ID |
|---|---|
| booting spike | 1 |
| stem | 2 |
| flowering spike | 3 |
| meristem | 4 |

Table 3: Provided are the identification (ID) letters of each of the Barley expression sets.

Barley Yield Components and Vigor Related Parameters Assessment—

13 Barley accessions in 4 repetitive blocks (named A, B, C, and D), each containing 4 plants per plot were grown at net house. Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb(dot)nih(dot)gov/]. Next, analyzed data was saved to text files and processed using the JMP statistical analysis software (SAS institute).

TABLE 4

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |
| Stem pigmentation | Scoring | 1-5 | Green (1), Basal only or Half or more (5) |
| Days to Flowering | Days | | Days from sowing to emergence of awns |

TABLE 4-continued

Barley standard descriptors

| Trait | Parameter | Range | Description |
|---|---|---|---|
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 4.

At the end of the experiment (50% of the spikes were dry) all spikes from plots within blocks A-D were collected, and the following measurements were performed:

(i) Grains Per Spike—

The total number of grains from 5 spikes that were manually threshed was counted. The average grain per spike was calculated by dividing the total grain number by the number of spikes.

(ii) Grain Average Size (cm)—

The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain Average Weight (mgr)—

The total grains from 5 spikes that were manually threshed were counted and weight. The average weight was calculated by dividing the total weight by the total grain number.

(iv) Grain Yield Per Spike (gr)—

The total grains from 5 spikes that were manually threshed were weight. The grain yield was calculated by dividing the total weight by the spike number.

(v) Spike Length Analysis—

The five chosen spikes per plant were measured using measuring tape excluding the awns.

(vi) Spike Number Analysis—

The spikes per plant were counted.

Additional parameters were measured as follows:

Growth Habit Scoring—

At growth stage 10 (booting), each of the plants was scored for its growth habit nature. The scale that was used was 1 for prostate nature till 9 for erect.

Hairiness of Basal Leaves—

At growth stage 5 (leaf sheath strongly erect; end of tillering), each of the plants was scored for its hairiness nature of the leaf before the last. The scale that was used was 1 for prostate nature till 9 for erect.

Plant Height—

At harvest stage (50% of spikes were dry), each of the plants was measured for its height using measuring tape. Height was measured from ground level to top of the longest spike excluding awns.

Days to Flowering—

Each of the plants was monitored for flowering date. Days of flowering was calculated from sowing date till flowering date.

Stem Pigmentation—

At growth stage 10 (booting), each of the plants was scored for its stem color. The scale that was used was 1 for green till 5 for full purple.

Vegetative Dry Weight and Spike Yield—

At the end of the experiment (50% of the spikes were dry) all spikes and vegetative material from plots within blocks A-D are collected. The biomass and spikes weight of each plot was separated, measured and divided by the number of plants.

Dry weight=total weight of the vegetative portion above ground (excluding roots) after drying at 70° C. in oven for 48 hours.

Spike Yield Per Plant= total spike weight per plant (gr) after drying at 30° C. in oven for 48 hours.

TABLE 5

Barley correlated parameters (vectors)

| Correlated parameter with | Correlation ID |
|---|---|
| Days to flowering (days) | 1 |
| Grain weight (miligrams) | 2 |
| Spike length (cm) | 3 |
| Grains size (mm²) | 4 |
| Grains per spike (numbers) | 5 |
| Growth habit (scores 1-9) | 6 |
| Hairiness of basal leaves (scoring 1-2) | 7 |
| Plant height (cm) | 8 |
| Grain Yield per spike (gr/spike) | 9 |
| Stem pigmentation (scoring 1-5) | 10 |
| Vegetative dry weight (gram) | 11 |
| Spikes per plant (numbers) | 12 |

Table 5. Provided are the Barley correlated parameters (vectors).

Experimental Results 13 different Barley accessions were grown and characterized for 12 parameters as described above. The average for each of the measured parameter was calculated using the JMP software and values are summarized in Tables 6 and 7 below. Subsequent correlation analysis between the various transcriptom expression sets (Table 3) and the average parameters was conducted. Follow, results were integrated to the database (Table 8 below).

TABLE 6

Measured parameters of correlation Ids in Barley accessions

| Corr. ID | Ecotype | | | | | | |
|---|---|---|---|---|---|---|---|
| | Line-1 | Line-2 | Line-3 | Line-4 | Line-5 | Line-6 | Line-7 |
| 1 | 62.40 | 64.08 | 65.15 | 58.92 | 63.00 | 70.54 | 52.80 |
| 2 | 35.05 | 28.06 | 28.76 | 17.87 | 41.22 | 29.73 | 25.22 |
| 3 | 12.04 | 10.93 | 11.83 | 9.90 | 11.68 | 11.53 | 8.86 |
| 4 | 0.27 | 0.23 | 0.24 | 0.17 | 0.29 | 0.28 | 0.22 |
| 5 | 20.23 | 17.98 | 17.27 | 17.73 | 14.47 | 16.78 | 12.12 |
| 6 | 2.60 | 2.00 | 1.92 | 3.17 | 4.33 | 2.69 | 3.60 |
| 7 | 1.53 | 1.33 | 1.69 | 1.08 | 1.42 | 1.69 | 1.30 |
| 8 | 134.27 | 130.50 | 138.77 | 114.58 | 127.75 | 129.38 | 103.89 |
| 9 | 3.56 | 2.54 | 2.58 | 1.57 | 3.03 | 2.52 | 1.55 |
| 10 | 1.13 | 2.50 | 1.69 | 1.75 | 2.33 | 2.31 | 1.70 |
| 11 | 78.87 | 66.14 | 68.49 | 53.39 | 68.30 | 74.17 | 35.35 |
| 12 | 48.85 | 48.27 | 37.42 | 61.92 | 33.27 | 41.69 | 40.00 |

Table 6. Provided are the values of each of the parameters measured in Barley accessions (ecotypes, line number) according to the correlation identifications (see Table 5).

TABLE 7

Barley accessions, additional measured parameters

| Corr. ID | Ecotype | | | | | |
|---|---|---|---|---|---|---|
| | Line-8 | Line-9 | Line-10 | Line-11 | Line-12 | Line-13 |
| 1 | 60.88 | 58.10 | 60.40 | 53.00 | 64.58 | 56.00 |
| 2 | 34.99 | 20.58 | 37.13 | 27.50 | 29.56 | 19.58 |
| 3 | 11.22 | 11.11 | 10.18 | 8.58 | 10.51 | 9.80 |
| 4 | 0.28 | 0.19 | 0.27 | 0.22 | 0.27 | 0.18 |
| 5 | 14.07 | 21.54 | 13.40 | 12.10 | 15.28 | 17.07 |
| 6 | 3.50 | 3.00 | 2.47 | 3.67 | 3.50 | 3.00 |
| 7 | 1.19 | 1.00 | 1.60 | 1.17 | 1.08 | 1.17 |
| 8 | 121.63 | 126.80 | 121.40 | 99.83 | 118.42 | 117.17 |
| 9 | 2.62 | 2.30 | 2.68 | 1.68 | 2.35 | 1.67 |
| 10 | 2.19 | 2.30 | 3.07 | 1.83 | 1.58 | 2.17 |
| 11 | 58.33 | 62.23 | 68.31 | 38.32 | 56.15 | 42.68 |
| 12 | 40.63 | 62.00 | 50.60 | 49.33 | 43.09 | 51.40 |

Table 7. Provided are the values of each of the parameters measured in Barley accessions (ecotypes, line number) according to the correlation identifications (see Table 5).

TABLE 8

Correlation between the expression level of the selected polynucleotides of the invention and their homologues in specific tissues or developmental stages and the phenotypic performance across Barley accessions

| Gene Name | R | P value | Exp. set | Corr. vector | Gene Name | R | P value | Exp. set | Corr. vector |
|---|---|---|---|---|---|---|---|---|---|
| LYM521 | 0.75 | 3.09E−02 | 3 | 4 | LYM521 | 0.87 | 5.21E−03 | 3 | 1 |
| LYM522 | 0.72 | 2.95E−02 | 1 | 7 | LYM522 | 0.88 | 3.91E−04 | 4 | 12 |
| LYM525 | 0.83 | 1.07E−02 | 3 | 4 | LYM525 | 0.84 | 8.42E−03 | 3 | 2 |
| LYM525 | 0.77 | 2.45E−02 | 3 | 1 | LYM525 | 0.75 | 1.28E−02 | 3 | 7 |
| LYM525 | 0.89 | 1.22E−03 | 4 | 4 | LYM525 | 0.90 | 1.03E−03 | 4 | 2 |
| LYM525 | 0.71 | 3.30E−02 | 4 | 9 | LYM526 | 0.76 | 2.95E−02 | 3 | 10 |
| LYM529 | 0.72 | 4.43E−02 | 1 | 12 | LYM530 | 0.77 | 1.44E−02 | 4 | 4 |
| LYM530 | 0.78 | 4.48E−03 | 4 | 2 | LYM531 | 0.87 | 4.94E−03 | 4 | 12 |
| LYM531 | 0.87 | 2.47E−03 | 4 | 5 | LYM532 | 0.79 | 1.10E−02 | 4 | 9 |
| LYM532 | 0.73 | 2.50E−02 | 4 | 11 | LYM533 | 0.80 | 8.96E−03 | 1 | 4 |
| LYM533 | 0.85 | 3.54E−03 | 1 | 2 | LYM533 | 0.89 | 1.33E−03 | 1 | 9 |
| LYM533 | 0.76 | 1.65E−02 | 1 | 11 | LYM533 | 0.75 | 7.56E−03 | 1 | 7 |
| LYM534 | 0.81 | 8.38E−03 | 4 | 4 | LYM534 | 0.80 | 3.22E−03 | 4 | 2 |
| LYM679 | 0.74 | 2.23E−02 | 4 | 4 | LYM679 | 0.73 | 1.03E−02 | 4 | 2 |
| LYM742 | 0.74 | 2.31E−02 | 1 | 7 | LYM742 | 0.82 | 4.05E−03 | 3 | 9 |
| LYM742 | 0.73 | 1.76E−02 | 3 | 11 | | | | | |

Table 8. Provided are the correlations (R) and p-values (P) between the expression levels of selected genes of some embodiments of the invention in various tissues or developmental stages [Expression (Exp.) sets] and the phenotypic performance in various yield (seed yield, oil yield, oil content), biomass, growth rate and/or vigor components [Correlation (Corr.) vector (Vec.) specified in Tables 5, 6 and 7]; Exp. Set = expression set specified in Table 3.

Example 4

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot)chem.(dot)agilent(dot) com/Scripts/PDS(dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web(dot)davidmlane(dot)com/hyperstat/ A34739 (dot)html].

Experimental Procedures

Analyzed *Arabidopsis* Tissues—

Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each micro-array expression information tissue type has received a Set ID as summarized in Table 9 below.

TABLE 9

Tissues used for *Arabidopsis* transcriptom expression sets

| Expression Set | Set ID |
|---|---|
| Root | A |
| Leaf | B |
| Flower | C |
| Seed 5 DAF | D |
| Seed 12 DAF | E |

Table 9. Provided are the identification (ID) letters of each of the *Arabidopsis* expression sets (A-E).
DAF = days after flowering.

Yield Components and Vigor Related Parameters Assessment—

Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital Imaging in Tissue Culture—

A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital Imaging in Greenhouse—

The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at Hypertext Transfer Protocol://rsbweb(dot)nih(dot)gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root Analysis—

During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula V.

Relative growth rate of root coverage=Regression coefficient of root coverage along time course.   Formula V:

Vegetative Growth Rate Analysis—
was calculated according to Formula VI. The analysis was ended with the appearance of overlapping plants.

Relative vegetative growth rate area=Regression coefficient of vegetative area along time course.   Formula VI For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in Siliques Analysis—

On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds Average Weight—

At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil Percentage in Seeds—

At the end of the experiment all seeds from plots of blocks A-C were collected. *Columbia* seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique Length Analysis—

On day 50 from sowing, 30 siliques from different plants in each plot were sampled in block A. The chosen siliques were green-yellow in color and were collected from the bottom parts of a grown plant's stem. A digital photograph was taken to determine silique's length.

Dry Weight and Seed Yield—

On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil Yield—

The oil yield was calculated using Formula VII.

Seed Oil yield=Seed yield per plant (gr.)*Oil % in seed.   Formula VII:

Harvest Index (Seed)—

The harvest index was calculated using Formula IV (described above): Harvest Index=Average seed yield per plant/Average dry weight.

Experimental Results

Nine different *Arabidopsis* ecotypes were grown and characterized for 18 parameters (named as vectors).

TABLE 10

Arabidopsis correlated parameters (vectors)

| Correlated parameter with | Correlation ID |
|---|---|
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate (cm²/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Table 10. Provided are the *Arabidopsis* correlated parameters (correlation ID Nos. 1-18). Abbreviations: Cm = centimeter(s); cm² = squared centimeters; gr = gram(s); mg = milligram(s).

The characterized values are summarized in Tables 11 and 12 below.

TABLE 11

Measured parameters in *Arabidopsis* ecotypes

| Ecotype | \multicolumn{9}{c}{Corr. Parameter} |
|---|---|---|---|---|---|---|---|---|---|
|  | 15 | 16 | 12 | 11 | 5 | 17 | 10 | 13 | 14 |
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

Table 11. Provided are the values of each of the correlated (Corr.) parameters measured (According to Table 10 above) in *Arabidopsis* ecotypes: 15 = Seed yield per plant (gram); 16 = oil yield per plant (mg); 12 = oil % per seed; 11 = 1000 seed weight (gr); 5 = dry matter per plant (gr); 17 = harvest index; 10 = total leaf area per plant (cm); 13 = seeds per silique; 14 = Silique length (cm).

TABLE 12

Additional measured parameters in *Arabidopsis* ecotypes

| Ecotype | \multicolumn{9}{c}{Corr. Parameter} |
|---|---|---|---|---|---|---|---|---|---|
|  | 6 | 3 | 2 | 1 | 4 | 9 | 8 | 18 | 7 |
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

Table 12. Provided are the values of each of the correlated (Corr.) parameters measured (According to Table 10 above) in *Arabidopsis* ecotypes: 6 = Vegetative growth rate (cm²/day) until 8 true leaves; 3 = relative root growth (cm/day) (day 13); 2 = Root length day 7 (cm); 1 = Root length day 13 (cm); 4 = fresh weight per plant (gr.) at bolting stage; 9. = Lamina length (cm); 8 = Lamina width (cm); 18 = Leaf width/length; 7 = Blade circularity.

Example 5

Production of *Arabidopsis* Transcriptom and High Throughput Correlation Analysis of Normal and Nitrogen Limiting Conditions Using 44K *Arabidopsis* Oligonucleotide Micro-Array In order to produce a high throughput correlation analysis, the present inventors utilized an *Arabidopsis* oligonucleotide micro-array, produced by Agilent Technologies [Hypertext Transfer Protocol://World Wide Web(dot)chem(dot)agilent(dot)com/Scripts/PDS(dot)asp?1Page=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot)davidmlane(dot)com/hyperstat/A34739 (dot)html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 13 below.

TABLE 13

Tissues used for *Arabidopsis* transcriptom expression sets

| Expression Set | Set ID |
|---|---|
| Leaves at 1.5 mM Nitrogen fertilization | A |
| Leaves at 6 mM Nitrogen fertilization | B |
| Stems at 1.5 mM Nitrogen fertilization | C |
| Stem at 6 mM Nitrogen fertilization | D |

Table 13. Provided are the identification (ID) letters of each of the *Arabidopsis* expression sets.

Assessment of *Arabidopsis* Yield Components and Vigor Related Parameters Under Different Nitrogen Fertilization Levels—

10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol:// rsb(dot)info(dot)nih(dot)gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol:// rsbweb(dot)nih(dot)gov/]. Next, analyzed data was saved to text files and processed using the JMP statistical analysis software (SAS institute).

Data parameters collected are summarized in Table 14, hereinbelow.

TABLE 14

Arabidopsis correlated parameters (vectors)

| Correlated parameter with | Correlation Id |
|---|---|
| N 1.5 mM; Rosette Area at day 8 [cm$^2$] | 1 |
| N 1.5 mM; Rosette Area at day 10 [cm$^2$] | 2 |
| N 1.5 mM; Plot Coverage at day 8 [%] | 3 |
| N 1.5 mM; Plot Coverage at day 10 [%] | 4 |

TABLE 14-continued

Arabidopsis correlated parameters (vectors)

| Correlated parameter with | Correlation Id |
|---|---|
| N 1.5 mM; Leaf Number at day 10 | 5 |
| N 1.5 mM; Leaf Blade Area at day 10 [cm$^2$] | 6 |
| N 1.5 mM; RGR of Rosette Area at day 3 [cm$^2$/day] | 7 |
| N 1.5 mM; t50 Flowering [day] | 8 |
| N 1.5 mM; Dry Weight [gr./plant] | 9 |
| N 1.5 mM; Seed Yield [gr./plant] | 10 |
| N 1.5 mM; Harvest Index | 11 |
| N 1.5 mM; 1000 Seeds weight [gr.] | 12 |
| N 1.5 mM; seed yield/rosette area at day 10 [gr./cm$^2$] | 13 |
| N 1.5 mM; seed yield/leaf blade [gr./cm$^2$] | 14 |
| N 1.5 mM; % Seed yield reduction compared to N 6 mM | 15 |
| N 1.5 mM; % Biomass reduction compared to N 6 mM | 16 |
| N 1.5 mM; N level/DW [SPAD unit/gr.] | 17 |
| N 1.5 mM; DW/N level [gr/SPAD unit] | 18 |
| N 1.5 mM; seed yield/N level [gr/SPAD unit] | 19 |
| N 6 mM; Rosette Area at day 8 [cm$^2$] | 20 |
| N 6 mM; Rosette Area at day 10 [cm$^2$] | 21 |
| N 6 mM; Plot Coverage at day 8 [%] | 22 |
| N 6 mM; Plot Coverage at day 10 [%] | 23 |
| N 6 mM; Leaf Number at day 10 | 24 |
| N 6 mM; Leaf Blade Area at day 10 | 25 |
| N 6 mM; RGR of Rosette Area at day 3 [cm$^2$/gr.] | 26 |
| N 6 mM; t50 Flowering [day] | 27 |
| N 6 mM; Dry Weight [gr./plant] | 28 |
| N 6 mM; Seed Yield [gr./plant] | 29 |
| N 6 mM; Harvest Index | 30 |
| N 6 mM; 1000 Seeds weight [gr.] | 31 |
| N 6 mM; seed yield/rosette area day at day 10 [gr./cm$^2$] | 32 |
| N 6 mM; seed yield/leaf blade [gr./cm$^2$] | 33 |
| N 6 mM; N level/FW | 34 |
| N 6 mM; DW/N level [gr./SPAD unit] | 35 |
| N 6 mM; N level/DW (SPAD unit/gr. plant) | 36 |
| N 6 mM; Seed yield/N unit [gr./SPAD unit] | 37 |

Table 14. Provided are the *Arabidopsis* correlated parameters (vectors).
"N" = Nitrogen at the noted concentrations; "gr." = grams; "SPAD" = chlorophyll levels; "t50" = time where 50% of plants flowered; "gr./SPAD unit" = plant biomass expressed in grams per unit of nitrogen in plant measured by SPAD.
"DW" = Plant Dry Weight; "FW" = Plant Fresh weight; "N level/DW" = plant Nitrogen level measured in SPAD unit per plant biomass [gr.]; "DW/N level" = plant biomass per plant [gr.]/SPAD unit; Rosette Area (measured using digital analysis); Plot Coverage at the indicated day [%] (calculated by the dividing the total plant area with the total plot area); Leaf Blade Area at the indicated day [cm$^2$] (measured using digital analysis); RGR (relative growth rate) of Rosette Area at the indicated day [cm$^2$/day]; t50 Flowering [day] (the day in which 50% of plant flower); seed yield/rosette area at day 10 [gr/cm$^2$] (calculated); seed yield/leaf blade [gr/cm$^2$] (calculated); seed yield/N level [gr/SPAD unit] (calculated).

Assessment of NUE, Yield Components and Vigor-Related Parameters—

Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

The image processing system which was used is described in Example 4 above.

Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf Analysis—

Using the digital analysis leaves data was calculated, including leaf number, leaf blade area, plot coverage, Rosette diameter and Rosette area.

Relative Growth Rate Area:

The relative growth rate area of the rosette and the leaves was calculated according to Formulas VIII and IX, respectively.

Relative growth rate of rosette area=Regression coefficient of rosette area along time course.   Formula VIII:

Relative growth rate of plant leaf number=Regression coefficient of plant leaf number along time course.   Formula IX Seed Yield and 1000 Seeds Weight—

At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry Weight and Seed Yield—

At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index (Seed)—

The harvest index was calculated using Formula IV as described above [Harvest Index=Average seed yield per plant/Average dry weight].

$T_{50}$ Days to Flowering—

Each of the repeats was monitored for flowering date. Days of flowering was calculated from sowing date till 50% of the plots flowered.

Plant Nitrogen Level—

The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of Seed Yield Reduction— measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 37 parameters as described above. The average for each of the measured parameters was calculated using the JMP software (Table 15 below). Subsequent correlation analysis between the various transcriptom sets (Table 13) and the average parameters were conducted.

TABLE 15

Measured parameters in *Arabidopsis* accessions

| Treatment | Ecotype | | | | | | | | | |
|---|---|---|---|---|---|---|---|---|---|---|
| | Line-1 | Line-2 | Line-3 | Line-4 | Line-5 | Line-6 | Line-7 | Line-8 | Line-9 | Line-10 |
| N 1.5 mM; Rosette Area at day 8 | 0.760 | 0.709 | 1.061 | 1.157 | 0.996 | 1.000 | 0.910 | 0.942 | 1.118 | 0.638 |
| N 1.5 mM; Rosette Area at day 10 | 1.430 | 1.325 | 1.766 | 1.971 | 1.754 | 1.832 | 1.818 | 1.636 | 1.996 | 1.150 |
| N 1.5 mM; Plot Coverage % at day 8 | 3.221 | 3.003 | 4.497 | 4.902 | 4.220 | 4.238 | 3.858 | 3.990 | 4.738 | 2.705 |
| N 1.5 mM; Plot Coverage % at day 10 | 6.058 | 5.614 | 7.484 | 8.351 | 7.432 | 7.764 | 7.702 | 6.933 | 8.458 | 4.871 |
| N 1.5 mM; Leaf Number at day 10 | 6.875 | 7.313 | 7.313 | 7.875 | 7.938 | 7.750 | 7.625 | 7.188 | 8.625 | 5.929 |
| N 1.5 mM; Leaf Blade Area at day 10 | 0.335 | 0.266 | 0.374 | 0.387 | 0.373 | 0.370 | 0.386 | 0.350 | 0.379 | 0.307 |
| N 1.5 mM; RGR of Rosette Area at day 3 | 0.631 | 0.793 | 0.502 | 0.491 | 0.605 | 0.720 | 0.825 | 0.646 | 0.668 | 0.636 |
| N 1.5 mM; t50 Flowering [day] | 15.967 | 20.968 | 14.836 | 24.708 | 23.566 | 23.698 | 18.059 | 19.488 | 23.568 | 21.888 |
| N 1.5 mM; Dry Weight [gr/plant] | 0.164 | 0.124 | 0.082 | 0.113 | 0.184 | 0.124 | 0.134 | 0.106 | 0.148 | 0.171 |
| N 1.5 mM; Seed Yield [gr/plant] | 0.032 | 0.025 | 0.023 | 0.010 | 0.006 | 0.009 | 0.032 | 0.019 | 0.012 | 0.014 |
| N 1.5 mM; Harvest Index | 0.192 | 0.203 | 0.295 | 0.085 | 0.031 | 0.071 | 0.241 | 0.179 | 0.081 | 0.079 |
| N 1.5 mM; 1000 Seeds weight[gr] | 0.016 | 0.016 | 0.018 | 0.014 | 0.018 | 0.022 | 0.015 | 0.014 | 0.022 | 0.019 |
| N 1.5 mM; seed yield/ rosette area day at day 10 | 0.022 | 0.019 | 0.014 | 0.005 | 0.003 | 0.005 | 0.018 | 0.013 | 0.007 | 0.012 |
| N 1.5 mM; seed yield/leaf blade | 0.095 | 0.095 | 0.063 | 0.026 | 0.015 | 0.024 | 0.084 | 0.059 | 0.034 | 0.044 |

TABLE 15-continued

Measured parameters in *Arabidopsis* accessions

| Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| N 1.5 mM; % Seed yield reduction compared to 6 mM | 72.559 | 84.701 | 78.784 | 87.996 | 91.820 | 92.622 | 76.710 | 81.938 | 91.301 | 85.757 |
| N 1.5 mM; % Biomass reduction compared to 6 mM | 60.746 | 76.706 | 78.560 | 78.140 | 62.972 | 78.641 | 73.192 | 83.068 | 77.190 | 70.120 |
| N 1.5 mM; Spad/FW | 45.590 | | | 42.108 | 28.151 | | 53.111 | | | 67.000 |
| N 1.5 mM; SPAD/DW | 167.300 | | | 241.061 | 157.823 | | 194.977 | | | 169.343 |
| N 1.5 mM; DW/SPAD | 0.006 | | | 0.004 | 0.006 | | 0.005 | | | 0.006 |
| N 1.5 mM; seed yield/spad | 0.001 | | | 0.000 | 0.000 | | 0.001 | | | 0.000 |
| N 6 mM; Rosette Area at day 8 | 0.759 | 0.857 | 1.477 | 1.278 | 1.224 | 1.095 | 1.236 | 1.094 | 1.410 | 0.891 |
| N 6 mM; Rosette Area at day 10 | 1.406 | 1.570 | 2.673 | 2.418 | 2.207 | 2.142 | 2.474 | 1.965 | 2.721 | 1.642 |
| N 6 mM; Plot Coverage % at day 8 | 3.216 | 3.631 | 6.259 | 5.413 | 5.187 | 4.641 | 5.236 | 4.634 | 5.974 | 3.774 |
| N 6 mM; Plot Coverage % at day 10 | 5.957 | 6.654 | 11.324 | 10.244 | 9.352 | 9.076 | 10.485 | 8.327 | 11.528 | 6.958 |
| N 6 mM; Leaf Number at day 10 | 6.250 | 7.313 | 8.063 | 8.750 | 8.063 | 8.750 | 8.375 | 7.125 | 9.438 | 6.313 |
| N 6 mM; Leaf Blade Area at day 10 | 0.342 | 0.315 | 0.523 | 0.449 | 0.430 | 0.430 | 0.497 | 0.428 | 0.509 | 0.405 |
| N 6 mM; RGR of Rosette Area at day 3 | 0.689 | 1.024 | 0.614 | 0.601 | 0.477 | 0.651 | 0.676 | 0.584 | 0.613 | 0.515 |
| N 6 mM; t50 Flowering [day] | 16.371 | 20.500 | 14.635 | 24.000 | 23.378 | 23.595 | 15.033 | 19.750 | 22.887 | 18.804 |
| N 6 mM; Dry Weight [gr/plant] | 0.419 | 0.531 | 0.382 | 0.518 | 0.496 | 0.579 | 0.501 | 0.628 | 0.649 | 0.573 |
| N 6 mM; Seed Yield [gr/plant] | 0.116 | 0.165 | 0.108 | 0.082 | 0.068 | 0.119 | 0.139 | 0.107 | 0.138 | 0.095 |
| N 6 mM; Harvest Index | 0.280 | 0.309 | 0.284 | 0.158 | 0.136 | 0.206 | 0.276 | 0.171 | 0.212 | 0.166 |
| N 6 mM; 1000 Seeds weight [gr] | 0.015 | 0.017 | 0.018 | 0.012 | 0.016 | 0.016 | 0.015 | 0.014 | 0.017 | 0.016 |
| N 6 mM; seed yield/rosette area day at day 10 | 0.082 | 0.106 | 0.041 | 0.034 | 0.031 | 0.056 | 0.057 | 0.055 | 0.051 | 0.058 |
| N 6 mM; seed yield/leaf blade | 0.339 | 0.526 | 0.207 | 0.183 | 0.158 | 0.277 | 0.281 | 0.252 | 0.271 | 0.235 |
| N 6 mM; Spad/FW | 22.489 | | | 28.268 | 17.641 | | 33.323 | | | 39.003 |
| N 6 mM; DW/SPAD (biomass/N unit) | 0.019 | | | 0.018 | 0.028 | | 0.015 | | | 0.015 |
| N 6 mM; spad/DW (gN/g plant) | 53.705 | | | 54.625 | 35.548 | | 66.479 | | | 68.054 |
| N 6 mM; Seed yield/N unit | 0.004 | | | 0.003 | 0.002 | | 0.005 | | | 0.003 |

Table 15. Provided are the measured parameters under various treatments in various ecotypes (*Arabidopsis* accessions).

Example 6

Production of *Sorghum* Transcriptom and High Throughput Correlation Analysis with ABST Related Parameters Using 44K *Sorghum* Oligonucleotide Micro-Arrays In order to produce a high throughput correlation analysis between plant phenotype and gene expression level, the present inventors utilized a *sorghum* oligonucleotide microarray, produced by Agilent Technologies [Hypertext Transfer Protocol://World Wide Web(dot)chem.(dot)agilent(dot)com/Scripts/PDS(dot)asp?1Page=50879]. The array oligonucleotide represents about 44,000 *sorghum* genes and transcripts. In order to define correlations between the levels of RNA expression with ABST, yield and NUE components or vigor related parameters, various plant characteristics of 17 different *sorghum* hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot)davidmlane(dot)com/hyperstat/A34739 (dot)html].

I. Correlation of *Sorghum* Varieties Across Ecotypes Grown Under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular Growth Conditions:

*sorghum* plants were grown in the field using commercial fertilization and irrigation protocols (370 liter per meter, fertilization of 14 units of 21% urea per entire growth period).

2. Drought Conditions:

*sorghum* seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen Fertilization Conditions:

sorghum plants were fertilized with 50% less amount of nitrogen in the field than the amount of nitrogen applied in the regular growth treatment. All the fertilizer was applied before flowering.

Analyzed *Sorghum* Tissues—

All 10 selected *Sorghum* hybrids were sample per each treatment. Tissues [Flag leaf, Flower meristem and Flower] from plants growing under normal conditions, severe drought stress and low nitrogen conditions were sampled and RNA was extracted as described above. Each microarray expression information tissue type has received a Set ID as summarized in Table 16 below.

TABLE 16

Sorghum transcriptom expression sets

| Expression Set | Set ID |
|---|---|
| Flag leaf Normal | 1 |
| Flower meristem Normal | 2 |
| Flower Normal | 3 |
| Flag leaf low nitrogen (N) | 4 |
| Flower meristem low nitrogen (N) | 5 |
| Flower low nitrogen (N) | 6 |
| Flag leaf Drought | 7 |
| Flower meristem Drought | 8 |
| Flower Drought | 9 |

Table 16: Provided are the sorghum transcriptom expression sets 1-9.
Flag leaf = the leaf below the flower;
Flower meristem = Apical meristem following panicle initiation;
Flower = the flower at the anthesis day.
Expression sets 1, 2 and 3 are from plants grown under normal conditions.
Expression sets 4-6 are from plants grown under low nitrogen conditions.
Expression sets 7-9 are from plants grown under drought stress conditions.

The following parameters were collected using digital imaging system:

At the end of the growing period the grains were separated from the Plant 'Head' and the following parameters were measured and collected:

Average Grain Area (cm$^2$)—

A sample of ~200 grains were weight, photographed and images were processed using the below described image processing system. The grain area was measured from those images and was divided by the number of grains.

(ii) Upper and Lower Ratio Average of Grain Area, Width, Diameter and Perimeter—

Grain projection of area, width, diameter and perimeter were extracted from the digital images using open source package imagej (nih). Seed data was analyzed in plot average levels as follows:

Average of all seeds;

Average of upper 20% fraction—contained upper 20% fraction of seeds; and

Average of lower 20% fraction—contained lower 20% fraction of seeds;

Further on, ratio between each fraction and the plot average was calculated for each of the data parameters.

At the end of the growing period 5 'Heads' were, photographed and images were processed using the below described image processing system.

(i) Head Average Area (cm$^2$)—

At the end of the growing period 5 'Heads' were photographed and images were processed using the below described image processing system. The 'Head' area was measured from those images and was divided by the number of 'Heads'.

(ii) Head Average Length (cm)—

At the end of the growing period 5 'Heads' were photographed and images were processed using the below described image processing system. The 'Head' length (longest axis) was measured from those images and was divided by the number of 'Heads'.

(iii) Head Average Width (cm)—

At the end of the growing period 5 'Heads' were photographed and images were processed using the below described image processing system. The 'Head' width was measured from those images and was divided by the number of 'Heads'.

(iiii) Head Average Width (cm)—

At the end of the growing period 5 'Heads' were photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (Grain Yield)—

At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—

At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants).

Plant Height—

Plants were characterized for height during growing period at 5 time points. In each measure, plants were measured for their height using a measuring tape. Height was measured from ground level to top of the longest leaf.

SPAD—

Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative Fresh Weight and Heads—

At the end of the experiment (when Inflorescence were dry) all Inflorescence and vegetative material from plots within blocks A-C were collected. The biomass and Heads weight of each plot was separated, measured and divided by the number of Heads.

Plant Biomass (Fresh Weight)—

At the end of the experiment (when Inflorescence were dry) the vegetative material from plots within blocks A-C were collected. The plants biomass without the Inflorescence were measured and divided by the number of Plants.

FW Heads/(FW Heads+FW Plants)—

The total fresh weight of heads and their respective plant biomass were measured at the harvest day. The heads weight was divided by the sum of weights of heads and plants.

Experimental Results 17 different *sorghum* varieties were grown and characterized for different parameters: The average for each of the measured parameter was calculated using the JMP software (Tables 18-19) and a subsequent correlation analysis between the various transcriptom sets (Table 16) and the average parameters (Tables 17-19), was conducted (Table 20). Results were then integrated to the database.

TABLE 17

Sorghum correlated parameters (vectors)

| Correlated parameter with | Correlation ID |
|---|---|
| Total grain weight/Head gr (based on plot), Normal | 1 |
| Total grain weight/Head gr (based on 5 heads), Normal | 2 |
| Head Average Area (cm$^2$), Normal | 3 |
| Head Average Perimeter (cm), Normal | 4 |
| Head Average Length (cm), Normal | 5 |
| Head Average Width (cm), Normal | 6 |
| Average Grain Area (cm$^2$), Normal | 7 |
| Upper Ratio Average Grain Area, Normal | 8 |
| Lower Ratio Average Grain Area, Normal | 9 |
| Lower Ratio Average Grain Perimeter, Normal | 10 |
| Lower Ratio Average Grain Length, Normal | 11 |
| Lower Ratio Average Grain Width, Normal | 12 |
| Final Plant Height (cm), Normal | 13 |
| FW - Head/Plant gr (based on 5 plants), Normal | 14 |
| FW - Head/Plant gr (based on plot), Normal | 15 |
| FW/Plant gr (based on plot), Normal | 16 |
| Leaf SPAD 64 DPS (Days Post Sowing), Normal | 17 |
| FW Heads/(FW Heads + FW Plants) (all plot), Normal | 18 |
| [Plant biomass (FW)/SPAD 64 DPS], Normal | 19 |
| [Grain Yield + plant biomass/SPAD 64 DPS], Normal | 20 |

TABLE 17-continued

Sorghum correlated parameters (vectors)

| Correlated parameter with | Correlation ID |
|---|---|
| [Grain yield/SPAD 64 DPS], Normal | 21 |
| Total grain weight/Head (based on plot) gr, Low N | 22 |
| Total grain weight/Head gr (based on 5 heads), Low N | 23 |
| Head Average Area (cm$^2$), Low N | 24 |
| Head Average Perimeter (cm), Low N | 25 |
| Head Average Length (cm), Low N | 26 |
| Head Average Width (cm), Low N | 27 |
| Average Grain Area (cm$^2$), Low N | 28 |
| Upper Ratio Average Grain Area, Low N | 29 |
| Lower Ratio Average Grain Area, Low N | 30 |
| Lower Ratio Average Grain Perimeter, Low N | 31 |
| Lower Ratio Average Grain Length, Low N | 32 |
| Lower Ratio Average Grain Width, Low N | 33 |
| Final Plant Height (cm), Low N | 34 |
| FW - Head/Plant gr (based on 5 plants), Low N | 35 |
| FW - Head/Plant gr (based on plot), Low N | 36 |
| FW/Plant gr (based on plot), Low N | 37 |
| Leaf SPAD 64 DPS (Days Post Sowing), Low N | 38 |
| FW Heads/(FW Heads + FW Plants) (all plot), Low N | 39 |
| [Plant biomass (FW)/SPAD 64 DPS], Low N | 40 |
| [Grain Yield + plant biomass/SPAD 64 DPS], Low N | 41 |
| [Grain yield/SPAD 64 DPS], Low N | 42 |
| Total grain weight/Head gr, (based on plot) Drought | 43 |
| Head Average Area (cm$^2$), Drought | 44 |
| Head Average Perimeter (cm), Drought | 45 |
| Head Average Length (cm), Drought | 46 |
| Head Average Width (cm), Drought | 47 |
| Average Grain Area (cm$^2$), Drought | 48 |
| Upper Ratio Average Grain Area, Drought | 49 |
| Final Plant Height (cm), Drought | 50 |
| FW - Head/Plant gr. (based on plot), Drought | 51 |
| FW/Plant gr (based on plot), Drought | 52 |
| Leaf SPAD 64 DPS (Days Post Sowing), Drought | 53 |
| FW Heads/(FW Heads + FW Plants)(all plot), Drought | 54 |
| [Plant biomass (FW)/SPAD 64 DPS], Drought | 55 |

Table 17. Provided are the Sorghum correlated parameters (vectors).
"gr." = grams;
"SPAD" = chlorophyll levels;
"FW" = Plant Fresh weight;
"normal" = standard growth conditions.

TABLE 18

Measured parameters in Sorghum accessions

| Corr. ID | Ecotype | | | | | | | | |
|---|---|---|---|---|---|---|---|---|---|
| | Line-1 | Line-2 | Line-3 | Line-4 | Line-5 | Line-6 | Line-7 | Line-8 | Line-9 |
| 1 | 31.12 | 26.35 | 18.72 | 38.38 | 26.67 | 28.84 | 47.67 | 31.00 | 39.99 |
| 2 | 47.40 | 46.30 | 28.37 | 70.40 | 32.15 | 49.23 | 63.45 | 44.45 | 56.65 |
| 3 | 120.14 | 167.6 | 85.14 | 157.26 | 104.00 | 102.48 | 168.54 | 109.32 | 135.13 |
| 4 | 61.22 | 67.90 | 56.26 | 65.38 | 67.46 | 67.46 | 74.35 | 56.16 | 61.64 |
| 5 | 25.58 | 26.84 | 21.02 | 26.84 | 23.14 | 21.82 | 31.33 | 23.18 | 25.70 |
| 6 | 5.97 | 7.92 | 4.87 | 7.43 | 5.58 | 5.88 | 6.78 | 5.99 | 6.62 |
| 7 | 0.10 | 0.11 | 0.13 | 0.13 | 0.14 | 0.14 | 0.11 | 0.11 | 0.10 |
| 8 | 1.22 | 1.30 | 1.13 | 1.14 | 1.16 | 1.15 | 1.19 | 1.23 | 1.25 |
| 9 | 0.83 | 0.74 | 0.78 | 0.80 | 0.70 | 0.70 | 0.83 | 0.81 | 0.84 |
| 10 | 0.91 | 0.87 | 0.91 | 0.95 | 0.90 | 0.91 | 0.91 | 0.91 | 0.92 |
| 11 | 0.91 | 0.88 | 0.92 | 0.91 | 0.89 | 0.88 | 0.91 | 0.90 | 0.92 |
| 12 | 0.91 | 0.83 | 0.85 | 0.87 | 0.79 | 0.80 | 0.90 | 0.89 | 0.91 |
| 13 | 95.25 | 79.20 | 197.85 | 234.20 | 189.40 | 194.67 | 117.25 | 92.80 | 112.65 |
| 14 | 406.50 | 518.0 | 148.00 | 423.00 | 92.00 | 101.33 | 423.50 | 386.50 | 409.50 |
| 15 | 175.15 | 223.49 | 56.40 | 111.62 | 67.34 | 66.90 | 126.18 | 107.74 | 123.86 |
| 16 | 162.56 | 212.59 | 334.83 | 313.46 | 462.28 | 318.26 | 151.13 | 137.60 | 167.98 |
| 17 | 43.01 | | 43.26 | 44.74 | 45.76 | 41.61 | 45.21 | 45.14 | 43.03 |
| 18 | 0.51 | 0.51 | 0.12 | 0.26 | 0.12 | 0.18 | 0.46 | 0.43 | 0.42 |
| 19 | 0.72 | 0.43 | 0.86 | 0.58 | 0.69 | 1.05 | 0.69 | 0.93 | 0.84 |
| 20 | 4.50 | 8.17 | 7.87 | 10.68 | 8.34 | 4.40 | 3.74 | 4.83 | 3.67 |
| 21 | 3.78 | 7.74 | 7.01 | 10.10 | 7.65 | 3.34 | 3.05 | 3.90 | 2.83 |
| 22 | 25.95 | 30.57 | 19.37 | 35.62 | 25.18 | 22.18 | 49.96 | 27.48 | 51.12 |
| 23 | 50.27 | 50.93 | 36.13 | 73.10 | 37.87 | 36.40 | 71.67 | 35.00 | 76.73 |

TABLE 18-continued

Measured parameters in Sorghum accessions

| Corr. ID | Line-1 | Line-2 | Line-3 | Line-4 | Line-5 | Line-6 | Line-7 | Line-8 | Line-9 |
|---|---|---|---|---|---|---|---|---|---|
| 24 | 96.24 | 214.72 | 98.59 | 182.83 | 119.64 | 110.19 | 172.36 | 84.81 | 156.25 |
| 25 | 56.32 | 79.20 | 53.25 | 76.21 | 67.27 | 59.49 | 79.28 | 51.52 | 69.88 |
| 26 | 23.22 | 25.58 | 20.93 | 28.43 | 24.32 | 22.63 | 32.11 | 20.38 | 26.69 |
| 27 | 5.26 | 10.41 | 5.93 | 8.25 | 6.19 | 6.12 | 6.80 | 5.25 | 7.52 |
| 28 | 0.11 | 0.11 | 0.14 | 0.12 | 0.14 | 0.13 | 0.12 | 0.12 | 0.12 |
| 29 | 1.18 | 1.31 | 1.11 | 1.21 | 1.19 | 1.18 | 1.16 | 1.23 | 1.17 |
| 30 | 0.82 | 0.77 | 0.81 | 0.79 | 0.78 | 0.80 | 0.83 | 0.79 | 0.81 |
| 31 | 0.90 | 0.88 | 0.92 | 0.90 | 0.92 | 0.92 | 0.92 | 0.89 | 0.90 |
| 32 | 0.91 | 0.90 | 0.92 | 0.90 | 0.91 | 0.93 | 0.92 | 0.89 | 0.90 |
| 33 | 0.90 | 0.85 | 0.89 | 0.88 | 0.86 | 0.87 | 0.91 | 0.89 | 0.90 |
| 34 | 104.00 | 80.93 | 204.73 | 125.40 | 225.40 | 208.07 | 121.40 | 100.27 | 121.13 |
| 35 | 388.00 | 428.67 | 297.67 | 280.00 | 208.33 | 303.67 | 436.00 | 376.33 | 474.67 |
| 36 | 214.78 | 205.05 | 73.49 | 122.96 | 153.07 | 93.23 | 134.11 | 77.43 | 129.63 |
| 37 | 204.78 | 199.64 | 340.51 | 240.60 | 537.78 | 359.40 | 149.20 | 129.06 | 178.71 |
| 38 | 38.33 | 38.98 | 42.33 | 40.90 | 43.15 | 39.85 | 42.68 | 43.31 | 39.01 |
| 39 | 0.51 | 0.51 | 0.17 | 0.39 | 0.21 | 0.19 | 0.48 | 0.37 | 0.42 |
| 40 | 5.34 | 5.12 | 8.05 | 5.88 | 12.46 | 9.02 | 3.50 | 2.98 | 4.58 |
| 41 | 6.02 | 5.91 | 8.50 | 6.75 | 13.05 | 9.58 | 4.67 | 3.61 | 5.89 |
| 42 | 0.68 | 0.78 | 0.46 | 0.87 | 0.58 | 0.56 | 1.17 | 0.63 | 1.31 |
| 43 | 22.11 | 16.77 | 9.19 | 104.44 | 3.24 | 22.00 | 9.97 | 18.58 | 29.27 |
| 44 | 83.14 | 107.79 | 88.68 | 135.91 | 90.76 | 123.95 | 86.06 | 85.20 | 113.10 |
| 45 | 52.78 | 64.49 | 56.59 | 64.37 | 53.21 | 71.66 | 55.61 | 52.96 | 69.83 |
| 46 | 21.63 | 21.94 | 21.57 | 22.01 | 20.99 | 28.60 | 21.35 | 20.81 | 24.68 |
| 47 | 4.83 | 6.31 | 5.16 | 7.78 | 5.28 | 5.49 | 5.04 | 5.07 | 5.77 |
| 48 | 0.10 | 0.11 | 0.11 | 0.09 | 0.09 | 0.11 | | | |
| 49 | 1.31 | 1.19 | 1.29 | 1.46 | 1.21 | 1.21 | | | |
| 50 | 89.40 | 75.73 | 92.10 | 94.30 | 150.80 | 110.73 | 99.20 | 84.00 | 99.00 |
| 51 | 154.90 | 122.02 | 130.51 | 241.11 | 69.03 | 186.41 | 62.11 | 39.02 | 58.94 |
| 52 | 207.99 | 138.02 | 255.41 | 402.22 | 233.55 | 391.75 | 89.31 | 50.61 | 87.02 |
| 53 | 40.58 | 40.88 | 45.01 | 42.30 | 45.24 | 40.56 | 44.80 | 45.07 | 40.65 |
| 54 | 0.42 | 0.47 | 0.42 | 0.37 | 0.23 | 0.31 | 0.41 | 0.44 | 0.40 |
| 55 | 5.13 | 3.38 | 5.67 | 9.51 | 5.16 | 9.66 | 1.99 | 1.12 | 2.14 |

Table 18: Provided are the values of each of the parameters (as described above) measured in Sorghum accessions (ecotype) under normal, low nitrogen and drought conditions. Growth conditions are specified in the experimental procedure section.

TABLE 19

Additional measured parameters in Sorghum accessions

| Corr. ID | Line-10 | Line-11 | Line-12 | Line-13 | Line-14 | Line-15 | Line-16 | Line-17 |
|---|---|---|---|---|---|---|---|---|
| 1 | 38.36 | 32.10 | 32.69 | 32.79 | 51.53 | 35.71 | 38.31 | 42.44 |
| 2 | 60.00 | 45.45 | 58.19 | 70.60 | 70.10 | 53.95 | 59.87 | 52.65 |
| 3 | 169.03 | 156.10 | 112.14 | 154.74 | 171.70 | 168.51 | 162.51 | 170.46 |
| 4 | 71.40 | 68.56 | 56.44 | 67.79 | 71.54 | 78.94 | 67.03 | 74.11 |
| 5 | 28.82 | 28.13 | 22.97 | 28.09 | 30.00 | 30.54 | 27.17 | 29.26 |
| 6 | 7.42 | 6.98 | 6.19 | 7.02 | 7.18 | 7.00 | 7.39 | 7.35 |
| 7 | 0.12 | 0.12 | 0.11 | 0.12 | 0.11 | 0.10 | 0.11 | 0.11 |
| 8 | 1.24 | 1.32 | 1.22 | 1.18 | 1.18 | 1.22 | 1.25 | 1.22 |
| 9 | 0.79 | 0.77 | 0.80 | 0.81 | 0.82 | 0.81 | 0.82 | 0.82 |
| 10 | 0.93 | 0.91 | 0.92 | 0.90 | 0.91 | 0.90 | 0.91 | 0.91 |
| 11 | 0.92 | 0.89 | 0.91 | 0.91 | 0.91 | 0.90 | 0.90 | 0.91 |
| 12 | 0.85 | 0.86 | 0.88 | 0.90 | 0.90 | 0.91 | 0.90 | 0.90 |
| 13 | 97.50 | 98.00 | 100.00 | 105.60 | 151.15 | 117.10 | 124.45 | 126.50 |
| 14 | 328.95 | 391.00 | 435.75 | 429.50 | 441.00 | 415.75 | 429.50 | 428.50 |
| 15 | 102.75 | 82.33 | 77.59 | 91.17 | 150.44 | 109.10 | 107.58 | 130.88 |
| 16 | 128.97 | 97.62 | 99.32 | 112.24 | 157.42 | 130.55 | 135.66 | 209.21 |
| 17 | 45.59 | 44.83 | 45.33 | 46.54 | 43.99 | 45.09 | 45.14 | 43.13 |
| 18 | 0.44 | 0.46 | 0.45 | 0.45 | 0.51 | 0.46 | 0.44 | 0.39 |
| 19 | 0.72 | 0.72 | 0.70 | 1.17 | 0.79 | 0.85 | 0.98 | |
| 20 | 2.89 | 2.91 | 3.12 | 4.75 | 3.69 | 3.85 | 5.84 | |
| 21 | 2.18 | 2.19 | 2.41 | 3.58 | 2.90 | 3.01 | 4.85 | |
| 22 | 36.84 | 29.45 | 26.70 | 29.42 | 51.12 | 37.04 | 39.85 | 41.78 |
| 23 | 57.58 | 42.93 | 36.47 | 68.60 | 71.80 | 49.27 | 43.87 | 52.07 |
| 24 | 136.71 | 137.70 | 96.54 | 158.19 | 163.95 | 138.39 | 135.46 | 165.64 |
| 25 | 66.17 | 67.37 | 57.90 | 70.61 | 73.76 | 66.87 | 65.40 | 75.97 |
| 26 | 26.31 | 25.43 | 23.11 | 27.87 | 28.88 | 27.64 | 25.52 | 30.33 |
| 27 | 6.59 | 6.85 | 5.32 | 7.25 | 7.19 | 6.27 | 6.57 | 6.82 |
| 28 | 0.13 | 0.13 | 0.12 | 0.12 | 0.11 | 0.11 | 0.12 | 0.11 |

TABLE 19-continued

Additional measured parameters in Sorghum accessions

| Corr. ID | Ecotype | | | | | | | |
|---|---|---|---|---|---|---|---|---|
| | Line-10 | Line-11 | Line-12 | Line-13 | Line-14 | Line-15 | Line-16 | Line-17 |
| 29 | 1.22 | 1.24 | 1.19 | 1.23 | 1.16 | 1.34 | 1.21 | 1.21 |
| 30 | 0.77 | 0.74 | 0.80 | 0.79 | 0.82 | 0.80 | 0.81 | 0.81 |
| 31 | 0.91 | 0.89 | 0.90 | 0.90 | 0.91 | 0.89 | 0.90 | 0.90 |
| 32 | 0.91 | 0.89 | 0.90 | 0.89 | 0.91 | 0.89 | 0.89 | 0.90 |
| 33 | 0.86 | 0.84 | 0.90 | 0.89 | 0.91 | 0.90 | 0.90 | 0.90 |
| 34 | 94.53 | 110.00 | 115.07 | 104.73 | 173.67 | 115.60 | 138.80 | 144.40 |
| 35 | 437.67 | 383.00 | 375.00 | 425.00 | 434.00 | 408.67 | 378.50 | 432.00 |
| 36 | 99.83 | 76.95 | 84.25 | 92.24 | 138.83 | 113.32 | 95.50 | 129.49 |
| 37 | 124.27 | 101.33 | 132.12 | 117.90 | 176.99 | 143.67 | 126.98 | 180.45 |
| 38 | 42.71 | 40.08 | 43.98 | 45.44 | 44.75 | 42.58 | 43.81 | 46.73 |
| 39 | 0.44 | 0.43 | 0.39 | 0.44 | 0.44 | 0.44 | 0.43 | 0.42 |
| 40 | 2.91 | 2.53 | 3.00 | 2.60 | 3.96 | 3.38 | 2.90 | 3.86 |
| 41 | 3.77 | 3.26 | 3.61 | 3.24 | 5.10 | 4.25 | 3.81 | 4.76 |
| 42 | 0.86 | 0.73 | 0.61 | 0.65 | 1.14 | 0.87 | 0.91 | 0.89 |
| 43 | 10.45 | 14.77 | 12.86 | 18.24 | 11.60 | 18.65 | 16.36 | |
| 44 | 100.79 | 80.41 | 126.89 | 86.41 | 92.29 | 77.89 | 76.93 | |
| 45 | 65.14 | 55.27 | 69.06 | 53.32 | 56.29 | 49.12 | 51.88 | |
| 46 | 24.28 | 21.95 | 24.98 | 19.49 | 20.42 | 16.81 | 18.88 | |
| 47 | 5.37 | 4.66 | 6.35 | 5.58 | 5.76 | 5.86 | 5.10 | |
| 48 | | | | | | | | |
| 49 | | | | | | | | |
| 50 | 92.20 | 81.93 | 98.80 | 86.47 | 99.60 | 83.00 | 83.53 | 92.30 |
| 51 | 76.37 | 33.47 | 42.20 | 41.53 | 131.67 | 60.84 | 44.33 | 185.44 |
| 52 | 120.43 | 37.21 | 48.18 | 44.20 | 231.60 | 116.01 | 123.08 | 342.50 |
| 53 | 45.43 | 42.58 | 44.18 | 44.60 | 42.41 | 43.25 | 40.30 | 40.75 |
| 54 | 0.44 | 0.47 | 0.47 | 0.48 | 0.35 | 0.35 | 0.23 | 0.33 |
| 55 | 2.65 | 0.87 | 1.09 | 0.99 | 5.46 | 2.68 | 3.05 | 8.40 |

Table 19: Provided are the values of each of the parameters (as described above) measured in Sorghum accessions (ecotype) under normal, low nitrogen and drought conditions. Growth conditions are specified in the experimental procedure section.

TABLE 20

Correlation between the expression level of selected genes of some embodiments of the invention in various tissues and the phenotypic performance under normal or abiotic stress conditions across Sorghum accessions

| Gene Name | R | P value | Exp. set | Corr. ID | Gene Name | R | P value | Exp. set | Corr. ID |
|---|---|---|---|---|---|---|---|---|---|
| LYM687 | 0.88 | 7.92E−04 | 4 | 34 | LYM687 | 0.90 | 3.59E−04 | 1 | 13 |
| LYM687 | 0.82 | 3.81E−03 | 1 | 1 | LYM687 | 0.88 | 8.40E−04 | 1 | 2 |
| LYM687 | 0.77 | 9.28E−03 | 9 | 53 | LYM687 | 0.78 | 7.69E−03 | 7 | 50 |
| LYM688 | 0.82 | 3.93E−03 | 2 | 8 | LYM688 | 0.81 | 4.83E−03 | 4 | 34 |
| LYM688 | 0.82 | 3.80E−03 | 6 | 28 | LYM688 | 0.73 | 1.57E−02 | 1 | 13 |
| LYM688 | 0.72 | 1.90E−02 | 1 | 2 | LYM689 | 0.81 | 4.58E−03 | 2 | 13 |
| LYM689 | 0.74 | 1.48E−02 | 2 | 1 | LYM689 | 0.83 | 2.91E−03 | 3 | 2 |
| LYM689 | 0.85 | 1.77E−03 | 8 | 55 | LYM689 | 0.76 | 1.03E−02 | 8 | 51 |
| LYM689 | 0.87 | 1.23E−03 | 8 | 52 | LYM689 | 0.76 | 1.11E−02 | 6 | 39 |
| LYM689 | 0.71 | 2.23E−02 | 6 | 32 | LYM690 | 0.83 | 3.00E−03 | 4 | 22 |
| LYM690 | 0.73 | 1.70E−02 | 4 | 32 | LYM690 | 0.81 | 4.88E−03 | 4 | 42 |
| LYM690 | 0.84 | 2.09E−03 | 4 | 31 | LYM690 | 0.79 | 6.91E−03 | 6 | 22 |
| LYM690 | 0.74 | 1.51E−02 | 6 | 42 | LYM690 | 0.76 | 1.14E−02 | 6 | 34 |
| LYM690 | 0.72 | 1.88E−02 | 1 | 16 | LYM691 | 0.84 | 2.19E−03 | 2 | 7 |
| LYM691 | 0.82 | 3.77E−03 | 3 | 13 | LYM691 | 0.71 | 2.05E−02 | 3 | 1 |
| LYM691 | 0.83 | 2.94E−03 | 3 | 2 | LYM691 | 0.73 | 1.73E−02 | 8 | 53 |
| LYM692 | 0.80 | 5.97E−03 | 2 | 13 | LYM692 | 0.74 | 1.52E−02 | 2 | 1 |
| LYM692 | 0.81 | 4.34E−03 | 2 | 2 | LYM692 | 0.90 | 3.96E−04 | 9 | 53 |
| LYM693 | 0.85 | 1.65E−03 | 2 | 21 | LYM693 | 0.81 | 4.87E−03 | 2 | 15 |
| LYM693 | 0.77 | 8.47E−03 | 2 | 16 | LYM693 | 0.83 | 2.83E−03 | 2 | 20 |
| LYM693 | 0.83 | 2.77E−03 | 3 | 2 | LYM693 | 0.78 | 8.20E−03 | 8 | 51 |
| LYM693 | 0.72 | 2.90E−02 | 9 | 44 | LYM694 | 0.80 | 5.05E−03 | 2 | 7 |
| LYM694 | 0.71 | 3.30E−02 | 9 | 47 | LYM694 | 0.83 | 3.13E−03 | 2 | 13 |
| LYM695 | 0.88 | 6.68E−04 | 2 | 1 | LYM695 | 0.87 | 1.08E−03 | 8 | 55 |
| LYM695 | 0.81 | 4.53E−03 | 8 | 51 | LYM695 | 0.88 | 7.40E−04 | 8 | 52 |
| LYM695 | 0.85 | 1.67E−03 | 5 | 35 | LYM695 | 0.71 | 2.09E−02 | 5 | 41 |
| LYM695 | 0.71 | 2.13E−02 | 5 | 22 | LYM695 | 0.77 | 9.21E−03 | 5 | 32 |
| LYM695 | 0.74 | 1.38E−02 | 5 | 37 | LYM695 | 0.75 | 1.34E−02 | 5 | 23 |
| LYM695 | 0.73 | 1.66E−02 | 5 | 42 | LYM695 | 0.77 | 9.44E−03 | 1 | 1 |
| LYM695 | 0.78 | 7.74E−03 | 1 | 2 | LYM697 | 0.88 | 6.67E−04 | 4 | 34 |
| LYM697 | 0.75 | 1.26E−02 | 6 | 36 | LYM697 | 0.71 | 2.27E−02 | 6 | 41 |
| LYM697 | 0.83 | 2.87E−03 | 6 | 39 | LYM697 | 0.93 | 3.02E−04 | 1 | 21 |

TABLE 20-continued

Correlation between the expression level of selected genes of some embodiments of the invention in various tissues and the phenotypic performance under normal or abiotic stress conditions across Sorghum accessions

| Gene Name | R | P value | Exp. set | Corr. ID | Gene Name | R | P value | Exp. set | Corr. ID |
|---|---|---|---|---|---|---|---|---|---|
| LYM697 | 0.83 | 3.24E−03 | 1 | 15 | LYM697 | 0.89 | 1.34E−03 | 1 | 20 |
| LYM698 | 0.75 | 1.22E−02 | 2 | 7 | LYM698 | 0.80 | 5.06E−03 | 3 | 13 |
| LYM698 | 0.77 | 9.14E−03 | 3 | 5 | LYM698 | 0.89 | 5.80E−04 | 3 | 1 |
| LYM698 | 0.74 | 1.42E−02 | 1 | 1 | LYM698 | 0.74 | 1.42E−02 | 1 | 2 |
| LYM698 | 0.84 | 4.55E−03 | 7 | 46 | LYM699 | 0.76 | 1.03E−02 | 2 | 21 |
| LYM699 | 0.78 | 8.38E−03 | 2 | 20 | LYM699 | 0.78 | 1.25E−02 | 3 | 19 |
| LYM699 | 0.71 | 2.06E−02 | 4 | 28 | LYM699 | 0.74 | 1.49E−02 | 1 | 7 |
| LYM700 | 0.72 | 1.78E−02 | 3 | 15 | LYM700 | 0.72 | 1.92E−02 | 3 | 16 |
| LYM700 | 0.71 | 2.09E−02 | 5 | 22 | LYM700 | 0.70 | 2.35E−02 | 5 | 42 |
| LYM700 | 0.71 | 2.24E−02 | 5 | 34 | LYM701 | 0.76 | 1.04E−02 | 3 | 4 |
| LYM701 | 0.80 | 5.59E−03 | 3 | 5 | LYM701 | 0.71 | 2.07E−02 | 4 | 35 |
| LYM701 | 0.87 | 1.22E−03 | 4 | 22 | LYM701 | 0.80 | 5.89E−03 | 4 | 26 |
| LYM701 | 0.81 | 4.35E−03 | 4 | 42 | LYM701 | 0.72 | 1.94E−02 | 4 | 31 |
| LYM701 | 0.77 | 9.83E−03 | 4 | 34 | LYM701 | 0.72 | 1.87E−02 | 8 | 55 |
| LYM701 | 0.82 | 3.44E−03 | 8 | 51 | LYM701 | 0.72 | 1.80E−02 | 8 | 52 |
| LYM701 | 0.72 | 1.95E−02 | 6 | 34 | LYM701 | 0.72 | 1.88E−02 | 5 | 27 |
| LYM701 | 0.91 | 7.48E−04 | 1 | 21 | LYM701 | 0.91 | 2.52E−04 | 1 | 15 |
| LYM701 | 0.71 | 2.15E−02 | 1 | 16 | LYM701 | 0.86 | 2.85E−03 | 1 | 20 |
| LYM701 | 0.83 | 2.94E−03 | 1 | 14 | LYM702 | 0.77 | 8.66E−03 | 2 | 18 |
| LYM702 | 0.79 | 6.09E−03 | 2 | 15 | LYM702 | 0.83 | 2.86E−03 | 2 | 16 |
| LYM702 | 0.76 | 1.15E−02 | 3 | 13 | LYM702 | 0.72 | 1.94E−02 | 3 | 1 |
| LYM702 | 0.88 | 7.41E−04 | 3 | 2 | LYM702 | 0.70 | 2.29E−02 | 1 | 2 |
| LYM702 | 0.83 | 5.58E−03 | 9 | 47 | LYM703 | 0.83 | 2.99E−03 | 3 | 7 |
| LYM703 | 0.72 | 1.96E−02 | 4 | 34 | LYM703 | 0.76 | 1.64E−02 | 8 | 47 |
| LYM703 | 0.70 | 2.30E−02 | 1 | 13 | LYM703 | 0.70 | 2.34E−02 | 1 | 3 |
| LYM703 | 0.87 | 1.03E−03 | 1 | 2 | LYM704 | 0.91 | 2.71E−04 | 2 | 13 |
| LYM704 | 0.73 | 1.62E−02 | 2 | 5 | LYM704 | 0.89 | 6.47E−04 | 2 | 1 |
| LYM704 | 0.81 | 4.20E−03 | 8 | 55 | LYM704 | 0.82 | 3.74E−03 | 8 | 52 |
| LYM704 | 0.73 | 1.56E−02 | 5 | 30 | LYM704 | 0.94 | 4.09E−05 | 5 | 22 |
| LYM704 | 0.74 | 1.52E−02 | 5 | 26 | LYM704 | 0.72 | 1.97E−02 | 5 | 32 |
| LYM704 | 0.92 | 1.90E−04 | 5 | 42 | LYM704 | 0.71 | 2.11E−02 | 5 | 31 |
| LYM704 | 0.78 | 7.45E−03 | 5 | 34 | LYM704 | 0.88 | 7.54E−04 | 1 | 2 |
| LYM705 | 0.78 | 7.48E−03 | 3 | 13 | LYM705 | 0.81 | 4.24E−03 | 8 | 55 |
| LYM705 | 0.77 | 9.36E−03 | 8 | 51 | LYM705 | 0.82 | 3.64E−03 | 8 | 52 |
| LYM705 | 0.81 | 4.63E−03 | 6 | 22 | LYM705 | 0.83 | 2.94E−03 | 6 | 32 |
| LYM705 | 0.77 | 9.85E−03 | 6 | 23 | LYM705 | 0.78 | 7.54E−03 | 6 | 42 |
| LYM705 | 0.82 | 3.32E−03 | 6 | 31 | LYM705 | 0.78 | 7.79E−03 | 6 | 34 |
| LYM705 | 0.78 | 8.20E−03 | 5 | 27 | LYM705 | 0.76 | 1.65E−02 | 1 | 21 |
| LYM705 | 0.76 | 1.16E−02 | 1 | 15 | LYM705 | 0.76 | 1.63E−02 | 1 | 20 |
| LYM706 | 0.83 | 3.22E−03 | 2 | 13 | LYM706 | 0.85 | 1.73E−03 | 2 | 1 |
| LYM706 | 0.76 | 1.06E−02 | 8 | 55 | LYM706 | 0.77 | 9.58E−03 | 8 | 52 |
| LYM706 | 0.78 | 7.33E−03 | 6 | 23 | LYM706 | 0.91 | 3.14E−04 | 5 | 36 |
| LYM706 | 0.91 | 2.60E−04 | 5 | 41 | LYM706 | 0.94 | 6.98E−05 | 5 | 40 |
| LYM706 | 0.88 | 7.64E−04 | 5 | 37 | LYM706 | 0.74 | 1.51E−02 | 1 | 7 |
| LYM706 | 0.79 | 6.56E−03 | 7 | 50 | LYM707 | 0.82 | 3.52E−03 | 2 | 7 |
| LYM707 | 0.71 | 2.23E−02 | 3 | 13 | LYM707 | 0.87 | 1.14E−03 | 4 | 22 |
| LYM707 | 0.80 | 5.04E−03 | 4 | 42 | LYM707 | 0.73 | 1.72E−02 | 4 | 31 |
| LYM707 | 0.92 | 1.83E−04 | 4 | 34 | LYM707 | 0.70 | 2.35E−02 | 8 | 53 |
| LYM707 | 0.71 | 2.23E−02 | 6 | 34 | LYM707 | 0.74 | 1.41E−02 | 1 | 13 |
| LYM707 | 0.78 | 8.42E−03 | 1 | 1 | LYM708 | 0.74 | 1.39E−02 | 2 | 1 |
| LYM708 | 0.76 | 1.09E−02 | 2 | 11 | LYM708 | 0.77 | 9.57E−03 | 4 | 26 |
| LYM708 | 0.88 | 7.17E−04 | 4 | 23 | LYM708 | 0.78 | 8.45E−03 | 4 | 31 |
| LYM708 | 0.76 | 1.06E−02 | 6 | 39 | LYM708 | 0.82 | 3.53E−03 | 5 | 35 |
| LYM708 | 0.82 | 3.47E−03 | 5 | 30 | LYM708 | 0.90 | 4.19E−04 | 5 | 22 |
| LYM708 | 0.77 | 8.79E−03 | 5 | 33 | LYM708 | 0.83 | 2.65E−03 | 5 | 26 |
| LYM708 | 0.79 | 6.67E−03 | 5 | 32 | LYM708 | 0.80 | 5.76E−03 | 5 | 25 |
| LYM708 | 0.89 | 6.08E−04 | 5 | 42 | LYM708 | 0.76 | 1.12E−02 | 5 | 31 |
| LYM708 | 0.75 | 1.21E−02 | 5 | 34 | LYM708 | 0.82 | 3.41E−03 | 1 | 13 |
| LYM708 | 0.70 | 2.31E−02 | 1 | 17 | LYM708 | 0.71 | 2.13E−02 | 1 | 12 |
| LYM708 | 0.76 | 1.77E−02 | 1 | 19 | LYM708 | 0.72 | 1.98E−02 | 1 | 1 |
| LYM709 | 0.89 | 5.72E−04 | 3 | 13 | LYM709 | 0.95 | 2.97E−05 | 3 | 1 |
| LYM709 | 0.75 | 1.32E−02 | 6 | 31 | LYM709 | 0.84 | 2.64E−03 | 6 | 34 |
| LYM709 | 0.71 | 2.22E−02 | 1 | 13 | LYM710 | 0.87 | 1.18E−03 | 2 | 8 |
| LYM710 | 0.91 | 3.13E−04 | 3 | 13 | LYM710 | 0.77 | 8.76E−03 | 3 | 1 |
| LYM710 | 0.72 | 1.78E−02 | 6 | 30 | LYM710 | 0.75 | 1.17E−02 | 6 | 32 |
| LYM710 | 0.75 | 1.24E−02 | 1 | 15 | LYM710 | 0.84 | 2.34E−03 | 1 | 14 |
| LYM710 | 0.77 | 1.47E−02 | 9 | 47 | LYM711 | 0.91 | 2.85E−04 | 2 | 18 |
| LYM711 | 0.93 | 7.46E−05 | 2 | 15 | LYM711 | 0.88 | 6.70E−04 | 2 | 16 |
| LYM711 | 0.81 | 4.21E−03 | 3 | 7 | LYM711 | 0.72 | 1.90E−02 | 4 | 38 |
| LYM711 | 0.86 | 1.55E−03 | 4 | 34 | LYM711 | 0.73 | 1.77E−02 | 1 | 1 |
| LYM712 | 0.72 | 1.87E−02 | 2 | 1 | LYM712 | 0.81 | 4.70E−03 | 3 | 7 |
| LYM712 | 0.86 | 1.34E−03 | 8 | 55 | LYM712 | 0.73 | 1.74E−02 | 8 | 51 |
| LYM712 | 0.87 | 1.14E−03 | 8 | 52 | LYM714 | 0.75 | 1.21E−02 | 4 | 36 |

TABLE 20-continued

Correlation between the expression level of selected genes of some embodiments of the invention in various tissues and the phenotypic performance under normal or abiotic stress conditions across Sorghum accessions

| Gene Name | R | P value | Exp. set | Corr. ID | Gene Name | R | P value | Exp. set | Corr. ID |
|---|---|---|---|---|---|---|---|---|---|
| LYM714 | 0.82 | 3.74E−03 | 4 | 41 | LYM714 | 0.80 | 5.34E−03 | 4 | 40 |
| LYM714 | 0.72 | 1.83E−02 | 4 | 32 | LYM714 | 0.79 | 7.09E−03 | 4 | 37 |
| LYM714 | 0.76 | 1.06E−02 | 1 | 15 | LYM714 | 0.71 | 2.11E−02 | 1 | 3 |
| LYM715 | 0.86 | 1.44E−03 | 3 | 4 | LYM715 | 0.74 | 1.38E−02 | 3 | 3 |
| LYM715 | 0.92 | 1.99E−04 | 3 | 5 | LYM715 | 0.73 | 1.75E−02 | 3 | 1 |
| LYM715 | 0.79 | 6.60E−03 | 4 | 23 | LYM716 | 0.87 | 1.04E−03 | 4 | 22 |
| LYM716 | 0.74 | 1.37E−02 | 4 | 26 | LYM716 | 0.81 | 4.10E−03 | 4 | 42 |
| LYM716 | 0.82 | 3.72E−03 | 4 | 34 | LYM716 | 0.84 | 4.56E−03 | 1 | 21 |
| LYM716 | 0.91 | 2.35E−04 | 1 | 15 | LYM716 | 0.80 | 9.97E−03 | 1 | 20 |
| LYM716 | 0.72 | 1.78E−02 | 1 | 14 | LYM717 | 0.85 | 2.04E−03 | 2 | 13 |
| LYM717 | 0.79 | 6.99E−03 | 3 | 2 | LYM717 | 0.70 | 2.34E−02 | 6 | 32 |
| LYM717 | 0.71 | 2.09E−02 | 6 | 23 | LYM717 | 0.78 | 7.41E−03 | 6 | 31 |
| LYM717 | 0.75 | 1.20E−02 | 1 | 13 | LYM717 | 0.71 | 2.02E−02 | 1 | 2 |
| LYM718 | 0.77 | 8.94E−03 | 3 | 4 | LYM718 | 0.70 | 2.29E−02 | 3 | 12 |
| LYM718 | 0.77 | 9.76E−03 | 3 | 5 | LYM718 | 0.71 | 2.10E−02 | 3 | 16 |
| LYM718 | 0.72 | 1.79E−02 | 3 | 2 | LYM718 | 0.76 | 1.13E−02 | 3 | 9 |
| LYM718 | 0.75 | 1.17E−02 | 4 | 23 | LYM718 | 0.83 | 2.96E−03 | 8 | 55 |
| LYM718 | 0.75 | 1.16E−02 | 8 | 51 | LYM718 | 0.84 | 2.48E−03 | 8 | 52 |
| LYM718 | 0.73 | 1.61E−02 | 5 | 37 | LYM719 | 0.73 | 1.56E−02 | 2 | 17 |
| LYM719 | 0.73 | 1.73E−02 | 2 | 10 | LYM719 | 0.81 | 4.74E−03 | 2 | 11 |
| LYM719 | 0.89 | 1.22E−03 | 1 | 21 | LYM719 | 0.71 | 2.05E−02 | 1 | 17 |
| LYM719 | 0.73 | 1.58E−02 | 1 | 2 | LYM719 | 0.89 | 1.44E−03 | 1 | 20 |
| LYM719 | 0.72 | 1.83E−02 | 7 | 50 | LYM720 | 0.85 | 2.01E−03 | 3 | 2 |
| LYM720 | 0.88 | 6.72E−04 | 8 | 55 | LYM720 | 0.78 | 8.11E−03 | 8 | 51 |
| LYM720 | 0.89 | 5.89E−04 | 8 | 52 | LYM720 | 0.85 | 1.86E−03 | 6 | 31 |
| LYM720 | 0.79 | 1.16E−02 | 1 | 21 | LYM720 | 0.88 | 7.68E−04 | 1 | 15 |
| LYM720 | 0.85 | 1.87E−03 | 1 | 16 | LYM720 | 0.77 | 1.45E−02 | 1 | 20 |
| LYM720 | 0.75 | 1.93E−02 | 9 | 47 | LYM721 | 0.73 | 1.75E−02 | 2 | 7 |
| LYM721 | 0.81 | 4.59E−03 | 4 | 26 | LYM721 | 0.83 | 2.78E−03 | 4 | 23 |
| LYM721 | 0.71 | 2.09E−02 | 4 | 31 | LYM721 | 0.73 | 1.75E−02 | 5 | 31 |
| LYM722 | 0.79 | 6.44E−03 | 3 | 2 | LYM722 | 0.85 | 3.92E−03 | 9 | 44 |
| LYM722 | 0.79 | 1.08E−02 | 9 | 47 | LYM722 | 0.80 | 9.63E−03 | 9 | 45 |
| LYM723 | 0.82 | 3.34E−03 | 2 | 13 | LYM723 | 0.77 | 9.66E−03 | 2 | 1 |
| LYM723 | 0.91 | 2.65E−04 | 8 | 55 | LYM723 | 0.80 | 5.00E−03 | 8 | 51 |
| LYM723 | 0.92 | 1.89E−04 | 8 | 52 | LYM723 | 0.79 | 6.48E−03 | 5 | 36 |
| LYM723 | 0.86 | 1.48E−03 | 5 | 41 | LYM723 | 0.81 | 4.77E−03 | 5 | 40 |
| LYM723 | 0.91 | 2.73E−04 | 5 | 37 | LYM724 | 0.84 | 2.40E−03 | 3 | 13 |
| LYM724 | 0.71 | 2.26E−02 | 3 | 5 | LYM724 | 0.79 | 6.31E−03 | 3 | 1 |
| LYM724 | 0.72 | 1.82E−02 | 3 | 2 | LYM724 | 0.71 | 2.18E−02 | 6 | 34 |
| LYM725 | 0.82 | 3.49E−03 | 2 | 13 | LYM725 | 0.81 | 4.37E−03 | 2 | 1 |
| LYM725 | 0.84 | 2.11E−03 | 8 | 55 | LYM725 | 0.82 | 3.43E−03 | 8 | 51 |
| LYM725 | 0.85 | 1.93E−03 | 8 | 52 | LYM725 | 0.80 | 9.68E−03 | 9 | 47 |
| LYM726 | 0.91 | 2.71E−04 | 3 | 13 | LYM726 | 0.75 | 1.19E−02 | 3 | 1 |
| LYM726 | 0.76 | 1.15E−02 | 6 | 31 | LYM726 | 0.71 | 2.15E−02 | 1 | 16 |
| LYM727 | 0.79 | 6.05E−03 | 2 | 8 | LYM727 | 0.76 | 9.99E−03 | 2 | 7 |
| LYM727 | 0.72 | 1.85E−02 | 3 | 5 | LYM727 | 0.81 | 4.14E−03 | 4 | 22 |
| LYM727 | 0.72 | 1.86E−02 | 4 | 32 | LYM727 | 0.77 | 9.04E−03 | 4 | 23 |
| LYM727 | 0.80 | 5.45E−03 | 4 | 42 | LYM727 | 0.82 | 3.87E−03 | 4 | 31 |
| LYM727 | 0.74 | 1.35E−02 | 6 | 22 | LYM727 | 0.71 | 2.15E−02 | 6 | 42 |
| LYM727 | 0.78 | 8.11E−03 | 5 | 28 | LYM728 | 0.86 | 1.28E−03 | 2 | 13 |
| LYM728 | 0.81 | 4.46E−03 | 2 | 1 | LYM728 | 0.77 | 9.63E−03 | 3 | 13 |
| LYM728 | 0.70 | 2.33E−02 | 3 | 4 | LYM728 | 0.74 | 1.38E−02 | 3 | 3 |
| LYM728 | 0.72 | 1.91E−02 | 3 | 5 | LYM728 | 0.80 | 5.31E−03 | 3 | 2 |
| LYM728 | 0.74 | 1.49E−02 | 7 | 55 | LYM728 | 0.73 | 1.59E−02 | 7 | 52 |
| LYM729 | 0.80 | 5.88E−03 | 2 | 21 | LYM729 | 0.82 | 3.82E−03 | 2 | 20 |
| LYM729 | 0.76 | 1.02E−02 | 3 | 4 | LYM729 | 0.83 | 2.80E−03 | 3 | 5 |
| LYM729 | 0.78 | 7.25E−03 | 1 | 13 | LYM729 | 0.86 | 1.29E−03 | 1 | 1 |
| LYM730 | 0.81 | 4.75E−03 | 3 | 13 | LYM730 | 0.74 | 1.48E−02 | 3 | 1 |
| LYM730 | 0.73 | 1.75E−02 | 4 | 30 | LYM730 | 0.77 | 9.35E−03 | 4 | 33 |
| LYM730 | 0.87 | 1.01E−03 | 4 | 31 | LYM730 | 0.77 | 8.81E−03 | 4 | 34 |
| LYM730 | 0.74 | 1.43E−02 | 1 | 13 | LYM730 | 0.76 | 1.02E−02 | 1 | 5 |
| LYM730 | 0.78 | 8.01E−03 | 1 | 1 | LYM730 | 0.71 | 2.05E−02 | 1 | 2 |
| LYM731 | 0.90 | 3.23E−04 | 3 | 13 | LYM731 | 0.83 | 2.70E−03 | 3 | 1 |
| LYM731 | 0.73 | 1.58E−02 | 3 | 2 | LYM731 | 0.71 | 2.24E−02 | 8 | 53 |
| LYM731 | 0.72 | 1.89E−02 | 6 | 34 | LYM731 | 0.77 | 9.30E−03 | 7 | 53 |
| LYM732 | 0.87 | 1.13E−03 | 2 | 13 | LYM732 | 0.74 | 1.45E−02 | 2 | 12 |
| LYM732 | 0.84 | 2.14E−03 | 2 | 1 | LYM732 | 0.71 | 2.08E−02 | 2 | 2 |
| LYM732 | 0.72 | 1.86E−02 | 2 | 9 | LYM732 | 0.79 | 6.43E−03 | 5 | 34 |
| LYM733 | 0.77 | 9.71E−03 | 2 | 8 | LYM733 | 0.79 | 7.08E−03 | 2 | 7 |
| LYM733 | 0.74 | 2.19E−02 | 1 | 19 | LYM733 | 0.81 | 4.27E−03 | 1 | 2 |

TABLE 20-continued

Correlation between the expression level of selected genes of some embodiments of the invention in various tissues and the phenotypic performance under normal or abiotic stress conditions across Sorghum accessions

| Gene Name | R | P value | Exp. set | Corr. ID | Gene Name | R | P value | Exp. set | Corr. ID |
|---|---|---|---|---|---|---|---|---|---|
| LYM734 | 0.71 | 2.06E−02 | 2 | 6 | LYM734 | 0.81 | 4.78E−03 | 2 | 21 |
| LYM734 | 0.72 | 1.84E−02 | 2 | 15 | LYM734 | 0.77 | 8.95E−03 | 2 | 16 |
| LYM734 | 0.81 | 4.37E−03 | 2 | 20 | LYM734 | 0.72 | 1.99E−02 | 2 | 14 |
| LYM734 | 0.72 | 1.83E−02 | 8 | 55 | LYM734 | 0.78 | 7.86E−03 | 8 | 51 |
| LYM734 | 0.72 | 1.80E−02 | 8 | 52 | LYM734 | 0.70 | 2.38E−02 | 6 | 31 |
| LYM734 | 0.78 | 7.50E−03 | 1 | 17 | LYM734 | 0.71 | 2.28E−02 | 1 | 12 |
| LYM734 | 0.72 | 1.81E−02 | 1 | 10 | LYM734 | 0.75 | 1.24E−02 | 1 | 11 |
| LYM734 | 0.71 | 2.06E−02 | 1 | 9 | LYM746 | 0.77 | 9.65E−03 | 2 | 13 |
| LYM746 | 0.71 | 2.27E−02 | 2 | 12 | LYM746 | 0.76 | 1.06E−02 | 2 | 1 |
| LYM746 | 0.86 | 1.26E−03 | 8 | 55 | LYM746 | 0.79 | 6.99E−03 | 8 | 51 |
| LYM746 | 0.87 | 9.58E−04 | 8 | 52 | LYM746 | 0.72 | 1.86E−02 | 5 | 36 |
| LYM746 | 0.78 | 8.27E−03 | 5 | 24 | LYM746 | 0.75 | 1.26E−02 | 5 | 41 |
| LYM746 | 0.71 | 2.15E−02 | 5 | 40 | LYM746 | 0.80 | 4.98E−03 | 5 | 27 |
| LYM746 | 0.76 | 1.05E−02 | 5 | 37 | LYM747 | 0.77 | 9.47E−03 | 3 | 14 |
| LYM747 | 0.91 | 2.81E−04 | 4 | 36 | LYM747 | 0.84 | 2.41E−03 | 4 | 41 |
| LYM747 | 0.91 | 2.48E−04 | 4 | 40 | LYM747 | 0.74 | 1.37E−02 | 4 | 39 |
| LYM747 | 0.81 | 4.68E−03 | 4 | 37 | LYM747 | 0.72 | 2.91E−02 | 1 | 21 |
| LYM747 | 0.82 | 3.62E−03 | 1 | 18 | LYM747 | 0.96 | 1.61E−05 | 1 | 15 |
| LYM747 | 0.71 | 2.22E−02 | 1 | 14 | LYM747 | 0.74 | 1.42E−02 | 7 | 51 |
| LYM748 | 0.86 | 1.34E−03 | 3 | 13 | LYM748 | 0.71 | 2.07E−02 | 3 | 1 |

Table 20. Provided are the correlations (R) between the expression levels of yield improving genes and their homologues in tissues [Flag leaf, Flower meristem, stem and Flower; Expression sets (Exp), Table 16] and the phenotypic performance in various yield, biomass, growth rate and/or vigor components [Correlation vector (corr.), corr. ID is provided in Table 17 above] under abiotic stress conditions [e.g., nutrient deficiency (low nitrogen) or drought stress], or normal conditions across Sorghum accessions. P = p value.

II. Correlation of *Sorghum* Varieties Across Ecotype Grown Under Salinity Stress and Cold Stress Conditions

*Sorghum* Vigor Related Parameters Under 100 mM NaCl and Low Temperature (10±2° C.)—

Ten *Sorghum* varieties were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hogland solution), low temperature (10±2° C. in the presence of Full Hogland solution) or at Normal growth solution [Full Hogland solution at 28±2° C.].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]-40.5 grams/liter; Mn—20.2 grams/liter; Zn 10.1 grams/liter; Co 1.5 grams/liter; and Mo 1.1 grams/liter), solution's pH should be 6.5-6.8].

All 10 selected *Sorghum* varieties were sampled per each treatment. Two tissues [leaves and roots] growing at 100 mM NaCl, low temperature (10±2° C.) or under Normal conditions (full Hogland at a temperature between 28±2° C.) were sampled and RNA was extracted as described hereinabove under "GENERAL EXPERIMENTAL AND BIOINFORMATICS METHODS".

TABLE 21

| Sorghum transcriptom expression sets | |
|---|---|
| Expression Set | Set ID |
| Sorghum bath/NUE/root | 1 |
| Sorghum bath/NaCl/root | 2 |
| Sorghum bath/Cold/vegetative meristem | 3 |
| Sorghum bath/Normal/vegetative meristem | 4 |
| Sorghum bath/NUE/vegetative meristem | 5 |
| Sorghum bath/NaCl/vegetative meristem | 6 |
| Sorghum bath/Normal/root | 7 |
| Sorghum bath/Cold/root | 8 |

Table 21: Provided are the Sorghum transcriptom expression sets.
Cold conditions = 10 ± 2 ° C.;
NaCl = 100 mM NaCl;
low nitrogen = 1.2 mM Nitrogen;
Normal conditions = 16 mM Nitrogen.

Experimental Results 10 different *Sorghum* varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameters was calculated using the JMP software and values are summarized in Table 23 below. Subsequent correlation analysis between the various transcriptom sets and the average parameters were conducted (Table 24). Results were then integrated to the database.

TABLE 22

| Sorghum correlated parameters (vectors) | |
|---|---|
| Correlated parameter with | Correlation ID |
| DW Root/Plant - 100 mM NaCl | 26 |
| DW Root/Plant - Cold | 34 |
| DW Root/Plant - Low Nitrogen | 17 |
| DW Root/Plant - Normal | 7 |
| DW Shoot/Plant - Low Nitrogen | 16 |

TABLE 22-continued

Sorghum correlated parameters (vectors)

| Correlated parameter with | Correlation ID |
|---|---|
| DW Shoot/Plant - 100 mM NaCl | 25 |
| DW Shoot/Plant - Cold | 33 |
| DW Shoot/Plant - Normal | 6 |
| Leaf num Cold | 55 |
| Leaf num Low Nitrogen | 41 |
| Leaf num NaCl | 48 |
| Leaf num Normal | 36 |
| Plant Height Low Nitrogen | 42 |
| Plant Height Cold | 56 |
| Plant Height NaCl | 49 |
| Plant Height Normal | 37 |

Table 22: Provided are the Sorghum correlated parameters.
Cold conditions = 10 ± 2 °C.;
NaCl = 100 mM NaCl;
low nitrogen = 1.2 mM Nitrogen;
Normal conditions = 16 mM Nitrogen.
"DW" = dry weight.

TABLE 23

Sorghum accessions, measured parameters

| Corr. ID | Ecotype | | | | | | | | | |
|---|---|---|---|---|---|---|---|---|---|---|
| | Line-1 | Line-2 | Line-3 | Line-4 | Line-5 | Line-6 | Line-7 | Line-8 | Line-9 | Line-10 |
| 6 | 0.10 | 0.24 | 0.31 | 0.16 | 0.19 | 0.19 | 0.24 | 0.24 | 0.19 | 0.24 |
| 7 | 0.05 | 0.13 | 0.17 | 0.10 | 0.11 | 0.12 | 0.14 | 0.12 | 0.10 | 0.11 |
| 16 | 0.08 | 0.19 | 0.33 | 0.16 | 0.16 | 0.16 | 0.26 | 0.20 | 0.13 | 0.18 |
| 17 | 0.04 | 0.11 | 0.20 | 0.10 | 0.08 | 0.09 | 0.13 | 0.09 | 0.09 | 0.09 |
| 25 | 0.09 | 0.19 | 0.20 | 0.14 | 0.13 | 0.13 | 0.15 | 0.19 | 0.10 | 0.12 |
| 26 | 0.05 | 0.10 | 0.12 | 0.07 | 0.08 | 0.08 | 0.14 | 0.10 | 0.16 | 0.14 |
| 33 | 0.08 | 0.15 | 0.19 | 0.11 | 0.13 | 0.16 | 0.15 | 0.15 | 0.11 | 0.14 |
| 34 | 0.07 | 0.11 | 0.16 | 0.09 | 0.08 | 0.11 | 0.14 | 0.13 | 0.11 | 0.14 |
| 36 | 4.17 | 4.48 | 4.93 | 4.53 | 4.52 | 4.64 | 4.49 | 4.79 | 4.37 | 4.54 |
| 37 | 11.22 | 13.77 | 17.48 | 13.08 | 13.50 | 13.53 | 16.75 | 16.15 | 13.95 | 15.28 |
| 41 | 3.63 | 3.99 | 4.51 | 4.17 | 4.03 | 4.13 | 4.24 | 4.28 | 3.90 | 3.91 |
| 42 | 14.09 | 20.49 | 23.69 | 18.91 | 19.98 | 19.43 | 21.00 | 21.54 | 18.50 | 19.98 |
| 48 | 3.67 | 3.88 | 4.28 | 4.03 | 3.97 | 3.98 | 3.90 | 4.18 | 3.70 | 3.82 |
| 49 | 14.63 | 16.31 | 20.56 | 14.70 | 16.43 | 16.12 | 15.61 | 18.71 | 13.65 | 15.72 |
| 55 | 3.88 | 4.16 | 4.52 | 4.28 | 4.33 | 4.17 | 3.94 | 4.26 | 4.20 | 4.04 |
| 56 | 8.83 | 12.32 | 14.42 | 9.50 | 12.53 | 11.82 | 11.28 | 13.22 | 9.97 | 10.02 |

Table 23: Provided are the measured parameters under 100 mM NaCl and low temperature (8-10° C.) conditions of Sorghum accessions (Seed ID) according to the Correlation ID numbers (described in Table 22 above).

TABLE 24

Correlation between the expression level of selected genes of some embodiments of the invention in roots and the phenotypic performance under normal or abiotic stress conditions across Sorghum accessions

| Gene Name | R | P value | Exp. set | Corr. ID | Gene Name | R | P value | Exp. set | Corr. ID |
|---|---|---|---|---|---|---|---|---|---|
| LYM687 | 0.76 | 4.87E−02 | 1 | 17 | LYM687 | 0.74 | 1.38E−02 | 8 | 34 |
| LYM692 | 0.79 | 3.59E−02 | 1 | 41 | LYM692 | 0.79 | 1.06E−02 | 3 | 33 |
| LYM692 | 0.80 | 9.45E−03 | 3 | 56 | LYM692 | 0.73 | 2.59E−02 | 5 | 42 |
| LYM695 | 0.82 | 6.77E−03 | 3 | 33 | LYM695 | 0.73 | 2.65E−02 | 3 | 56 |
| LYM702 | 0.71 | 7.20E−02 | 1 | 41 | LYM702 | 0.90 | 1.02E−03 | 5 | 17 |
| LYM702 | 0.95 | 9.24E−05 | 5 | 42 | LYM702 | 0.91 | 7.80E−04 | 5 | 16 |
| LYM702 | 0.95 | 9.70E−05 | 5 | 41 | LYM705 | 0.73 | 6.45E−02 | 1 | 17 |
| LYM706 | 0.78 | 3.73E−02 | 1 | 17 | LYM706 | 0.90 | 5.08E−03 | 1 | 42 |
| LYM706 | 0.84 | 1.93E−02 | 1 | 16 | LYM706 | 0.85 | 1.59E−02 | 1 | 41 |
| LYM708 | 0.78 | 1.27E−02 | 3 | 34 | LYM708 | 0.82 | 6.71E−03 | 3 | 33 |
| LYM708 | 0.81 | 8.71E−03 | 3 | 56 | LYM708 | 0.74 | 2.26E−02 | 5 | 17 |
| LYM708 | 0.73 | 2.55E−02 | 5 | 42 | LYM708 | 0.72 | 2.87E−02 | 5 | 16 |
| LYM708 | 0.71 | 3.04E−02 | 5 | 41 | LYM708 | 0.73 | 2.51E−02 | 6 | 26 |
| LYM709 | 0.84 | 4.82E−03 | 3 | 56 | LYM709 | 0.84 | 4.27E−02 | 5 | 17 |
| LYM709 | 0.74 | 2.38E−02 | 5 | 16 | LYM711 | 0.83 | 5.19E−03 | 3 | 55 |
| LYM711 | 0.77 | 1.55E−02 | 3 | 33 | LYM711 | 0.81 | 7.90E−03 | 3 | 56 |
| LYM711 | 0.81 | 8.02E−03 | 5 | 17 | LYM711 | 0.75 | 1.88E−02 | 5 | 42 |
| LYM711 | 0.76 | 1.65E−02 | 5 | 16 | LYM711 | 0.82 | 6.69E−03 | 5 | 41 |
| LYM715 | 0.81 | 7.61E−03 | 6 | 48 | LYM717 | 0.76 | 1.86E−02 | 4 | 36 |
| LYM717 | 0.82 | 6.72E−03 | 4 | 6 | LYM717 | 0.79 | 1.18E−02 | 4 | 7 |
| LYM718 | 0.81 | 2.64E−02 | 1 | 42 | LYM718 | 0.72 | 6.66E−02 | 1 | 16 |
| LYM718 | 0.74 | 2.40E−02 | 3 | 55 | LYM718 | 0.83 | 5.37E−03 | 3 | 56 |
| LYM725 | 0.71 | 3.09E−02 | 3 | 56 | LYM725 | 0.70 | 3.53E−02 | 4 | 37 |
| LYM725 | 0.74 | 2.19E−02 | 5 | 16 | LYM726 | 0.84 | 4.78E−03 | 4 | 37 |
| LYM726 | 0.72 | 3.00E−02 | 4 | 36 | LYM726 | 0.75 | 2.02E−02 | 4 | 6 |
| LYM726 | 0.76 | 1.65E−02 | 4 | 7 | LYM728 | 0.79 | 1.11E−02 | 3 | 34 |
| LYM728 | 0.83 | 6.08E−03 | 4 | 37 | LYM728 | 0.71 | 3.18E−02 | 4 | 7 |

TABLE 24-continued

Correlation between the expression level of selected genes of some embodiments of the invention in roots and the phenotypic performance under normal or abiotic stress conditions across Sorghum accessions

| Gene Name | R | P value | Exp. set | Corr. ID | Gene Name | R | P value | Exp. set | Corr. ID |
|---|---|---|---|---|---|---|---|---|---|
| LYM728 | 0.74 | 2.24E−02 | 5 | 17 | LYM728 | 0.92 | 4.14E−04 | 5 | 42 |
| LYM728 | 0.82 | 6.59E−03 | 5 | 16 | LYM728 | 0.86 | 3.01E−03 | 5 | 41 |
| LYM728 | 0.74 | 2.34E−02 | 7 | 36 | LYM732 | 0.80 | 9.16E−03 | 3 | 33 |
| LYM732 | 0.77 | 1.50E−02 | 3 | 56 | LYM746 | 0.77 | 1.61E−02 | 5 | 17 |
| LYM746 | 0.84 | 4.56E−03 | 5 | 42 | LYM746 | 0.76 | 1.68E−02 | 5 | 16 |
| LYM746 | 0.77 | 1.61E−02 | 5 | 41 | | | | | |

Table 24. Provided are the correlations (R) between the expression levels yield improving genes and their homologues in various tissues [Expression sets (Exp), Table 21] and the phenotypic performance [yield, biomass, growth rate and/or vigor components (Correlation vector)] under abiotic stress conditions (salinity, cold stress) or normal conditions across Sorghum accessions. Corr.—Correlation vector ID as described hereinabove (Table 22). P = p value.

Example 7

Production of Maize Transcriptom and High Throughput Correlation Analysis Using 60K Maize Oligonucleotide Micro-Array To produce a high throughput correlation analysis, the present inventors utilized a Maize oligonucleotide microarray, produced by Agilent Technologies [Hypertxt Transfer Protocol://World Wide Web(dot)chem.(dot)agilent(dot)com/Scripts/PDS(dot)asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web(dot)davidmlane(dot)com/hyperstat/A34739 (dot)html].

Experimental Procedures

Four tissues at different developmental stages including Ear (R1-R2), leaf (R1-R2; and V2-V3), Grain from the distal part of the ear (R4-R5), and Internode (upper internode; R1-R2, R3-R4, V6-V8) representing different plant characteristics, were sampled and RNA was extracted as described in "GENERAL EXPERIMENTAL AND BIOINFORMATICS METHODS". For convenience, each micro-array expression information tissue type has received a Set ID as summarized in Table 25 below.

TABLE 25

Tissues used for Maize transcriptom expression sets

| Expression Set | Set ID |
|---|---|
| Ear (R1-R2) | 1 |
| Internode (R3-R4) | 3 |
| Grain distal (R4-R5) | 4 |
| Leaf (V6-V8) | 6 |
| Leaf (V2-V3) | 7 |
| Internode (R1-R2) | 8 |
| Internode (R3-R4) | 9 |
| Ear (R3-R4) | 12 |
| Internode (R1-R2) | 14 |
| Leaf (R1-R2) | 15 |
| Leaf (R1-R2) | 16 |
| Grain distal (R3-R4) | 17 |

TABLE 25-continued

Tissues used for Maize transcriptom expression sets

| Expression Set | Set ID |
|---|---|
| Ear (R1-R2) | 18 |
| Internode (V2-V3) | 20 |
| Ear (R3-R4) | 22 |
| Internode (V6-V8) | 24 |

Table 25: Provided are the identification (ID) number of each of the Maize expression sets. V1-V8 = represent vegetative stages of Maize development; R1-R5 = represent reproductive stages of Maize development.

The following parameters were collected:
Grain Area ($cm^2$)—
At the end of the growing period the grains were separated from the ear. A sample of ~200 grains were weight, photographed and images were processed using the below described image processing system. The grain area was measured from those images and was divided by the number of grains.

Grain Length and Grain Width (cm)—
At the end of the growing period the grains were separated from the ear. A sample of ~200 grains were weight, photographed and images were processed using the below described image processing system. The sum of grain lengths/or width (longest axis) was measured from those images and was divided by the number of grains.

Ear Area ($cm^2$)—
At the end of the growing period 6 ears were, photographed and images were processed using the below described image processing system. The Ear area was measured from those images and was divided by the number of Ears.

Ear Length and Ear Width (cm)—
At the end of the growing period 6 ears were, photographed and images were processed using the below described image processing system. The Ear length and width (longest axis) was measured from those images and was divided by the number of ears.

Filled per Whole Ear—
was calculated as the length of the ear with grains out of the total ear.

Percent Filled Ear—
At the end of the growing period 6 ears were, photographed and images were processed using the below described image processing system. The percent filled Ear grain was the ear with grains out of the total ear and was measured from those images and was divided by the number of Ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight Per Plant (gr.)(Yield)—

At the end of the experiment all ears from plots within blocks A-C were collected. 6 ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear FW (gr.)—

At the end of the experiment (when ears were harvested) total and 6 selected ears per plots within blocks A-C were collected separately. The plants with (total and 6) were weighted (gr.) separately and the average ear per plant was calculated for total (Ear FW per plot) and for 6 (Ear FW per plant).

Plant Height and Ear Height—

Plants were characterized for height at harvesting. In each measure, 6 plants were measured for their height using a measuring tape. Height was measured from ground level to top of the plant below the tassel. Ear height was measured from the ground level to the place were the main ear is located.

Leaf Number Per Plant—

Plants were characterized for leaf number during growing period at 5 time points. In each measure, plants were measured for their leaf number by counting all the leaves of 3 selected plants per plot.

Relative Growth Rate— was calculated using regression coefficient of leaf number change a long time course.

SPAD—

Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Dry Weight Per Plant—

At the end of the experiment when all vegetative material from plots within blocks A-C were collected, weight and divided by the number of plants.

Ear Diameter [cm]—

The diameter of the ear at the mid of the ear was measured using a ruler.

Cob Diameter [cm]—

The diameter of the cob without grains was measured using a ruler.

Kernel Row Number Per Ear—

The number of rows in each ear was counted. The average of 6 ears per plot was calculated.

Leaf Area Index [LAI]= total leaf area of all plants in a plot. Measurement was performed using a Leaf area-meter.

Yield/LAI [kg]— is the ratio between total grain yields and total leaf area index.

TABLE 26

| Maize correlated parameters (vectors) | |
|---|---|
| Correlated parameter | Correlation ID |
| Normal - LAI | 73 |
| Normal - Yield/LAI (gr) | 74 |
| Growth Rate Leaf Num | 75 |
| Plant Height per Plot cm | 76 |
| Ear Height cm | 77 |
| Leaf Number per Plant | 78 |
| Ear Length cm | 79 |
| Percent Filled Ear | 80 |
| Cob Diameter mm | 81 |
| Kernel Row Number per Ear | 82 |
| DW per Plant based on 6 gr | 83 |
| Ear FW per Plant based on 6 gr | 84 |
| Normalized Grain Weight per plant based on 6 gr | 85 |
| Ears FW per plant based on all gr | 86 |
| Normalized Grain Weight per Plant based on all gr | 87 |
| Ear Area $cm^2$ | 88 |
| Ear Width cm | 89 |
| Filled per Whole Ear | 90 |
| Grain Area $cm^2$ | 91 |
| Grain Length cm | 92 |
| Grain Width cm | 93 |

Table 26.

Twelve maize varieties were grown, and characterized for parameters, as described above. The average for each parameter was calculated using the JMP software, and values are summarized in Tables 27-28 below. Subsequent correlation between the various transcriptom sets for all or sub set of lines was done by the bioinformatic unit and results were integrated into the database (Table 29 below).

TABLE 27

| Measured parameters in Maize Hybrid | | | | | |
|---|---|---|---|---|---|
| Ecotype/Corr. ID | Line-1 | Line-2 | Line-3 | Line-4 | Line-5 |
| 73 | 3.21 | 3.95 | 3.33 | 4.01 | 3.86 |
| 74 | 426.09 | 312.97 | 307.28 | 362.44 | 314.14 |
| 75 | 0.28 | 0.22 | 0.28 | 0.27 | 0.31 |
| 76 | 278.08 | 260.50 | 275.13 | 238.50 | 286.94 |
| 77 | 135.17 | 122.33 | 131.97 | 114.00 | 135.28 |
| 78 | 12.00 | 11.11 | 11.69 | 11.78 | 11.94 |
| 79 | 19.69 | 19.05 | 20.52 | 21.34 | 20.92 |
| 80 | 80.62 | 86.76 | 82.14 | 92.71 | 80.38 |

TABLE 27-continued

Measured parameters in Maize Hybrid

| Ecotype/Corr. ID | Line-1 | Line-2 | Line-3 | Line-4 | Line-5 |
|---|---|---|---|---|---|
| 81 | 28.96 | 25.08 | 28.05 | 25.73 | 28.72 |
| 82 | 16.17 | 14.67 | 16.20 | 15.89 | 16.17 |
| 83 | 657.50 | 491.67 | 641.11 | 580.56 | 655.56 |
| 84 | 245.83 | 208.33 | 262.22 | 263.89 | 272.22 |
| 85 | 140.68 | 139.54 | 153.67 | 176.98 | 156.61 |
| 86 | 278.19 | 217.50 | 288.28 | 247.88 | 280.11 |
| 87 | 153.90 | 135.88 | 152.50 | 159.16 | 140.46 |
| 88 | 85.06 | 85.84 | 90.51 | 95.95 | 91.62 |
| 89 | 5.58 | 5.15 | 5.67 | 5.53 | 5.73 |
| 90 | 0.92 | 0.92 | 0.93 | 0.92 | 0.91 |
| 91 | 0.75 | 0.71 | 0.75 | 0.77 | 0.81 |
| 92 | 1.17 | 1.09 | 1.18 | 1.20 | 1.23 |
| 93 | 0.81 | 0.81 | 0.80 | 0.80 | 0.82 |

Table 27.

TABLE 28

Measured parameters in Maize Hybrid additional parameters

| Corr. ID | Line-6 | Line-7 | Line-8 | Line-10 | Line-11 | Line-13 |
|---|---|---|---|---|---|---|
| 73 | 4.19 | 3.97 | 4.32 |  | 2.89 | 4.31 |
| 74 | 224.58 | 266.44 | 261.66 |  | 482.33 |  |
| 75 | 0.24 | 0.24 | 0.27 | 0.19 | 0.30 |  |
| 76 | 224.83 | 264.44 | 251.61 | 163.78 | 278.44 |  |
| 77 | 94.28 | 120.94 | 107.72 | 60.44 | 112.50 |  |
| 78 | 12.33 | 12.44 | 12.22 | 9.28 | 12.56 |  |
| 79 | 18.23 | 19.02 | 18.57 | 16.69 | 21.70 |  |
| 80 | 82.76 | 73.25 | 81.06 | 81.06 | 91.60 |  |
| 81 | 25.78 | 26.43 | 25.19 | 26.67 |  |  |
| 82 | 15.17 | 16.00 | 14.83 | 14.27 | 15.39 |  |
| 83 | 569.44 | 511.11 | 544.44 | 574.17 | 522.22 |  |
| 84 | 177.78 | 188.89 | 197.22 | 141.11 | 261.11 |  |
| 85 | 119.67 | 119.69 | 133.51 | 54.32 | 173.23 |  |
| 86 | 175.84 | 192.47 | 204.70 | 142.72 | 264.24 |  |
| 87 | 117.14 | 123.24 | 131.27 | 40.84 | 170.66 |  |
| 88 | 72.41 | 74.03 | 76.53 | 55.20 | 95.36 |  |
| 89 | 5.23 | 5.22 | 5.33 | 4.12 | 5.58 |  |
| 90 | 0.95 | 0.87 | 0.94 | 0.80 | 0.96 |  |
| 91 | 0.71 | 0.71 | 0.75 | 0.50 | 0.76 |  |
| 92 | 1.12 | 1.14 | 1.13 | 0.92 | 1.18 |  |
| 93 | 0.80 | 0.79 | 0.84 | 0.67 | 0.81 |  |

Table 28.

TABLE 29

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM565 | 0.80 | 3.21E-02 | 14 | 90 | LYM565 | 0.72 | 6.67E-02 | 14 | 76 |
| LYM565 | 0.71 | 7.13E-02 | 15 | 88 | LYM565 | 0.73 | 6.18E-02 | 15 | 77 |
| LYM566 | 0.78 | 2.38E-02 | 4 | 74 | LYM566 | 0.74 | 5.81E-02 | 15 | 88 |
| LYM566 | 0.70 | 7.79E-02 | 15 | 87 | LYM566 | 0.75 | 5.04E-02 | 15 | 82 |
| LYM566 | 0.82 | 2.42E-02 | 15 | 75 | LYM566 | 0.85 | 1.47E-02 | 15 | 79 |
| LYM566 | 0.84 | 1.91E-02 | 15 | 86 | LYM566 | 0.83 | 2.13E-02 | 15 | 84 |
| LYM566 | 0.80 | 5.58E-02 | 16 | 74 | LYM566 | 0.84 | 8.61E-03 | 17 | 81 |
| LYM566 | 0.71 | 4.93E-02 | 17 | 75 | LYM566 | 0.71 | 4.67E-02 | 17 | 91 |
| LYM566 | 0.85 | 8.06E-03 | 17 | 76 | LYM566 | 0.73 | 3.81E-02 | 17 | 83 |
| LYM566 | 0.86 | 6.34E-03 | 17 | 77 | LYM566 | 0.71 | 4.76E-02 | 17 | 89 |
| LYM566 | 0.76 | 2.72E-02 | 17 | 86 | LYM566 | 0.72 | 4.44E-02 | 17 | 84 |
| LYM566 | 0.78 | 6.95E-02 | 22 | 90 | LYM566 | 0.72 | 1.03E-01 | 22 | 93 |
| LYM567 | 0.92 | 9.20E-03 | 1 | 74 | LYM567 | 0.97 | 1.10E-03 | 8 | 74 |
| LYM567 | 0.73 | 9.63E-02 | 12 | 74 | LYM567 | 0.79 | 3.36E-02 | 14 | 88 |
| LYM567 | 0.88 | 8.58E-03 | 14 | 79 | LYM567 | 0.89 | 7.61E-03 | 14 | 80 |
| LYM567 | 0.70 | 7.84E-02 | 14 | 86 | LYM567 | 0.79 | 3.41E-02 | 14 | 84 |
| LYM567 | 0.74 | 5.85E-02 | 14 | 85 | LYM567 | 0.85 | 3.08E-02 | 16 | 74 |
| LYM567 | 0.80 | 1.74E-02 | 17 | 81 | LYM567 | 0.83 | 1.01E-02 | 17 | 83 |
| LYM567 | 0.81 | 2.74E-02 | 18 | 88 | LYM567 | 0.77 | 4.23E-02 | 18 | 87 |
| LYM567 | 0.82 | 2.45E-02 | 18 | 75 | LYM567 | 0.91 | 5.07E-03 | 18 | 79 |
| LYM567 | 0.70 | 7.95E-02 | 18 | 80 | LYM567 | 0.70 | 7.92E-02 | 18 | 76 |
| LYM567 | 0.82 | 2.43E-02 | 18 | 86 | LYM567 | 0.85 | 1.62E-02 | 18 | 84 |
| LYM567 | 0.77 | 4.29E-02 | 18 | 85 | LYM567 | 0.77 | 7.54E-02 | 22 | 90 |
| LYM567 | 0.91 | 1.11E-02 | 22 | 80 | LYM568 | 0.80 | 5.68E-02 | 15 | 81 |
| LYM568 | 0.85 | 3.35E-02 | 22 | 90 | LYM569 | 0.74 | 1.47E-02 | 7 | 88 |
| LYM569 | 0.70 | 2.31E-02 | 7 | 87 | LYM569 | 0.70 | 2.38E-02 | 7 | 82 |
| LYM569 | 0.74 | 1.51E-02 | 7 | 92 | LYM569 | 0.72 | 1.97E-02 | 7 | 79 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM569 | 0.72 | 1.80E−02 | 7 | 84 | LYM569 | 0.74 | 1.36E−02 | 7 | 85 |
| LYM569 | 0.85 | 1.65E−02 | 14 | 88 | LYM569 | 0.81 | 2.87E−02 | 14 | 87 |
| LYM569 | 0.79 | 3.27E−02 | 14 | 82 | LYM569 | 0.85 | 1.44E−02 | 14 | 92 |
| LYM569 | 0.77 | 4.32E−02 | 14 | 79 | LYM569 | 0.80 | 3.13E−02 | 14 | 91 |
| LYM569 | 0.83 | 2.08E−02 | 14 | 77 | LYM569 | 0.80 | 2.93E−02 | 14 | 89 |
| LYM569 | 0.70 | 7.78E−02 | 14 | 86 | LYM569 | 0.78 | 3.71E−02 | 14 | 93 |
| LYM569 | 0.80 | 3.14E−02 | 14 | 84 | LYM569 | 0.85 | 1.43E−02 | 14 | 85 |
| LYM569 | 0.87 | 1.18E−02 | 15 | 88 | LYM569 | 0.76 | 4.86E−02 | 15 | 87 |
| LYM569 | 0.74 | 5.54E−02 | 15 | 82 | LYM569 | 0.75 | 5.36E−02 | 15 | 92 |
| LYM569 | 0.90 | 5.57E−03 | 15 | 79 | LYM569 | 0.86 | 1.33E−02 | 15 | 80 |
| LYM569 | 0.76 | 4.60E−02 | 15 | 77 | LYM569 | 0.71 | 7.52E−02 | 15 | 89 |
| LYM569 | 0.81 | 2.89E−02 | 15 | 86 | LYM569 | 0.88 | 8.90E−03 | 15 | 84 |
| LYM569 | 0.83 | 2.21E−02 | 15 | 85 | LYM569 | 0.75 | 5.14E−02 | 18 | 87 |
| LYM569 | 0.80 | 3.19E−02 | 18 | 92 | LYM569 | 0.73 | 5.99E−02 | 18 | 90 |
| LYM569 | 0.85 | 1.63E−02 | 18 | 91 | LYM569 | 0.80 | 2.90E−02 | 18 | 76 |
| LYM569 | 0.90 | 6.15E−03 | 18 | 77 | LYM569 | 0.85 | 1.52E−02 | 18 | 89 |
| LYM569 | 0.72 | 6.98E−02 | 18 | 86 | LYM569 | 0.84 | 1.93E−02 | 18 | 93 |
| LYM569 | 0.70 | 7.77E−02 | 18 | 85 | LYM569 | 0.71 | 3.13E−02 | 20 | 78 |
| LYM569 | 0.77 | 1.60E−02 | 20 | 92 | LYM569 | 0.82 | 7.04E−03 | 20 | 91 |
| LYM569 | 0.78 | 1.33E−02 | 20 | 76 | LYM569 | 0.82 | 7.15E−03 | 20 | 77 |
| LYM569 | 0.73 | 2.48E−02 | 20 | 89 | LYM569 | 0.84 | 4.60E−03 | 20 | 93 |
| LYM569 | 0.74 | 9.31E−02 | 22 | 92 | LYM569 | 0.77 | 7.26E−02 | 22 | 91 |
| LYM569 | 0.81 | 4.89E−02 | 22 | 76 | LYM569 | 0.82 | 4.66E−02 | 22 | 77 |
| LYM569 | 0.78 | 6.82E−02 | 22 | 89 | LYM569 | 0.81 | 4.91E−02 | 22 | 86 |
| LYM569 | 0.75 | 8.77E−02 | 22 | 84 | LYM570 | 0.87 | 2.49E−02 | 1 | 74 |
| LYM570 | 0.79 | 1.93E−02 | 4 | 74 | LYM570 | 0.74 | 1.37E−02 | 7 | 78 |
| LYM570 | 0.76 | 1.13E−02 | 7 | 93 | LYM570 | 0.79 | 6.11E−02 | 8 | 73 |
| LYM570 | 0.71 | 7.55E−02 | 15 | 90 | LYM570 | 0.72 | 6.73E−02 | 18 | 82 |
| LYM570 | 0.86 | 2.67E−02 | 22 | 78 | LYM570 | 0.95 | 2.56E−04 | 24 | 74 |
| LYM571 | 0.89 | 1.61E−02 | 1 | 74 | LYM571 | 0.85 | 7.31E−03 | 3 | 92 |
| LYM571 | 0.71 | 4.85E−02 | 3 | 79 | LYM571 | 0.70 | 5.21E−02 | 3 | 90 |
| LYM571 | 0.76 | 2.93E−02 | 3 | 93 | LYM571 | 0.80 | 2.91E−02 | 14 | 88 |
| LYM571 | 0.83 | 2.22E−02 | 14 | 87 | LYM571 | 0.77 | 4.10E−02 | 14 | 82 |
| LYM571 | 0.87 | 1.13E−02 | 14 | 75 | LYM571 | 0.78 | 4.07E−02 | 14 | 92 |
| LYM571 | 0.81 | 2.64E−02 | 14 | 79 | LYM571 | 0.75 | 5.20E−02 | 14 | 91 |
| LYM571 | 0.89 | 7.09E−03 | 14 | 76 | LYM571 | 0.83 | 2.18E−02 | 14 | 77 |
| LYM571 | 0.84 | 1.68E−02 | 14 | 89 | LYM571 | 0.95 | 1.05E−03 | 14 | 86 |
| LYM571 | 0.87 | 1.12E−02 | 14 | 84 | LYM571 | 0.78 | 3.94E−02 | 14 | 85 |
| LYM571 | 0.70 | 7.79E−02 | 15 | 87 | LYM571 | 0.84 | 1.94E−02 | 15 | 78 |
| LYM571 | 0.81 | 2.57E−02 | 15 | 75 | LYM571 | 0.83 | 2.21E−02 | 15 | 90 |
| LYM571 | 0.74 | 5.70E−02 | 15 | 91 | LYM571 | 0.82 | 2.38E−02 | 15 | 76 |
| LYM571 | 0.74 | 5.77E−02 | 15 | 89 | LYM571 | 0.76 | 4.79E−02 | 15 | 93 |
| LYM571 | 0.87 | 1.11E−02 | 18 | 88 | LYM571 | 0.81 | 2.89E−02 | 18 | 87 |
| LYM571 | 0.83 | 2.00E−02 | 18 | 82 | LYM571 | 0.84 | 1.87E−02 | 18 | 75 |
| LYM571 | 0.78 | 4.02E−02 | 18 | 92 | LYM571 | 0.96 | 5.72E−04 | 18 | 79 |
| LYM571 | 0.72 | 6.76E−02 | 18 | 80 | LYM571 | 0.76 | 4.77E−02 | 18 | 89 |
| LYM571 | 0.88 | 8.33E−03 | 18 | 86 | LYM571 | 0.93 | 2.04E−03 | 18 | 84 |
| LYM571 | 0.83 | 2.02E−02 | 18 | 85 | LYM571 | 0.72 | 1.09E−01 | 22 | 79 |
| LYM571 | 0.93 | 7.39E−03 | 22 | 90 | LYM571 | 0.91 | 1.28E−02 | 22 | 80 |
| LYM571 | 0.81 | 4.85E−02 | 22 | 85 | LYM572 | 0.76 | 7.94E−02 | 1 | 73 |
| LYM572 | 0.71 | 4.69E−02 | 17 | 91 | LYM572 | 0.83 | 3.98E−02 | 1 | 73 |
| LYM573 | 0.73 | 1.02E−01 | 8 | 73 | LYM573 | 0.75 | 8.62E−02 | 14 | 81 |
| LYM573 | 0.86 | 2.82E−02 | 16 | 73 | LYM573 | 0.83 | 4.05E−02 | 16 | 74 |
| LYM573 | 0.73 | 6.21E−02 | 18 | 76 | LYM573 | 0.73 | 2.66E−02 | 20 | 87 |
| LYM573 | 0.80 | 9.78E−03 | 20 | 78 | LYM573 | 0.75 | 2.00E−02 | 20 | 75 |
| LYM573 | 0.75 | 1.93E−02 | 20 | 92 | LYM573 | 0.79 | 1.12E−02 | 20 | 79 |
| LYM573 | 0.72 | 2.99E−02 | 20 | 89 | LYM573 | 0.74 | 2.17E−02 | 20 | 85 |
| LYM573 | 0.74 | 3.61E−02 | 24 | 73 | LYM574 | 0.72 | 4.26E−02 | 3 | 93 |
| LYM574 | 0.93 | 6.55E−03 | 8 | 73 | LYM574 | 0.84 | 8.48E−03 | 17 | 81 |
| LYM574 | 0.76 | 2.87E−02 | 17 | 75 | LYM574 | 0.85 | 7.48E−03 | 17 | 83 |
| LYM574 | 0.81 | 2.89E−02 | 18 | 78 | LYM574 | 0.84 | 1.68E−02 | 18 | 90 |
| LYM574 | 0.77 | 4.23E−02 | 18 | 93 | LYM575 | 0.78 | 2.26E−02 | 3 | 88 |
| LYM575 | 0.71 | 4.86E−02 | 3 | 87 | LYM575 | 0.86 | 6.57E−03 | 3 | 80 |
| LYM575 | 0.73 | 3.88E−02 | 3 | 85 | LYM575 | 0.80 | 9.73E−03 | 6 | 74 |
| LYM575 | 0.79 | 2.03E−02 | 9 | 74 | LYM575 | 0.89 | 1.89E−02 | 14 | 81 |
| LYM575 | 0.87 | 1.02E−02 | 14 | 83 | LYM575 | 0.84 | 1.77E−02 | 15 | 88 |
| LYM575 | 0.93 | 2.39E−03 | 15 | 87 | LYM575 | 0.75 | 5.38E−02 | 15 | 82 |
| LYM575 | 0.86 | 1.29E−02 | 15 | 78 | LYM575 | 0.79 | 3.50E−02 | 15 | 75 |
| LYM575 | 0.95 | 8.40E−04 | 15 | 92 | LYM575 | 0.74 | 5.84E−02 | 15 | 79 |
| LYM575 | 0.90 | 5.21E−03 | 15 | 90 | LYM575 | 0.98 | 9.44E−05 | 15 | 91 |
| LYM575 | 0.75 | 5.09E−02 | 15 | 80 | LYM575 | 0.90 | 6.12E−03 | 15 | 76 |
| LYM575 | 0.92 | 3.22E−03 | 15 | 77 | LYM575 | 0.98 | 1.57E−04 | 15 | 89 |
| LYM575 | 0.79 | 3.36E−02 | 15 | 86 | LYM575 | 0.93 | 2.03E−03 | 15 | 93 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM575 | 0.79 | 3.54E-02 | 15 | 84 | LYM575 | 0.90 | 6.21E-03 | 15 | 85 |
| LYM575 | 0.82 | 4.55E-02 | 16 | 74 | LYM575 | 0.76 | 4.57E-02 | 18 | 87 |
| LYM575 | 0.80 | 2.94E-02 | 18 | 78 | LYM575 | 0.70 | 7.75E-02 | 18 | 75 |
| LYM575 | 0.75 | 5.42E-02 | 18 | 92 | LYM575 | 0.86 | 1.28E-02 | 18 | 90 |
| LYM575 | 0.85 | 1.48E-02 | 18 | 91 | LYM575 | 0.89 | 6.88E-03 | 18 | 76 |
| LYM575 | 0.82 | 2.29E-02 | 18 | 77 | LYM575 | 0.83 | 2.19E-02 | 18 | 89 |
| LYM575 | 0.91 | 4.17E-03 | 18 | 93 | LYM575 | 0.73 | 2.59E-02 | 20 | 78 |
| LYM575 | 0.85 | 3.76E-03 | 20 | 75 | LYM575 | 0.71 | 3.18E-02 | 20 | 92 |
| LYM575 | 0.75 | 2.05E-02 | 20 | 91 | LYM575 | 0.75 | 2.07E-02 | 20 | 93 |
| LYM575 | 0.70 | 1.19E-01 | 22 | 82 | LYM575 | 0.76 | 8.00E-02 | 22 | 92 |
| LYM575 | 0.78 | 6.60E-02 | 22 | 79 | LYM575 | 0.78 | 6.73E-02 | 22 | 89 |
| LYM576 | 0.75 | 8.42E-02 | 8 | 73 | LYM576 | 0.92 | 1.01E-02 | 16 | 73 |
| LYM576 | 0.76 | 2.96E-02 | 20 | 81 | LYM576 | 0.77 | 1.44E-02 | 20 | 82 |
| LYM576 | 0.79 | 1.13E-02 | 20 | 75 | LYM576 | 0.76 | 1.87E-02 | 20 | 92 |
| LYM576 | 0.70 | 3.53E-02 | 20 | 91 | LYM576 | 0.71 | 3.26E-02 | 20 | 84 |
| LYM577 | 0.74 | 9.17E-02 | 1 | 73 | LYM577 | 0.73 | 1.00E-01 | 8 | 73 |
| LYM577 | 0.74 | 3.76E-02 | 17 | 82 | LYM577 | 0.88 | 3.79E-03 | 17 | 75 |
| LYM577 | 0.94 | 4.15E-04 | 17 | 92 | LYM577 | 0.80 | 1.80E-02 | 17 | 79 |
| LYM577 | 0.86 | 6.71E-03 | 17 | 91 | LYM577 | 0.83 | 1.17E-02 | 17 | 83 |
| LYM577 | 0.89 | 3.10E-03 | 17 | 89 | LYM577 | 0.70 | 5.15E-02 | 17 | 86 |
| LYM577 | 0.81 | 1.46E-02 | 17 | 84 | LYM577 | 0.72 | 4.47E-02 | 17 | 85 |
| LYM577 | 0.77 | 7.39E-02 | 22 | 82 | LYM577 | 0.74 | 8.96E-02 | 22 | 77 |
| LYM578 | 0.71 | 4.73E-02 | 3 | 82 | LYM578 | 0.75 | 3.32E-02 | 3 | 92 |
| LYM578 | 0.79 | 3.39E-02 | 14 | 76 | LYM578 | 0.78 | 3.82E-02 | 14 | 77 |
| LYM578 | 0.86 | 1.28E-02 | 14 | 86 | LYM578 | 0.74 | 5.90E-02 | 14 | 84 |
| LYM578 | 0.83 | 4.14E-02 | 22 | 90 | LYM578 | 0.91 | 1.25E-02 | 22 | 80 |
| LYM578 | 0.74 | 9.54E-02 | 22 | 85 | LYM579 | 0.84 | 9.78E-03 | 3 | 93 |
| LYM579 | 0.77 | 2.47E-02 | 17 | 75 | LYM579 | 0.72 | 4.39E-02 | 17 | 91 |
| LYM579 | 0.71 | 4.78E-02 | 17 | 83 | LYM579 | 0.75 | 3.33E-02 | 24 | 73 |
| LYM580 | 0.85 | 3.17E-02 | 1 | 74 | LYM580 | 0.71 | 3.20E-02 | 7 | 81 |
| LYM580 | 0.73 | 1.75E-02 | 7 | 83 | LYM580 | 0.72 | 1.06E-01 | 8 | 73 |
| LYM580 | 0.85 | 3.04E-02 | 18 | 81 | LYM580 | 0.75 | 8.58E-02 | 22 | 90 |
| LYM581 | 0.77 | 2.67E-02 | 3 | 90 | LYM581 | 0.76 | 7.77E-02 | 14 | 81 |
| LYM581 | 0.78 | 3.66E-02 | 14 | 83 | LYM581 | 0.73 | 1.01E-01 | 16 | 74 |
| LYM581 | 0.95 | 1.11E-03 | 18 | 88 | LYM581 | 1.00 | 3.36E-07 | 18 | 87 |
| LYM581 | 0.75 | 5.17E-02 | 18 | 82 | LYM581 | 0.86 | 1.32E-02 | 18 | 78 |
| LYM581 | 0.88 | 9.40E-03 | 18 | 75 | LYM581 | 0.97 | 2.60E-04 | 18 | 92 |
| LYM581 | 0.90 | 6.14E-03 | 18 | 79 | LYM581 | 0.89 | 7.63E-03 | 18 | 90 |
| LYM581 | 0.97 | 2.98E-04 | 18 | 91 | LYM581 | 0.93 | 2.44E-03 | 18 | 76 |
| LYM581 | 0.89 | 6.70E-03 | 18 | 77 | LYM581 | 0.98 | 1.04E-04 | 18 | 89 |
| LYM581 | 0.87 | 1.06E-02 | 18 | 86 | LYM581 | 0.88 | 9.25E-03 | 18 | 93 |
| LYM581 | 0.90 | 5.82E-03 | 18 | 84 | LYM581 | 0.98 | 9.29E-05 | 18 | 85 |
| LYM581 | 0.77 | 7.54E-02 | 22 | 82 | LYM582 | 0.73 | 3.99E-02 | 3 | 90 |
| LYM582 | 0.74 | 3.57E-02 | 4 | 74 | LYM582 | 0.74 | 5.55E-02 | 14 | 88 |
| LYM582 | 0.74 | 5.62E-02 | 14 | 82 | LYM582 | 0.70 | 7.74E-02 | 14 | 92 |
| LYM582 | 0.75 | 5.40E-02 | 14 | 79 | LYM582 | 0.71 | 7.51E-02 | 14 | 91 |
| LYM582 | 0.72 | 6.66E-02 | 14 | 80 | LYM582 | 0.76 | 4.94E-02 | 14 | 84 |
| LYM582 | 0.73 | 6.04E-02 | 14 | 85 | LYM582 | 0.71 | 7.35E-02 | 15 | 76 |
| LYM582 | 0.79 | 3.26E-02 | 15 | 77 | LYM582 | 0.81 | 2.65E-02 | 15 | 93 |
| LYM582 | 0.94 | 1.63E-03 | 18 | 88 | LYM582 | 0.94 | 1.57E-03 | 18 | 87 |
| LYM582 | 0.86 | 1.23E-02 | 18 | 82 | LYM582 | 0.88 | 8.28E-03 | 18 | 78 |
| LYM582 | 0.77 | 4.10E-02 | 18 | 75 | LYM582 | 0.94 | 1.65E-03 | 18 | 92 |
| LYM582 | 0.88 | 9.28E-03 | 18 | 79 | LYM582 | 0.94 | 1.64E-03 | 18 | 90 |
| LYM582 | 0.98 | 5.28E-05 | 18 | 91 | LYM582 | 0.92 | 3.84E-03 | 18 | 76 |
| LYM582 | 0.93 | 2.57E-03 | 18 | 77 | LYM582 | 0.96 | 4.88E-04 | 18 | 89 |
| LYM582 | 0.92 | 3.57E-03 | 18 | 86 | LYM582 | 0.97 | 4.01E-04 | 18 | 93 |
| LYM582 | 0.92 | 3.31E-03 | 18 | 84 | LYM582 | 0.93 | 2.57E-03 | 18 | 85 |
| LYM582 | 0.81 | 8.19E-03 | 20 | 78 | LYM582 | 0.76 | 1.87E-02 | 20 | 75 |
| LYM582 | 0.79 | 1.05E-02 | 20 | 92 | LYM582 | 0.75 | 2.09E-02 | 20 | 91 |
| LYM582 | 0.73 | 2.45E-02 | 20 | 89 | LYM582 | 0.79 | 6.27E-02 | 22 | 78 |
| LYM583 | 0.85 | 7.54E-03 | 3 | 78 | LYM583 | 0.85 | 1.59E-02 | 14 | 88 |
| LYM583 | 0.89 | 7.61E-03 | 14 | 87 | LYM583 | 0.82 | 2.36E-02 | 14 | 82 |
| LYM583 | 0.72 | 6.90E-02 | 14 | 78 | LYM583 | 0.85 | 1.44E-02 | 14 | 75 |
| LYM583 | 0.86 | 1.27E-02 | 14 | 92 | LYM583 | 0.81 | 2.64E-02 | 14 | 79 |
| LYM583 | 0.76 | 4.61E-02 | 14 | 90 | LYM583 | 0.85 | 1.59E-02 | 14 | 91 |
| LYM583 | 0.93 | 2.27E-03 | 14 | 76 | LYM583 | 0.91 | 4.81E-03 | 14 | 77 |
| LYM583 | 0.92 | 2.88E-03 | 14 | 89 | LYM583 | 0.94 | 1.45E-03 | 14 | 86 |
| LYM583 | 0.83 | 2.08E-02 | 14 | 93 | LYM583 | 0.87 | 9.99E-03 | 14 | 84 |
| LYM583 | 0.84 | 1.83E-02 | 14 | 85 | LYM583 | 0.72 | 4.38E-02 | 17 | 81 |
| LYM583 | 0.74 | 3.62E-02 | 17 | 83 | LYM583 | 0.73 | 6.12E-02 | 18 | 92 |
| LYM583 | 0.73 | 6.21E-02 | 18 | 90 | LYM583 | 0.76 | 4.76E-02 | 18 | 91 |
| LYM583 | 0.77 | 4.36E-02 | 18 | 77 | LYM583 | 0.78 | 3.70E-02 | 18 | 89 |
| LYM583 | 0.74 | 5.50E-02 | 18 | 93 | LYM583 | 0.80 | 1.00E-02 | 20 | 78 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM583 | 0.77 | 1.50E−02 | 20 | 75 | LYM583 | 0.87 | 2.37E−03 | 20 | 92 |
| LYM583 | 0.76 | 1.67E−02 | 20 | 90 | LYM583 | 0.89 | 1.30E−03 | 20 | 91 |
| LYM583 | 0.77 | 1.47E−02 | 20 | 76 | LYM583 | 0.71 | 3.25E−02 | 20 | 77 |
| LYM583 | 0.81 | 7.94E−03 | 20 | 89 | LYM583 | 0.91 | 7.68E−04 | 20 | 93 |
| LYM583 | 0.74 | 2.24E−02 | 20 | 85 | LYM583 | 0.70 | 1.21E−01 | 22 | 78 |
| LYM583 | 0.76 | 2.87E−02 | 24 | 74 | LYM585 | 0.88 | 2.00E−02 | 14 | 81 |
| LYM585 | 0.88 | 8.09E−03 | 14 | 83 | LYM585 | 0.71 | 4.97E−02 | 17 | 81 |
| LYM585 | 0.70 | 5.23E−02 | 17 | 82 | LYM585 | 0.83 | 1.07E−02 | 17 | 75 |
| LYM585 | 0.85 | 7.41E−03 | 17 | 92 | LYM585 | 0.86 | 6.17E−03 | 17 | 91 |
| LYM585 | 0.76 | 2.75E−02 | 17 | 89 | LYM585 | 0.72 | 4.24E−02 | 17 | 84 |
| LYM585 | 0.86 | 1.23E−02 | 18 | 75 | LYM585 | 0.70 | 1.21E−01 | 22 | 78 |
| LYM586 | 0.70 | 5.19E−02 | 3 | 88 | LYM586 | 0.80 | 5.61E−03 | 7 | 78 |
| LYM586 | 0.71 | 2.15E−02 | 7 | 93 | LYM586 | 0.73 | 6.34E−02 | 14 | 76 |
| LYM586 | 0.83 | 2.15E−02 | 14 | 77 | LYM586 | 0.71 | 7.57E−02 | 14 | 86 |
| LYM586 | 0.78 | 3.73E−02 | 18 | 88 | LYM586 | 0.78 | 4.05E−02 | 18 | 87 |
| LYM586 | 0.73 | 6.15E−02 | 18 | 91 | LYM586 | 0.91 | 4.42E−03 | 18 | 76 |
| LYM586 | 0.96 | 5.62E−04 | 18 | 77 | LYM586 | 0.76 | 4.83E−02 | 18 | 89 |
| LYM586 | 0.82 | 2.47E−02 | 18 | 86 | LYM586 | 0.75 | 5.34E−02 | 18 | 93 |
| LYM586 | 0.72 | 7.06E−02 | 18 | 84 | LYM586 | 0.74 | 5.70E−02 | 18 | 85 |
| LYM586 | 0.79 | 1.15E−02 | 20 | 88 | LYM586 | 0.76 | 1.78E−02 | 20 | 87 |
| LYM586 | 0.72 | 2.75E−02 | 20 | 82 | LYM586 | 0.79 | 1.22E−02 | 20 | 76 |
| LYM586 | 0.87 | 2.46E−03 | 20 | 77 | LYM586 | 0.76 | 1.70E−02 | 20 | 89 |
| LYM586 | 0.84 | 4.15E−03 | 20 | 86 | LYM586 | 0.79 | 1.20E−02 | 20 | 84 |
| LYM586 | 0.72 | 2.82E−02 | 20 | 85 | LYM587 | 0.81 | 5.13E−02 | 1 | 74 |
| LYM587 | 0.75 | 1.87E−02 | 6 | 73 | LYM587 | 0.93 | 7.47E−03 | 8 | 73 |
| LYM587 | 0.86 | 2.97E−02 | 12 | 73 | LYM587 | 0.77 | 7.03E−02 | 22 | 93 |
| LYM588 | 0.73 | 1.59E−02 | 7 | 88 | LYM588 | 0.83 | 4.04E−02 | 8 | 74 |
| LYM588 | 0.71 | 7.40E−02 | 14 | 80 | LYM588 | 0.74 | 9.02E−02 | 16 | 74 |
| LYM588 | 0.94 | 1.40E−03 | 18 | 88 | LYM588 | 0.90 | 6.34E−03 | 18 | 87 |
| LYM588 | 0.91 | 4.04E−03 | 18 | 82 | LYM588 | 0.79 | 3.41E−02 | 18 | 75 |
| LYM588 | 0.88 | 8.49E−03 | 18 | 92 | LYM588 | 0.93 | 2.76E−03 | 18 | 79 |
| LYM588 | 0.81 | 2.77E−02 | 18 | 91 | LYM588 | 0.81 | 2.59E−02 | 18 | 76 |
| LYM588 | 0.88 | 9.28E−03 | 18 | 77 | LYM588 | 0.89 | 6.93E−03 | 18 | 89 |
| LYM588 | 0.97 | 3.46E−04 | 18 | 86 | LYM588 | 0.98 | 1.80E−04 | 18 | 84 |
| LYM588 | 0.91 | 4.69E−03 | 18 | 85 | LYM588 | 0.73 | 2.45E−02 | 20 | 87 |
| LYM588 | 0.80 | 9.69E−03 | 20 | 78 | LYM588 | 0.75 | 1.99E−02 | 20 | 92 |
| LYM588 | 0.79 | 1.16E−02 | 20 | 90 | LYM588 | 0.78 | 1.38E−02 | 20 | 91 |
| LYM588 | 0.74 | 2.38E−02 | 20 | 89 | LYM588 | 0.80 | 8.92E−03 | 20 | 93 |
| LYM588 | 0.75 | 1.96E−02 | 20 | 85 | LYM589 | 0.84 | 3.79E−02 | 1 | 74 |
| LYM589 | 0.80 | 1.79E−02 | 3 | 78 | LYM589 | 0.76 | 1.69E−02 | 20 | 87 |
| LYM589 | 0.74 | 2.30E−02 | 20 | 78 | LYM589 | 0.76 | 1.87E−02 | 20 | 75 |
| LYM589 | 0.75 | 1.88E−02 | 20 | 92 | LYM589 | 0.88 | 1.98E−03 | 20 | 90 |
| LYM589 | 0.83 | 6.04E−03 | 20 | 91 | LYM589 | 0.79 | 1.12E−02 | 20 | 89 |
| LYM589 | 0.86 | 2.82E−03 | 20 | 93 | LYM589 | 0.75 | 1.98E−02 | 20 | 85 |
| LYM589 | 0.72 | 1.08E−01 | 22 | 88 | LYM589 | 0.72 | 1.05E−01 | 22 | 92 |
| LYM589 | 0.79 | 6.01E−02 | 22 | 89 | LYM589 | 0.74 | 9.47E−02 | 22 | 86 |
| LYM589 | 0.75 | 8.56E−02 | 22 | 84 | LYM590 | 0.71 | 3.36E−02 | 7 | 81 |
| LYM590 | 0.93 | 2.30E−03 | 14 | 88 | LYM590 | 0.99 | 2.65E−05 | 14 | 87 |
| LYM590 | 0.79 | 3.64E−02 | 14 | 82 | LYM590 | 0.87 | 1.06E−02 | 14 | 78 |
| LYM590 | 0.92 | 3.01E−03 | 14 | 75 | LYM590 | 0.98 | 5.29E−05 | 14 | 92 |
| LYM590 | 0.89 | 7.49E−03 | 14 | 79 | LYM590 | 0.88 | 9.37E−03 | 14 | 90 |
| LYM590 | 0.98 | 1.26E−04 | 14 | 91 | LYM590 | 0.93 | 2.19E−03 | 14 | 76 |
| LYM590 | 0.89 | 7.95E−03 | 14 | 77 | LYM590 | 0.99 | 1.42E−05 | 14 | 89 |
| LYM590 | 0.88 | 9.57E−03 | 14 | 86 | LYM590 | 0.88 | 8.54E−03 | 14 | 93 |
| LYM590 | 0.90 | 5.51E−03 | 14 | 84 | LYM590 | 0.97 | 2.23E−04 | 14 | 85 |
| LYM590 | 0.77 | 4.30E−02 | 15 | 88 | LYM590 | 0.75 | 5.13E−02 | 15 | 87 |
| LYM590 | 0.83 | 2.15E−02 | 15 | 75 | LYM590 | 0.88 | 9.09E−03 | 15 | 79 |
| LYM590 | 0.73 | 6.43E−02 | 15 | 80 | LYM590 | 0.74 | 5.49E−02 | 15 | 86 |
| LYM590 | 0.79 | 3.28E−02 | 15 | 84 | LYM590 | 0.75 | 5.08E−02 | 15 | 85 |
| LYM590 | 0.94 | 4.96E−03 | 16 | 74 | LYM590 | 0.90 | 2.10E−03 | 17 | 81 |
| LYM590 | 0.87 | 4.81E−03 | 17 | 75 | LYM590 | 0.71 | 4.97E−02 | 17 | 92 |
| LYM590 | 0.73 | 4.12E−02 | 17 | 91 | LYM590 | 0.91 | 1.49E−03 | 17 | 83 |
| LYM590 | 0.80 | 1.82E−02 | 17 | 89 | LYM590 | 0.74 | 5.50E−02 | 18 | 78 |
| LYM590 | 0.74 | 5.68E−02 | 18 | 92 | LYM590 | 0.80 | 3.20E−02 | 18 | 90 |
| LYM590 | 0.84 | 1.92E−02 | 18 | 91 | LYM590 | 0.73 | 6.38E−02 | 18 | 76 |
| LYM590 | 0.78 | 3.86E−02 | 18 | 77 | LYM590 | 0.78 | 3.69E−02 | 18 | 89 |
| LYM590 | 0.90 | 5.69E−03 | 18 | 93 | LYM591 | 0.73 | 1.01E−01 | 14 | 81 |
| LYM591 | 0.82 | 2.28E−02 | 14 | 82 | LYM591 | 0.78 | 3.73E−02 | 14 | 75 |
| LYM591 | 0.82 | 2.49E−02 | 14 | 79 | LYM591 | 0.78 | 3.72E−02 | 14 | 86 |
| LYM591 | 0.80 | 3.00E−02 | 14 | 84 | LYM591 | 0.75 | 5.42E−02 | 18 | 76 |
| LYM592 | 0.73 | 4.03E−02 | 3 | 88 | LYM592 | 0.75 | 3.29E−02 | 3 | 92 |
| LYM592 | 0.71 | 4.84E−02 | 3 | 84 | LYM592 | 0.78 | 2.15E−02 | 3 | 85 |
| LYM592 | 0.71 | 7.12E−02 | 15 | 82 | LYM592 | 0.75 | 3.38E−02 | 17 | 88 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM592 | 0.76 | 2.79E−02 | 17 | 87 | LYM592 | 0.79 | 2.06E−02 | 17 | 79 |
| LYM592 | 0.71 | 4.73E−02 | 17 | 80 | LYM592 | 0.87 | 5.33E−03 | 17 | 85 |
| LYM592 | 0.76 | 4.60E−02 | 18 | 82 | LYM592 | 0.73 | 9.67E−02 | 22 | 80 |
| LYM593 | 0.71 | 5.03E−02 | 17 | 78 | LYM593 | 0.95 | 3.23E−03 | 18 | 81 |
| LYM593 | 0.84 | 1.72E−02 | 18 | 83 | LYM594 | 0.74 | 9.55E−02 | 12 | 74 |
| LYM594 | 0.75 | 5.00E−02 | 14 | 78 | LYM594 | 0.78 | 3.76E−02 | 14 | 90 |
| LYM594 | 0.78 | 3.91E−02 | 14 | 93 | LYM594 | 0.75 | 3.06E−02 | 17 | 81 |
| LYM594 | 0.78 | 2.17E−02 | 17 | 75 | LYM594 | 0.70 | 5.26E−02 | 17 | 91 |
| LYM594 | 0.73 | 3.91E−02 | 17 | 83 | LYM594 | 0.70 | 5.32E−02 | 17 | 89 |
| LYM594 | 0.76 | 4.66E−02 | 18 | 78 | LYM594 | 0.72 | 7.00E−02 | 18 | 90 |
| LYM594 | 0.71 | 7.37E−02 | 18 | 91 | LYM594 | 0.77 | 4.33E−02 | 18 | 93 |
| LYM594 | 0.78 | 6.75E−02 | 22 | 79 | LYM594 | 0.81 | 5.09E−02 | 22 | 80 |
| LYM594 | 0.78 | 6.63E−02 | 22 | 85 | LYM595 | 0.81 | 4.83E−02 | 1 | 74 |
| LYM595 | 0.81 | 1.46E−02 | 3 | 79 | LYM595 | 0.76 | 2.93E−02 | 3 | 85 |
| LYM595 | 0.75 | 1.29E−02 | 7 | 79 | LYM595 | 0.91 | 1.11E−02 | 8 | 74 |
| LYM595 | 0.74 | 9.08E−02 | 12 | 74 | LYM595 | 0.71 | 7.12E−02 | 14 | 75 |
| LYM595 | 0.84 | 1.68E−02 | 14 | 79 | LYM595 | 0.76 | 4.64E−02 | 14 | 80 |
| LYM595 | 0.77 | 4.29E−02 | 14 | 84 | LYM595 | 0.90 | 6.28E−03 | 15 | 88 |
| LYM595 | 0.78 | 3.97E−02 | 15 | 87 | LYM595 | 0.71 | 7.40E−02 | 15 | 82 |
| LYM595 | 0.71 | 7.67E−02 | 15 | 75 | LYM595 | 0.72 | 7.03E−02 | 15 | 92 |
| LYM595 | 0.95 | 8.52E−04 | 15 | 79 | LYM595 | 0.86 | 1.33E−02 | 15 | 80 |
| LYM595 | 0.83 | 1.97E−02 | 15 | 86 | LYM595 | 0.93 | 2.57E−03 | 15 | 84 |
| LYM595 | 0.84 | 1.70E−02 | 15 | 85 | LYM595 | 0.81 | 5.03E−02 | 16 | 74 |
| LYM595 | 0.82 | 1.36E−02 | 17 | 88 | LYM595 | 0.81 | 1.43E−02 | 17 | 87 |
| LYM595 | 0.71 | 4.70E−02 | 17 | 92 | LYM595 | 0.87 | 4.62E−03 | 17 | 79 |
| LYM595 | 0.77 | 2.57E−02 | 17 | 84 | LYM595 | 0.90 | 2.37E−03 | 17 | 85 |
| LYM595 | 0.77 | 4.35E−02 | 18 | 88 | LYM595 | 0.77 | 4.26E−02 | 18 | 82 |
| LYM595 | 0.76 | 4.66E−02 | 18 | 75 | LYM595 | 0.91 | 4.91E−03 | 18 | 79 |
| LYM595 | 0.78 | 3.95E−02 | 18 | 80 | LYM595 | 0.75 | 5.25E−02 | 18 | 86 |
| LYM595 | 0.86 | 1.37E−02 | 18 | 84 | LYM595 | 0.74 | 5.52E−02 | 18 | 85 |
| LYM595 | 0.78 | 2.21E−02 | 20 | 81 | LYM595 | 0.71 | 1.17E−01 | 22 | 87 |
| LYM595 | 0.79 | 5.90E−02 | 22 | 79 | LYM595 | 0.77 | 7.05E−02 | 22 | 80 |
| LYM595 | 0.79 | 6.20E−02 | 22 | 85 | LYM595 | 0.86 | 6.54E−03 | 24 | 74 |
| LYM596 | 0.86 | 2.64E−02 | 8 | 73 | LYM596 | 0.72 | 6.55E−02 | 14 | 83 |
| LYM596 | 0.71 | 1.18E−01 | 22 | 83 | LYM596 | 0.87 | 2.37E−02 | 22 | 93 |
| LYM598 | 0.77 | 2.51E−02 | 3 | 78 | LYM598 | 0.73 | 6.23E−02 | 14 | 76 |
| LYM598 | 0.71 | 7.14E−02 | 15 | 75 | LYM598 | 0.76 | 8.17E−02 | 22 | 90 |
| LYM598 | 0.72 | 1.04E−01 | 22 | 93 | LYM599 | 0.85 | 8.24E−03 | 3 | 90 |
| LYM599 | 0.78 | 2.33E−02 | 3 | 80 | LYM599 | 0.73 | 6.34E−02 | 14 | 88 |
| LYM599 | 0.77 | 4.47E−02 | 14 | 87 | LYM599 | 0.83 | 1.95E−02 | 14 | 82 |
| LYM599 | 0.78 | 3.78E−02 | 14 | 78 | LYM599 | 0.72 | 7.01E−02 | 14 | 75 |
| LYM599 | 0.87 | 1.09E−02 | 14 | 92 | LYM599 | 0.75 | 5.01E−02 | 14 | 79 |
| LYM599 | 0.75 | 5.21E−02 | 14 | 90 | LYM599 | 0.79 | 3.51E−02 | 14 | 91 |
| LYM599 | 0.82 | 2.37E−02 | 14 | 89 | LYM599 | 0.72 | 6.68E−02 | 14 | 84 |
| LYM599 | 0.78 | 3.79E−02 | 14 | 85 | LYM599 | 0.76 | 4.64E−02 | 15 | 88 |
| LYM599 | 0.82 | 2.33E−02 | 15 | 79 | LYM599 | 0.87 | 1.12E−02 | 15 | 80 |
| LYM599 | 0.73 | 6.28E−02 | 15 | 84 | LYM599 | 0.72 | 7.07E−02 | 15 | 85 |
| LYM599 | 0.78 | 6.55E−02 | 16 | 74 | LYM599 | 0.72 | 4.26E−02 | 17 | 75 |
| LYM599 | 0.75 | 3.32E−02 | 17 | 91 | LYM599 | 0.80 | 1.62E−02 | 17 | 83 |
| LYM599 | 0.72 | 4.36E−02 | 17 | 89 | LYM599 | 0.77 | 1.60E−02 | 20 | 78 |
| LYM599 | 0.96 | 1.90E−03 | 22 | 78 | LYM600 | 0.85 | 3.33E−02 | 22 | 82 |
| LYM601 | 0.86 | 2.92E−02 | 18 | 81 | LYM602 | 0.70 | 5.21E−02 | 3 | 93 |
| LYM602 | 0.79 | 6.13E−02 | 8 | 74 | LYM602 | 0.72 | 1.04E−01 | 12 | 73 |
| LYM602 | 0.76 | 8.26E−02 | 15 | 81 | LYM602 | 0.71 | 7.45E−02 | 15 | 86 |
| LYM602 | 0.85 | 3.20E−02 | 16 | 74 | LYM602 | 0.83 | 9.90E−03 | 17 | 81 |
| LYM602 | 0.87 | 4.78E−03 | 17 | 75 | LYM602 | 0.74 | 3.52E−02 | 17 | 92 |
| LYM602 | 0.81 | 1.53E−02 | 17 | 91 | LYM602 | 0.82 | 1.22E−02 | 17 | 83 |
| LYM602 | 0.76 | 2.99E−02 | 17 | 89 | LYM602 | 0.79 | 6.18E−02 | 18 | 81 |
| LYM602 | 0.85 | 1.49E−02 | 18 | 82 | LYM602 | 0.77 | 4.28E−02 | 18 | 83 |
| LYM602 | 0.70 | 7.79E−02 | 18 | 77 | LYM602 | 0.88 | 8.38E−03 | 18 | 86 |
| LYM602 | 0.78 | 3.68E−02 | 18 | 84 | LYM602 | 0.72 | 1.06E−01 | 22 | 90 |
| LYM602 | 0.84 | 3.44E−02 | 22 | 93 | LYM603 | 0.73 | 3.79E−02 | 3 | 76 |
| LYM603 | 0.76 | 2.70E−02 | 17 | 81 | LYM603 | 0.74 | 3.76E−02 | 17 | 75 |
| LYM603 | 0.79 | 1.91E−02 | 17 | 83 | LYM603 | 0.75 | 3.32E−02 | 17 | 89 |
| LYM603 | 0.70 | 3.54E−02 | 20 | 78 | LYM603 | 0.73 | 2.65E−02 | 20 | 92 |
| LYM603 | 0.72 | 2.83E−02 | 20 | 91 | LYM603 | 0.77 | 7.21E−02 | 22 | 78 |
| LYM606 | 0.80 | 1.79E−02 | 3 | 90 | LYM606 | 0.79 | 2.07E−02 | 3 | 93 |
| LYM606 | 0.76 | 2.74E−02 | 4 | 73 | LYM606 | 0.71 | 7.48E−02 | 14 | 78 |
| LYM606 | 0.71 | 3.15E−02 | 20 | 93 | LYM606 | 0.99 | 3.31E−04 | 22 | 90 |
| LYM606 | 0.93 | 6.58E−03 | 22 | 80 | LYM607 | 0.86 | 2.92E−02 | 1 | 74 |
| LYM607 | 0.75 | 8.49E−02 | 22 | 90 | LYM607 | 0.73 | 9.81E−02 | 22 | 80 |
| LYM608 | 0.79 | 6.30E−02 | 1 | 74 | LYM608 | 0.74 | 3.71E−02 | 3 | 88 |
| LYM608 | 0.73 | 4.03E−02 | 3 | 86 | LYM608 | 0.74 | 3.62E−02 | 3 | 84 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM608 | 0.80 | 5.44E−02 | 8 | 73 | LYM608 | 0.71 | 4.62E−02 | 17 | 75 |
| LYM608 | 0.72 | 4.32E−02 | 17 | 83 | LYM608 | 0.71 | 4.89E−02 | 17 | 93 |
| LYM608 | 0.91 | 1.24E−02 | 22 | 90 | LYM608 | 0.77 | 7.56E−02 | 22 | 80 |
| LYM608 | 0.79 | 5.90E−02 | 22 | 93 | LYM609 | 0.74 | 9.55E−02 | 12 | 74 |
| LYM609 | 0.70 | 7.92E−02 | 14 | 87 | LYM609 | 0.71 | 7.46E−02 | 14 | 90 |
| LYM609 | 0.91 | 3.93E−03 | 14 | 76 | LYM609 | 0.83 | 2.01E−02 | 14 | 77 |
| LYM609 | 0.74 | 5.89E−02 | 14 | 86 | LYM609 | 0.75 | 5.03E−02 | 14 | 93 |
| LYM609 | 0.86 | 2.68E−02 | 15 | 81 | LYM609 | 0.84 | 1.68E−02 | 15 | 88 |
| LYM609 | 0.84 | 1.68E−02 | 15 | 87 | LYM609 | 0.73 | 6.18E−02 | 15 | 92 |
| LYM609 | 0.79 | 3.44E−02 | 15 | 79 | LYM609 | 0.76 | 4.55E−02 | 15 | 90 |
| LYM609 | 0.73 | 6.36E−02 | 15 | 91 | LYM609 | 0.74 | 5.91E−02 | 15 | 80 |
| LYM609 | 0.79 | 3.58E−02 | 15 | 76 | LYM609 | 0.75 | 5.43E−02 | 15 | 83 |
| LYM609 | 0.71 | 7.18E−02 | 15 | 77 | LYM609 | 0.74 | 5.53E−02 | 15 | 89 |
| LYM609 | 0.73 | 6.42E−02 | 15 | 84 | LYM609 | 0.83 | 2.18E−02 | 15 | 85 |
| LYM609 | 0.74 | 9.42E−02 | 16 | 74 | LYM609 | 0.71 | 4.93E−02 | 17 | 76 |
| LYM609 | 0.83 | 2.01E−02 | 18 | 82 | LYM609 | 0.71 | 7.66E−02 | 18 | 92 |
| LYM609 | 0.72 | 7.05E−02 | 18 | 91 | LYM609 | 0.76 | 4.93E−02 | 18 | 76 |
| LYM609 | 0.86 | 1.23E−02 | 18 | 77 | LYM609 | 0.78 | 3.69E−02 | 18 | 89 |
| LYM609 | 0.81 | 2.87E−02 | 18 | 86 | LYM609 | 0.73 | 2.44E−02 | 20 | 77 |
| LYM609 | 0.78 | 6.75E−02 | 22 | 79 | LYM609 | 0.81 | 5.09E−02 | 22 | 80 |
| LYM609 | 0.78 | 6.63E−02 | 22 | 85 | LYM610 | 0.80 | 1.66E−02 | 3 | 88 |
| LYM610 | 0.74 | 3.39E−02 | 3 | 87 | LYM610 | 0.71 | 4.74E−02 | 3 | 92 |
| LYM610 | 0.76 | 2.97E−02 | 3 | 79 | LYM610 | 0.72 | 4.61E−02 | 3 | 80 |
| LYM610 | 0.80 | 1.77E−02 | 3 | 84 | LYM610 | 0.79 | 1.85E−02 | 3 | 85 |
| LYM610 | 0.82 | 6.80E−03 | 6 | 73 | LYM610 | 0.78 | 2.38E−02 | 9 | 74 |
| LYM610 | 0.86 | 2.65E−02 | 22 | 90 | LYM610 | 0.82 | 4.50E−02 | 22 | 93 |
| LYM611 | 0.76 | 8.03E−02 | 1 | 74 | LYM611 | 0.77 | 7.43E−02 | 8 | 74 |
| LYM611 | 0.74 | 3.75E−02 | 17 | 85 | LYM611 | 0.87 | 2.40E−02 | 22 | 88 |
| LYM611 | 0.75 | 8.77E−02 | 22 | 87 | LYM611 | 0.72 | 1.09E−01 | 22 | 82 |
| LYM611 | 0.85 | 3.29E−02 | 22 | 92 | LYM611 | 0.88 | 1.94E−02 | 22 | 79 |
| LYM611 | 0.73 | 9.69E−02 | 22 | 77 | LYM611 | 0.77 | 7.50E−02 | 22 | 89 |
| LYM611 | 0.73 | 1.02E−01 | 22 | 86 | LYM611 | 0.82 | 4.35E−02 | 22 | 84 |
| LYM611 | 0.84 | 3.84E−02 | 22 | 85 | LYM612 | 0.74 | 9.56E−02 | 1 | 74 |
| LYM612 | 0.72 | 4.60E−02 | 4 | 74 | LYM612 | 0.71 | 7.48E−02 | 14 | 88 |
| LYM612 | 0.71 | 7.15E−02 | 14 | 87 | LYM612 | 0.73 | 6.37E−02 | 14 | 90 |
| LYM612 | 0.71 | 7.35E−02 | 14 | 76 | LYM612 | 0.70 | 7.71E−02 | 14 | 89 |
| LYM612 | 0.79 | 2.02E−02 | 17 | 81 | LYM612 | 0.77 | 2.54E−02 | 17 | 75 |
| LYM612 | 0.71 | 4.98E−02 | 17 | 91 | LYM612 | 0.75 | 3.38E−02 | 17 | 83 |
| LYM612 | 0.70 | 5.20E−02 | 17 | 89 | LYM612 | 0.92 | 3.12E−03 | 18 | 88 |
| LYM612 | 0.83 | 2.12E−02 | 18 | 87 | LYM612 | 0.77 | 4.27E−02 | 18 | 82 |
| LYM612 | 0.78 | 3.88E−02 | 18 | 92 | LYM612 | 0.87 | 1.10E−02 | 18 | 79 |
| LYM612 | 0.73 | 6.37E−02 | 18 | 91 | LYM612 | 0.78 | 3.67E−02 | 18 | 76 |
| LYM612 | 0.88 | 8.21E−03 | 18 | 77 | LYM612 | 0.78 | 3.84E−02 | 18 | 89 |
| LYM612 | 0.93 | 2.42E−03 | 18 | 86 | LYM612 | 0.92 | 3.20E−03 | 18 | 84 |
| LYM612 | 0.86 | 1.30E−02 | 18 | 85 | LYM612 | 0.72 | 4.34E−02 | 24 | 73 |
| LYM613 | 0.76 | 7.85E−02 | 1 | 73 | LYM613 | 0.72 | 2.72E−02 | 6 | 73 |
| LYM613 | 0.82 | 4.72E−02 | 8 | 73 | LYM613 | 0.79 | 6.13E−02 | 16 | 73 |
| LYM614 | 0.90 | 1.45E−02 | 1 | 73 | LYM614 | 0.73 | 4.02E−02 | 3 | 88 |
| LYM614 | 0.80 | 1.71E−02 | 3 | 80 | LYM614 | 0.93 | 7.01E−03 | 8 | 74 |
| LYM614 | 0.90 | 5.60E−03 | 15 | 82 | LYM614 | 0.71 | 7.40E−02 | 15 | 75 |
| LYM614 | 0.71 | 7.28E−02 | 15 | 92 | LYM614 | 0.74 | 5.55E−02 | 15 | 83 |
| LYM614 | 0.72 | 7.04E−02 | 15 | 89 | LYM614 | 0.72 | 6.82E−02 | 15 | 86 |
| LYM614 | 0.97 | 9.45E−05 | 17 | 75 | LYM614 | 0.84 | 8.78E−03 | 17 | 92 |
| LYM614 | 0.93 | 9.01E−04 | 17 | 91 | LYM614 | 0.79 | 1.90E−02 | 17 | 83 |
| LYM614 | 0.90 | 2.33E−03 | 17 | 89 | LYM614 | 0.74 | 3.55E−02 | 17 | 86 |
| LYM614 | 0.74 | 3.68E−02 | 17 | 84 | LYM614 | 0.78 | 3.87E−02 | 18 | 78 |
| LYM614 | 0.76 | 4.67E−02 | 18 | 90 | LYM614 | 0.72 | 6.62E−02 | 18 | 91 |
| LYM614 | 0.82 | 2.24E−02 | 18 | 93 | LYM614 | 0.76 | 7.77E−02 | 22 | 82 |
| LYM615 | 0.76 | 2.75E−02 | 3 | 83 | LYM615 | 0.71 | 1.17E−01 | 12 | 73 |
| LYM615 | 0.72 | 6.85E−02 | 14 | 78 | LYM615 | 0.77 | 4.48E−02 | 14 | 90 |
| LYM615 | 0.74 | 5.86E−02 | 14 | 76 | LYM615 | 0.78 | 3.71E−02 | 14 | 93 |
| LYM615 | 0.87 | 5.34E−03 | 17 | 81 | LYM615 | 0.82 | 1.29E−02 | 17 | 75 |
| LYM615 | 0.73 | 4.18E−02 | 17 | 91 | LYM615 | 0.82 | 1.22E−02 | 17 | 83 |
| LYM615 | 0.72 | 4.24E−02 | 17 | 89 | LYM615 | 0.72 | 1.05E−01 | 18 | 81 |
| LYM615 | 0.75 | 5.36E−02 | 18 | 83 | LYM615 | 0.90 | 1.40E−02 | 22 | 93 |
| LYM616 | 0.73 | 1.56E−02 | 7 | 87 | LYM616 | 0.88 | 7.16E−04 | 7 | 78 |
| LYM616 | 0.83 | 2.74E−03 | 7 | 92 | LYM616 | 0.85 | 1.95E−03 | 7 | 90 |
| LYM616 | 0.86 | 1.39E−03 | 7 | 91 | LYM616 | 0.74 | 1.38E−02 | 7 | 76 |
| LYM616 | 0.70 | 2.42E−02 | 7 | 77 | LYM616 | 0.83 | 2.86E−03 | 7 | 89 |
| LYM616 | 0.88 | 8.82E−04 | 7 | 93 | LYM616 | 0.72 | 7.05E−02 | 14 | 88 |
| LYM616 | 0.82 | 2.40E−02 | 14 | 87 | LYM616 | 0.70 | 7.92E−02 | 14 | 82 |
| LYM616 | 0.88 | 9.18E−03 | 14 | 78 | LYM616 | 0.92 | 3.46E−03 | 14 | 92 |
| LYM616 | 0.87 | 1.08E−02 | 14 | 90 | LYM616 | 0.91 | 3.88E−03 | 14 | 91 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM616 | 0.70 | 7.96E−02 | 14 | 77 | LYM616 | 0.88 | 8.53E−03 | 14 | 89 |
| LYM616 | 0.86 | 1.36E−02 | 14 | 93 | LYM616 | 0.82 | 2.47E−02 | 14 | 85 |
| LYM616 | 0.88 | 9.37E−03 | 15 | 78 | LYM616 | 0.71 | 7.64E−02 | 15 | 92 |
| LYM616 | 0.89 | 7.84E−03 | 15 | 90 | LYM616 | 0.76 | 4.79E−02 | 15 | 91 |
| LYM616 | 0.82 | 2.49E−02 | 15 | 93 | LYM616 | 0.90 | 6.19E−03 | 18 | 78 |
| LYM616 | 0.79 | 3.33E−02 | 18 | 92 | LYM616 | 0.90 | 6.44E−03 | 18 | 90 |
| LYM616 | 0.81 | 2.69E−02 | 18 | 91 | LYM616 | 0.81 | 2.68E−02 | 18 | 89 |
| LYM616 | 0.79 | 3.40E−02 | 18 | 93 | LYM616 | 0.75 | 1.94E−02 | 20 | 87 |
| LYM616 | 0.84 | 5.09E−03 | 20 | 78 | LYM616 | 0.76 | 1.65E−02 | 20 | 92 |
| LYM616 | 0.81 | 7.52E−03 | 20 | 90 | LYM616 | 0.78 | 1.41E−02 | 20 | 91 |
| LYM616 | 0.74 | 2.20E−02 | 20 | 89 | LYM616 | 0.78 | 1.30E−02 | 20 | 93 |
| LYM616 | 0.74 | 2.13E−02 | 20 | 85 | LYM616 | 0.78 | 6.64E−02 | 22 | 78 |
| LYM617 | 0.72 | 1.09E−01 | 14 | 81 | LYM617 | 0.74 | 5.74E−02 | 18 | 76 |
| LYM617 | 0.85 | 3.32E−02 | 22 | 78 | LYM617 | 0.75 | 8.53E−02 | 8 | 74 |
| LYM618 | 0.73 | 9.94E−02 | 14 | 81 | LYM618 | 0.77 | 7.52E−02 | 15 | 81 |
| LYM618 | 0.80 | 5.84E−02 | 16 | 74 | LYM618 | 0.71 | 5.01E−02 | 17 | 81 |
| LYM618 | 0.77 | 2.41E−02 | 17 | 82 | LYM618 | 0.72 | 4.36E−02 | 17 | 75 |
| LYM619 | 0.74 | 3.76E−02 | 3 | 75 | LYM619 | 0.78 | 2.14E−02 | 3 | 89 |
| LYM620 | 0.89 | 1.69E−02 | 18 | 81 | LYM620 | 0.78 | 3.99E−02 | 18 | 83 |
| LYM620 | 0.77 | 1.61E−02 | 20 | 83 | LYM620 | 0.72 | 1.05E−01 | 22 | 82 |
| LYM621 | 0.78 | 2.31E−02 | 3 | 78 | LYM621 | 0.89 | 1.76E−02 | 16 | 74 |
| LYM621 | 0.84 | 8.30E−03 | 17 | 81 | LYM621 | 0.91 | 1.57E−03 | 17 | 75 |
| LYM621 | 0.79 | 1.91E−02 | 17 | 92 | LYM621 | 0.85 | 7.84E−03 | 17 | 91 |
| LYM621 | 0.92 | 1.33E−03 | 17 | 83 | LYM621 | 0.87 | 4.70E−03 | 17 | 89 |
| LYM621 | 0.78 | 2.31E−02 | 17 | 86 | LYM621 | 0.74 | 3.40E−02 | 17 | 84 |
| LYM621 | 0.75 | 8.71E−02 | 22 | 90 | LYM621 | 0.78 | 6.73E−02 | 22 | 80 |
| LYM621 | 0.72 | 1.08E−01 | 22 | 93 | LYM622 | 0.70 | 5.21E−02 | 3 | 78 |
| LYM623 | 0.73 | 4.17E−02 | 3 | 80 | LYM623 | 0.82 | 3.56E−03 | 7 | 80 |
| LYM623 | 0.91 | 1.19E−02 | 8 | 73 | LYM623 | 0.85 | 8.01E−03 | 9 | 74 |
| LYM623 | 0.74 | 9.19E−02 | 15 | 81 | LYM623 | 0.74 | 8.96E−02 | 22 | 93 |
| LYM624 | 0.85 | 3.15E−02 | 12 | 73 | LYM624 | 0.72 | 6.84E−02 | 18 | 88 |
| LYM624 | 0.75 | 4.98E−02 | 18 | 76 | LYM624 | 0.79 | 3.26E−02 | 18 | 77 |
| LYM624 | 0.73 | 6.19E−02 | 18 | 93 | LYM624 | 0.79 | 6.03E−02 | 22 | 93 |
| LYM625 | 0.72 | 1.09E−01 | 8 | 73 | LYM625 | 0.88 | 9.51E−03 | 14 | 88 |
| LYM625 | 0.81 | 2.71E−02 | 14 | 87 | LYM625 | 0.91 | 4.07E−03 | 14 | 82 |
| LYM625 | 0.87 | 1.05E−02 | 14 | 92 | LYM625 | 0.88 | 9.01E−03 | 14 | 79 |
| LYM625 | 0.78 | 3.97E−02 | 14 | 91 | LYM625 | 0.76 | 4.92E−02 | 14 | 77 |
| LYM625 | 0.82 | 2.24E−02 | 14 | 89 | LYM625 | 0.82 | 2.29E−02 | 14 | 86 |
| LYM625 | 0.91 | 4.69E−03 | 14 | 84 | LYM625 | 0.87 | 1.18E−02 | 14 | 85 |
| LYM625 | 0.73 | 6.48E−02 | 15 | 88 | LYM625 | 0.71 | 7.36E−02 | 15 | 82 |
| LYM625 | 0.81 | 2.85E−02 | 15 | 79 | LYM625 | 0.80 | 3.02E−02 | 15 | 80 |
| LYM625 | 0.78 | 3.69E−02 | 15 | 84 | LYM625 | 0.76 | 2.76E−02 | 17 | 87 |
| LYM625 | 0.81 | 1.55E−02 | 17 | 83 | LYM625 | 0.80 | 1.78E−02 | 17 | 89 |
| LYM625 | 0.74 | 3.58E−02 | 17 | 86 | LYM625 | 0.75 | 3.22E−02 | 17 | 84 |
| LYM625 | 0.72 | 1.04E−01 | 22 | 79 | LYM625 | 0.87 | 2.26E−02 | 22 | 80 |
| LYM625 | 0.79 | 6.02E−02 | 22 | 85 | LYM627 | 0.74 | 3.56E−02 | 9 | 74 |
| LYM627 | 0.75 | 8.52E−02 | 12 | 74 | LYM627 | 0.81 | 2.63E−02 | 14 | 88 |
| LYM627 | 0.89 | 7.03E−03 | 14 | 87 | LYM627 | 0.84 | 1.86E−02 | 14 | 82 |
| LYM627 | 0.85 | 1.56E−02 | 14 | 78 | LYM627 | 0.92 | 3.14E−03 | 14 | 75 |
| LYM627 | 0.91 | 4.58E−03 | 14 | 92 | LYM627 | 0.82 | 2.49E−02 | 14 | 79 |
| LYM627 | 0.84 | 1.69E−02 | 14 | 90 | LYM627 | 0.88 | 9.27E−03 | 14 | 91 |
| LYM627 | 0.87 | 1.06E−02 | 14 | 76 | LYM627 | 0.80 | 3.15E−02 | 14 | 77 |
| LYM627 | 0.95 | 1.31E−03 | 14 | 89 | LYM627 | 0.86 | 1.25E−02 | 14 | 86 |
| LYM627 | 0.75 | 5.26E−02 | 14 | 93 | LYM627 | 0.84 | 1.90E−02 | 14 | 84 |
| LYM627 | 0.85 | 1.66E−02 | 14 | 85 | LYM627 | 0.72 | 6.59E−02 | 15 | 87 |
| LYM627 | 0.72 | 6.87E−02 | 15 | 78 | LYM627 | 0.76 | 4.66E−02 | 15 | 75 |
| LYM627 | 0.82 | 2.43E−02 | 15 | 92 | LYM627 | 0.84 | 1.94E−02 | 15 | 91 |
| LYM627 | 0.80 | 2.99E−02 | 15 | 89 | LYM627 | 0.77 | 4.17E−02 | 15 | 93 |
| LYM627 | 0.72 | 6.60E−02 | 15 | 85 | LYM627 | 0.78 | 2.34E−02 | 17 | 88 |
| LYM627 | 0.84 | 8.93E−03 | 17 | 87 | LYM627 | 0.71 | 5.05E−02 | 17 | 89 |
| LYM627 | 0.87 | 5.50E−03 | 17 | 86 | LYM627 | 0.79 | 1.90E−02 | 17 | 84 |
| LYM627 | 0.76 | 4.69E−02 | 18 | 88 | LYM627 | 0.81 | 2.65E−02 | 18 | 87 |
| LYM627 | 0.81 | 2.87E−02 | 18 | 82 | LYM627 | 0.88 | 8.52E−03 | 18 | 75 |
| LYM627 | 0.80 | 3.22E−02 | 18 | 92 | LYM627 | 0.77 | 4.13E−02 | 18 | 79 |
| LYM627 | 0.70 | 7.78E−02 | 18 | 90 | LYM627 | 0.77 | 4.36E−02 | 18 | 91 |
| LYM627 | 0.87 | 1.08E−02 | 18 | 76 | LYM627 | 0.80 | 3.13E−02 | 18 | 77 |
| LYM627 | 0.86 | 1.20E−02 | 18 | 89 | LYM627 | 0.91 | 4.54E−03 | 18 | 86 |
| LYM627 | 0.83 | 2.17E−02 | 18 | 84 | LYM627 | 0.76 | 4.96E−02 | 18 | 85 |
| LYM627 | 0.91 | 7.13E−04 | 20 | 88 | LYM627 | 0.85 | 3.71E−03 | 20 | 87 |
| LYM627 | 0.80 | 9.24E−03 | 20 | 82 | LYM627 | 0.83 | 5.90E−03 | 20 | 75 |
| LYM627 | 0.88 | 1.73E−03 | 20 | 92 | LYM627 | 0.86 | 3.22E−03 | 20 | 79 |
| LYM627 | 0.85 | 3.96E−03 | 20 | 91 | LYM627 | 0.89 | 1.44E−03 | 20 | 76 |
| LYM627 | 0.91 | 7.86E−04 | 20 | 77 | LYM627 | 0.92 | 4.29E−04 | 20 | 89 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM627 | 0.96 | 4.29E−05 | 20 | 86 | LYM627 | 0.70 | 3.39E−02 | 20 | 93 |
| LYM627 | 0.95 | 1.01E−04 | 20 | 84 | LYM627 | 0.87 | 2.52E−03 | 20 | 85 |
| LYM627 | 0.72 | 1.09E−01 | 22 | 87 | LYM627 | 0.73 | 1.00E−01 | 22 | 75 |
| LYM627 | 0.71 | 1.11E−01 | 22 | 79 | LYM627 | 0.83 | 3.87E−02 | 22 | 80 |
| LYM627 | 0.77 | 7.35E−02 | 22 | 85 | LYM628 | 0.86 | 2.68E−02 | 15 | 81 |
| LYM628 | 0.87 | 2.60E−02 | 16 | 74 | LYM628 | 0.85 | 3.06E−02 | 18 | 81 |
| LYM628 | 0.83 | 2.05E−02 | 18 | 83 | LYM630 | 0.88 | 3.63E−03 | 4 | 74 |
| LYM630 | 0.71 | 1.15E−01 | 8 | 73 | LYM630 | 0.76 | 8.05E−02 | 15 | 81 |
| LYM630 | 0.86 | 6.11E−03 | 17 | 81 | LYM630 | 0.83 | 1.16E−02 | 17 | 75 |
| LYM630 | 0.74 | 3.75E−02 | 17 | 91 | LYM630 | 0.84 | 8.75E−03 | 17 | 83 |
| LYM630 | 0.77 | 2.60E−02 | 17 | 89 | LYM630 | 0.72 | 4.53E−02 | 17 | 86 |
| LYM630 | 0.72 | 6.79E−02 | 18 | 91 | LYM630 | 0.73 | 6.41E−02 | 18 | 77 |
| LYM630 | 0.76 | 4.54E−02 | 18 | 93 | LYM631 | 0.93 | 7.40E−03 | 1 | 73 |
| LYM631 | 0.74 | 1.41E−02 | 7 | 91 | LYM631 | 0.71 | 2.24E−02 | 7 | 76 |
| LYM631 | 0.80 | 5.02E−03 | 7 | 77 | LYM631 | 0.72 | 1.84E−02 | 7 | 89 |
| LYM631 | 0.78 | 7.21E−03 | 7 | 93 | LYM631 | 0.96 | 2.20E−03 | 8 | 73 |
| LYM631 | 0.70 | 7.74E−02 | 15 | 88 | LYM631 | 0.75 | 5.27E−02 | 15 | 87 |
| LYM631 | 0.70 | 7.90E−02 | 15 | 82 | LYM631 | 0.83 | 2.18E−02 | 15 | 92 |
| LYM631 | 0.73 | 6.49E−02 | 15 | 90 | LYM631 | 0.83 | 2.05E−02 | 15 | 91 |
| LYM631 | 0.79 | 3.38E−02 | 15 | 77 | LYM631 | 0.81 | 2.80E−02 | 15 | 89 |
| LYM631 | 0.79 | 3.38E−02 | 15 | 93 | LYM631 | 0.76 | 4.94E−02 | 15 | 85 |
| LYM631 | 0.78 | 2.24E−02 | 17 | 80 | LYM631 | 0.77 | 2.62E−02 | 17 | 93 |
| LYM631 | 0.80 | 1.61E−02 | 17 | 85 | LYM631 | 0.73 | 6.00E−02 | 18 | 93 |
| LYM632 | 0.72 | 7.02E−02 | 14 | 88 | LYM632 | 0.94 | 1.55E−03 | 14 | 82 |
| LYM632 | 0.76 | 4.58E−02 | 14 | 79 | LYM632 | 0.84 | 1.71E−02 | 14 | 86 |
| LYM632 | 0.82 | 2.30E−02 | 14 | 84 | LYM632 | 0.75 | 8.45E−02 | 16 | 73 |
| LYM632 | 0.85 | 3.39E−02 | 22 | 90 | LYM632 | 0.76 | 7.68E−02 | 22 | 80 |
| LYM632 | 0.81 | 5.32E−02 | 22 | 93 | LYM633 | 0.81 | 2.66E−02 | 18 | 87 |
| LYM633 | 0.88 | 9.71E−03 | 18 | 78 | LYM633 | 0.86 | 1.30E−02 | 18 | 75 |
| LYM633 | 0.85 | 1.54E−02 | 18 | 92 | LYM633 | 0.90 | 5.98E−03 | 18 | 90 |
| LYM633 | 0.89 | 7.48E−03 | 18 | 91 | LYM633 | 0.88 | 8.21E−03 | 18 | 76 |
| LYM633 | 0.81 | 2.66E−02 | 18 | 77 | LYM633 | 0.91 | 4.19E−03 | 18 | 89 |
| LYM633 | 0.76 | 4.85E−02 | 18 | 86 | LYM633 | 0.86 | 1.31E−02 | 18 | 93 |
| LYM633 | 0.73 | 6.07E−02 | 18 | 85 | LYM633 | 0.77 | 1.48E−02 | 20 | 82 |
| LYM633 | 0.70 | 3.43E−02 | 20 | 92 | LYM633 | 0.76 | 1.83E−02 | 20 | 77 |
| LYM633 | 0.83 | 3.86E−02 | 22 | 93 | LYM634 | 0.74 | 9.59E−02 | 8 | 73 |
| LYM634 | 0.75 | 8.50E−02 | 15 | 81 | LYM634 | 0.91 | 1.99E−03 | 17 | 81 |
| LYM634 | 0.78 | 2.15E−02 | 17 | 82 | LYM634 | 0.85 | 7.46E−03 | 17 | 75 |
| LYM634 | 0.76 | 2.72E−02 | 17 | 92 | LYM634 | 0.76 | 2.94E−02 | 17 | 76 |
| LYM634 | 0.92 | 1.37E−03 | 17 | 83 | LYM634 | 0.79 | 2.08E−02 | 17 | 77 |
| LYM634 | 0.81 | 1.58E−02 | 17 | 89 | LYM634 | 0.85 | 7.81E−03 | 17 | 86 |
| LYM634 | 0.73 | 3.96E−02 | 17 | 84 | LYM634 | 0.76 | 7.66E−02 | 18 | 81 |
| LYM634 | 0.79 | 6.08E−02 | 22 | 82 | LYM634 | 0.77 | 7.60E−02 | 22 | 92 |
| LYM634 | 0.84 | 3.67E−02 | 22 | 76 | LYM634 | 0.87 | 2.27E−02 | 22 | 77 |
| LYM634 | 0.73 | 1.03E−01 | 22 | 89 | LYM634 | 0.81 | 5.00E−02 | 22 | 86 |
| LYM634 | 0.74 | 9.41E−02 | 22 | 84 | LYM635 | 0.85 | 7.26E−03 | 3 | 90 |
| LYM635 | 0.73 | 3.89E−02 | 3 | 76 | LYM635 | 0.79 | 1.88E−02 | 3 | 77 |
| LYM635 | 0.87 | 2.39E−02 | 12 | 73 | LYM635 | 0.81 | 5.31E−02 | 14 | 81 |
| LYM635 | 0.72 | 6.84E−02 | 14 | 82 | LYM635 | 0.80 | 2.99E−02 | 14 | 83 |
| LYM635 | 0.78 | 4.04E−02 | 14 | 77 | LYM635 | 0.83 | 2.13E−02 | 14 | 86 |
| LYM635 | 0.91 | 1.06E−02 | 16 | 73 | LYM635 | 0.73 | 4.07E−02 | 17 | 81 |
| LYM635 | 0.71 | 4.67E−02 | 17 | 75 | LYM635 | 0.80 | 1.69E−02 | 17 | 83 |
| LYM635 | 0.74 | 8.97E−02 | 18 | 81 | LYM635 | 0.76 | 4.81E−02 | 18 | 83 |
| LYM635 | 0.74 | 2.22E−02 | 20 | 82 | LYM635 | 0.73 | 2.45E−02 | 20 | 75 |
| LYM635 | 0.71 | 3.28E−02 | 20 | 92 | LYM635 | 0.76 | 1.86E−02 | 20 | 76 |
| LYM635 | 0.72 | 2.96E−02 | 20 | 77 | LYM635 | 0.71 | 3.08E−02 | 20 | 89 |
| LYM635 | 0.71 | 3.07E−02 | 20 | 86 | LYM635 | 0.78 | 6.92E−02 | 22 | 93 |
| LYM638 | 0.76 | 2.80E−02 | 3 | 80 | LYM638 | 0.79 | 2.08E−02 | 4 | 74 |
| LYM638 | 0.91 | 4.56E−03 | 14 | 88 | LYM638 | 0.86 | 1.37E−02 | 14 | 87 |
| LYM638 | 0.92 | 3.09E−03 | 14 | 82 | LYM638 | 0.79 | 3.58E−02 | 14 | 75 |
| LYM638 | 0.86 | 1.36E−02 | 14 | 92 | LYM638 | 0.93 | 2.13E−03 | 14 | 79 |
| LYM638 | 0.75 | 5.14E−02 | 14 | 91 | LYM638 | 0.73 | 6.29E−02 | 14 | 76 |
| LYM638 | 0.76 | 4.56E−02 | 14 | 77 | LYM638 | 0.85 | 1.55E−02 | 14 | 89 |
| LYM638 | 0.91 | 4.53E−03 | 14 | 86 | LYM638 | 0.95 | 1.29E−03 | 14 | 84 |
| LYM638 | 0.88 | 9.65E−03 | 14 | 85 | LYM638 | 0.86 | 2.68E−02 | 15 | 81 |
| LYM638 | 0.78 | 3.70E−02 | 15 | 82 | LYM638 | 0.73 | 6.32E−02 | 15 | 92 |
| LYM638 | 0.75 | 5.43E−02 | 15 | 83 | LYM638 | 0.83 | 1.02E−02 | 17 | 81 |
| LYM638 | 0.91 | 1.96E−03 | 17 | 82 | LYM638 | 0.73 | 4.05E−02 | 17 | 77 |
| LYM638 | 0.91 | 1.06E−02 | 22 | 93 | LYM639 | 0.70 | 5.19E−02 | 4 | 74 |
| LYM639 | 0.77 | 4.15E−02 | 15 | 82 | LYM639 | 0.80 | 3.24E−02 | 15 | 78 |
| LYM639 | 0.86 | 1.41E−02 | 15 | 92 | LYM639 | 0.73 | 6.50E−02 | 15 | 90 |
| LYM639 | 0.81 | 2.56E−02 | 15 | 91 | LYM639 | 0.81 | 2.77E−02 | 15 | 89 |
| LYM639 | 0.71 | 7.41E−02 | 15 | 93 | LYM639 | 0.80 | 1.63E−02 | 17 | 81 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM639 | 0.71 | 4.69E-02 | 17 | 75 | LYM639 | 0.71 | 4.80E-02 | 17 | 83 |
| LYM639 | 0.86 | 1.36E-02 | 18 | 82 | LYM639 | 0.81 | 2.82E-02 | 18 | 77 |
| LYM639 | 0.72 | 6.65E-02 | 18 | 89 | LYM639 | 0.85 | 1.50E-02 | 18 | 86 |
| LYM639 | 0.76 | 4.91E-02 | 18 | 84 | LYM640 | 0.70 | 5.19E-02 | 3 | 93 |
| LYM640 | 0.83 | 9.98E-03 | 4 | 74 | LYM640 | 0.71 | 1.12E-01 | 8 | 73 |
| LYM640 | 0.94 | 1.73E-03 | 14 | 82 | LYM640 | 0.71 | 7.27E-02 | 14 | 86 |
| LYM640 | 0.73 | 6.47E-02 | 14 | 84 | LYM640 | 0.74 | 3.77E-02 | 17 | 82 |
| LYM640 | 0.73 | 3.85E-02 | 17 | 75 | LYM640 | 0.80 | 1.78E-02 | 17 | 92 |
| LYM640 | 0.80 | 1.76E-02 | 17 | 83 | LYM640 | 0.74 | 3.40E-02 | 17 | 89 |
| LYM640 | 0.71 | 1.12E-01 | 18 | 81 | LYM640 | 0.71 | 3.28E-02 | 20 | 78 |
| LYM640 | 0.73 | 9.83E-02 | 22 | 91 | LYM640 | 0.78 | 6.68E-02 | 22 | 83 |
| LYM640 | 0.72 | 1.05E-01 | 22 | 89 | LYM640 | 0.77 | 7.37E-02 | 22 | 85 |
| LYM642 | 0.76 | 4.63E-02 | 14 | 88 | LYM642 | 0.82 | 2.38E-02 | 14 | 87 |
| LYM642 | 0.80 | 3.00E-02 | 14 | 92 | LYM642 | 0.72 | 6.67E-02 | 14 | 90 |
| LYM642 | 0.87 | 1.14E-02 | 14 | 91 | LYM642 | 0.75 | 5.46E-02 | 14 | 76 |
| LYM642 | 0.78 | 3.86E-02 | 14 | 77 | LYM642 | 0.78 | 3.72E-02 | 14 | 89 |
| LYM642 | 0.88 | 9.10E-03 | 14 | 93 | LYM642 | 0.83 | 2.11E-02 | 14 | 85 |
| LYM642 | 0.71 | 7.23E-02 | 15 | 93 | LYM642 | 0.77 | 2.59E-02 | 17 | 81 |
| LYM642 | 0.73 | 4.07E-02 | 17 | 75 | LYM642 | 0.71 | 7.30E-02 | 18 | 88 |
| LYM642 | 0.81 | 2.80E-02 | 18 | 87 | LYM642 | 0.78 | 3.78E-02 | 18 | 78 |
| LYM642 | 0.84 | 1.87E-02 | 18 | 92 | LYM642 | 0.83 | 2.01E-02 | 18 | 90 |
| LYM642 | 0.90 | 5.17E-03 | 18 | 91 | LYM642 | 0.86 | 1.41E-02 | 18 | 76 |
| LYM642 | 0.92 | 3.16E-03 | 18 | 77 | LYM642 | 0.89 | 7.20E-03 | 18 | 89 |
| LYM642 | 0.74 | 5.86E-02 | 18 | 86 | LYM642 | 0.94 | 1.42E-03 | 18 | 93 |
| LYM642 | 0.76 | 4.88E-02 | 18 | 85 | LYM643 | 0.78 | 2.35E-02 | 9 | 73 |
| LYM643 | 0.89 | 1.83E-02 | 12 | 73 | LYM643 | 0.77 | 4.39E-02 | 18 | 80 |
| LYM644 | 0.78 | 2.34E-02 | 3 | 90 | LYM644 | 0.75 | 1.33E-02 | 7 | 80 |
| LYM644 | 0.77 | 4.16E-02 | 14 | 78 | LYM644 | 0.78 | 3.70E-02 | 14 | 90 |
| LYM644 | 0.73 | 6.17E-02 | 14 | 76 | LYM644 | 0.70 | 7.71E-02 | 14 | 93 |
| LYM644 | 0.85 | 7.19E-03 | 17 | 78 | LYM644 | 0.82 | 4.74E-02 | 18 | 81 |
| LYM644 | 0.80 | 3.17E-02 | 18 | 83 | LYM644 | 0.76 | 1.76E-02 | 20 | 80 |
| LYM644 | 0.84 | 3.58E-02 | 22 | 90 | LYM644 | 0.92 | 9.27E-03 | 22 | 80 |
| LYM644 | 0.95 | 3.66E-03 | 22 | 93 | LYM644 | 0.86 | 5.98E-03 | 24 | 73 |
| LYM644 | 0.94 | 4.22E-04 | 24 | 74 | LYM645 | 0.76 | 1.16E-02 | 7 | 93 |
| LYM645 | 0.71 | 7.33E-02 | 14 | 87 | LYM645 | 0.79 | 3.56E-02 | 14 | 82 |
| LYM645 | 0.82 | 2.52E-02 | 14 | 92 | LYM645 | 0.81 | 2.79E-02 | 14 | 91 |
| LYM645 | 0.79 | 3.31E-02 | 14 | 77 | LYM645 | 0.81 | 2.60E-02 | 14 | 89 |
| LYM645 | 0.75 | 5.35E-02 | 14 | 93 | LYM645 | 0.71 | 7.60E-02 | 14 | 85 |
| LYM645 | 0.71 | 4.85E-02 | 17 | 81 | LYM645 | 0.78 | 3.74E-02 | 18 | 93 |
| LYM645 | 0.91 | 1.29E-02 | 22 | 93 | LYM646 | 0.80 | 9.62E-03 | 6 | 74 |
| LYM646 | 0.85 | 3.08E-02 | 16 | 74 | LYM646 | 0.91 | 1.73E-03 | 17 | 81 |
| LYM646 | 0.82 | 1.34E-02 | 17 | 75 | LYM646 | 0.72 | 4.50E-02 | 17 | 91 |
| LYM646 | 0.90 | 2.04E-03 | 17 | 83 | LYM646 | 0.79 | 1.91E-02 | 17 | 89 |
| LYM646 | 0.74 | 3.56E-02 | 17 | 86 | LYM646 | 0.79 | 3.52E-02 | 18 | 87 |
| LYM646 | 0.86 | 1.38E-02 | 18 | 82 | LYM646 | 0.85 | 1.47E-02 | 18 | 78 |
| LYM646 | 0.80 | 3.25E-02 | 18 | 75 | LYM646 | 0.89 | 7.46E-03 | 18 | 92 |
| LYM646 | 0.83 | 1.97E-02 | 18 | 90 | LYM646 | 0.91 | 4.48E-03 | 18 | 91 |
| LYM646 | 0.76 | 4.66E-02 | 18 | 76 | LYM646 | 0.77 | 4.17E-02 | 18 | 77 |
| LYM646 | 0.91 | 4.63E-03 | 18 | 89 | LYM646 | 0.86 | 1.31E-02 | 18 | 93 |
| LYM646 | 0.75 | 5.38E-02 | 18 | 85 | LYM646 | 0.76 | 7.64E-02 | 22 | 78 |
| LYM647 | 0.79 | 2.04E-02 | 3 | 80 | LYM647 | 0.78 | 4.04E-02 | 14 | 88 |
| LYM647 | 0.79 | 3.41E-02 | 14 | 87 | LYM647 | 0.72 | 6.94E-02 | 14 | 79 |
| LYM647 | 0.93 | 2.67E-03 | 14 | 76 | LYM647 | 0.85 | 1.65E-02 | 14 | 77 |
| LYM647 | 0.75 | 5.05E-02 | 14 | 89 | LYM647 | 0.85 | 1.42E-02 | 14 | 86 |
| LYM647 | 0.75 | 5.02E-02 | 14 | 84 | LYM647 | 0.72 | 6.74E-02 | 14 | 85 |
| LYM647 | 0.72 | 6.86E-02 | 15 | 80 | LYM647 | 0.78 | 3.79E-02 | 18 | 76 |
| LYM647 | 0.85 | 3.24E-02 | 22 | 83 | LYM648 | 0.78 | 6.78E-02 | 8 | 73 |
| LYM648 | 0.89 | 1.84E-02 | 16 | 74 | LYM648 | 0.89 | 2.89E-03 | 17 | 93 |
| LYM648 | 0.71 | 4.72E-02 | 20 | 81 | LYM649 | 0.86 | 1.26E-02 | 14 | 82 |
| LYM649 | 0.72 | 6.56E-02 | 14 | 83 | LYM650 | 0.76 | 4.88E-02 | 14 | 78 |
| LYM650 | 0.73 | 3.91E-02 | 17 | 75 | LYM650 | 0.76 | 2.97E-02 | 17 | 91 |
| LYM650 | 0.86 | 2.62E-03 | 20 | 78 | LYM652 | 0.87 | 2.35E-02 | 14 | 81 |
| LYM652 | 0.76 | 4.59E-02 | 14 | 83 | LYM652 | 0.73 | 9.71E-02 | 15 | 81 |
| LYM652 | 0.73 | 6.44E-02 | 18 | 77 | LYM652 | 0.76 | 4.87E-02 | 14 | 77 |
| LYM653 | 0.91 | 1.95E-03 | 17 | 81 | LYM653 | 0.81 | 1.42E-02 | 17 | 75 |
| LYM653 | 0.91 | 1.69E-03 | 17 | 83 | LYM653 | 0.77 | 2.55E-02 | 17 | 89 |
| LYM653 | 0.72 | 4.40E-02 | 17 | 86 | LYM653 | 0.82 | 4.66E-02 | 18 | 81 |
| LYM653 | 0.75 | 5.04E-02 | 18 | 83 | LYM653 | 0.75 | 1.90E-02 | 20 | 83 |
| LYM653 | 0.83 | 4.09E-02 | 22 | 93 | LYM654 | 0.77 | 8.59E-03 | 7 | 78 |
| LYM654 | 0.82 | 3.31E-03 | 7 | 90 | LYM654 | 0.72 | 6.79E-02 | 15 | 90 |
| LYM654 | 0.87 | 5.35E-03 | 17 | 81 | LYM654 | 0.81 | 1.39E-02 | 17 | 75 |
| LYM654 | 0.73 | 3.79E-02 | 17 | 91 | LYM654 | 0.73 | 4.05E-02 | 17 | 76 |
| LYM654 | 0.81 | 1.57E-02 | 17 | 83 | LYM654 | 0.75 | 3.30E-02 | 17 | 89 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM654 | 0.70 | 7.85E−02 | 18 | 90 | LYM654 | 0.72 | 2.84E−02 | 20 | 92 |
| LYM654 | 0.73 | 2.42E−02 | 20 | 79 | LYM654 | 0.72 | 2.90E−02 | 20 | 76 |
| LYM654 | 0.71 | 1.12E−01 | 22 | 78 | LYM655 | 0.79 | 3.31E−02 | 14 | 76 |
| LYM655 | 0.91 | 4.42E−03 | 14 | 77 | LYM655 | 0.74 | 5.87E−02 | 14 | 89 |
| LYM655 | 0.71 | 7.35E−02 | 14 | 86 | LYM655 | 0.72 | 1.09E−01 | 18 | 81 |
| LYM655 | 0.86 | 1.30E−02 | 18 | 82 | LYM655 | 0.72 | 6.60E−02 | 18 | 83 |
| LYM655 | 0.77 | 4.30E−02 | 18 | 77 | LYM655 | 0.74 | 5.71E−02 | 18 | 89 |
| LYM655 | 0.76 | 4.56E−02 | 18 | 86 | LYM655 | 0.72 | 4.41E−02 | 20 | 81 |
| LYM655 | 0.80 | 8.88E−03 | 20 | 82 | LYM655 | 0.73 | 2.54E−02 | 20 | 77 |
| LYM655 | 0.74 | 2.40E−02 | 20 | 86 | LYM656 | 0.94 | 4.83E−04 | 3 | 88 |
| LYM656 | 0.86 | 5.64E−03 | 3 | 87 | LYM656 | 0.73 | 3.78E−02 | 3 | 92 |
| LYM656 | 0.92 | 1.11E−03 | 3 | 79 | LYM656 | 0.76 | 2.97E−02 | 3 | 86 |
| LYM656 | 0.90 | 2.33E−03 | 3 | 84 | LYM656 | 0.92 | 1.25E−03 | 3 | 85 |
| LYM656 | 0.71 | 4.89E−02 | 9 | 74 | LYM656 | 0.83 | 4.07E−02 | 22 | 93 |
| LYM657 | 0.79 | 6.26E−02 | 8 | 73 | LYM658 | 0.73 | 6.43E−02 | 14 | 90 |
| LYM658 | 0.71 | 7.23E−02 | 14 | 76 | LYM658 | 0.79 | 3.32E−02 | 14 | 93 |
| LYM658 | 0.72 | 4.37E−02 | 17 | 93 | LYM658 | 0.75 | 5.25E−02 | 18 | 78 |
| LYM658 | 0.83 | 2.01E−02 | 18 | 90 | LYM658 | 0.70 | 7.79E−02 | 18 | 91 |
| LYM658 | 0.79 | 3.57E−02 | 18 | 93 | LYM658 | 0.77 | 1.57E−02 | 20 | 78 |
| LYM658 | 0.79 | 1.17E−02 | 20 | 75 | LYM658 | 0.83 | 6.03E−03 | 20 | 92 |
| LYM658 | 0.73 | 2.58E−02 | 20 | 90 | LYM658 | 0.83 | 5.94E−03 | 20 | 91 |
| LYM658 | 0.78 | 1.35E−02 | 20 | 89 | LYM658 | 0.76 | 1.79E−02 | 20 | 93 |
| LYM658 | 0.74 | 2.26E−02 | 20 | 85 | LYM659 | 0.76 | 2.80E−02 | 4 | 74 |
| LYM659 | 0.77 | 9.82E−03 | 7 | 88 | LYM659 | 0.70 | 2.37E−02 | 7 | 92 |
| LYM659 | 0.71 | 2.20E−02 | 7 | 89 | LYM659 | 0.74 | 1.53E−02 | 7 | 86 |
| LYM659 | 0.78 | 7.40E−02 | 7 | 84 | LYM659 | 0.73 | 1.61E−02 | 7 | 85 |
| LYM659 | 0.73 | 1.02E−01 | 16 | 73 | LYM659 | 0.72 | 2.78E−02 | 20 | 92 |
| LYM659 | 0.74 | 2.22E−02 | 20 | 91 | LYM659 | 0.89 | 1.60E−02 | 22 | 78 |
| LYM659 | 0.80 | 5.60E−02 | 22 | 90 | LYM659 | 0.72 | 1.08E−01 | 22 | 80 |
| LYM660 | 0.86 | 6.57E−03 | 17 | 81 | LYM660 | 0.77 | 2.64E−02 | 17 | 75 |
| LYM660 | 0.80 | 1.74E−02 | 17 | 83 | LYM660 | 0.72 | 4.53E−02 | 17 | 89 |
| LYM660 | 0.76 | 8.15E−02 | 22 | 78 | LYM661 | 0.90 | 2.19E−03 | 17 | 81 |
| LYM661 | 0.81 | 1.41E−02 | 17 | 82 | LYM661 | 0.94 | 5.79E−04 | 17 | 75 |
| LYM661 | 0.87 | 4.57E−03 | 17 | 92 | LYM661 | 0.86 | 6.19E−03 | 17 | 91 |
| LYM661 | 0.74 | 3.66E−02 | 17 | 76 | LYM661 | 0.87 | 4.60E−03 | 17 | 83 |
| LYM661 | 0.73 | 4.09E−02 | 17 | 77 | LYM661 | 0.92 | 1.00E−03 | 17 | 89 |
| LYM661 | 0.82 | 1.19E−02 | 17 | 86 | LYM661 | 0.79 | 1.89E−02 | 17 | 84 |
| LYM661 | 0.75 | 5.42E−02 | 18 | 87 | LYM661 | 0.84 | 1.72E−02 | 18 | 82 |
| LYM661 | 0.82 | 2.44E−02 | 18 | 78 | LYM661 | 0.73 | 6.12E−02 | 18 | 75 |
| LYM661 | 0.89 | 7.91E−03 | 18 | 92 | LYM661 | 0.79 | 3.28E−02 | 18 | 90 |
| LYM661 | 0.85 | 1.51E−02 | 18 | 91 | LYM661 | 0.86 | 1.25E−02 | 18 | 89 |
| LYM661 | 0.75 | 5.04E−02 | 18 | 93 | LYM661 | 0.74 | 5.88E−02 | 18 | 85 |
| LYM662 | 0.77 | 7.16E−02 | 14 | 81 | LYM662 | 0.72 | 6.81E−02 | 14 | 83 |
| LYM662 | 0.87 | 2.26E−02 | 22 | 90 | LYM662 | 0.72 | 1.04E−01 | 22 | 91 |
| LYM662 | 0.79 | 5.88E−02 | 22 | 80 | LYM663 | 0.72 | 4.38E−02 | 9 | 74 |
| LYM663 | 0.85 | 1.48E−02 | 14 | 88 | LYM663 | 0.95 | 1.19E−03 | 14 | 87 |
| LYM663 | 0.88 | 9.88E−03 | 14 | 78 | LYM663 | 0.82 | 2.25E−02 | 14 | 75 |
| LYM663 | 0.90 | 6.22E−03 | 14 | 92 | LYM663 | 0.76 | 4.74E−02 | 14 | 79 |
| LYM663 | 0.94 | 1.56E−03 | 14 | 90 | LYM663 | 0.96 | 6.69E−04 | 14 | 91 |
| LYM663 | 0.98 | 6.53E−05 | 14 | 76 | LYM663 | 0.92 | 3.48E−03 | 14 | 77 |
| LYM663 | 0.95 | 1.19E−03 | 14 | 89 | LYM663 | 0.82 | 2.49E−02 | 14 | 86 |
| LYM663 | 0.96 | 7.18E−04 | 14 | 93 | LYM663 | 0.79 | 3.65E−02 | 14 | 84 |
| LYM663 | 0.89 | 7.10E−03 | 14 | 85 | LYM663 | 0.71 | 4.74E−02 | 17 | 81 |
| LYM663 | 0.78 | 6.54E−02 | 22 | 78 | LYM665 | 0.73 | 9.65E−02 | 1 | 73 |
| LYM665 | 0.86 | 2.93E−02 | 8 | 73 | LYM665 | 0.84 | 8.36E−03 | 17 | 81 |
| LYM665 | 0.87 | 5.09E−03 | 17 | 83 | LYM665 | 0.72 | 7.02E−02 | 18 | 82 |
| LYM665 | 0.75 | 8.53E−02 | 22 | 82 | LYM665 | 0.73 | 1.00E−01 | 22 | 77 |
| LYM667 | 0.85 | 7.89E−03 | 17 | 81 | LYM667 | 0.84 | 9.53E−03 | 17 | 75 |
| LYM667 | 0.76 | 2.88E−02 | 17 | 91 | LYM667 | 0.78 | 2.29E−02 | 17 | 83 |
| LYM667 | 0.73 | 3.81E−02 | 17 | 89 | LYM667 | 0.85 | 1.64E−02 | 18 | 78 |
| LYM667 | 0.77 | 4.30E−02 | 18 | 92 | LYM667 | 0.86 | 1.27E−02 | 18 | 90 |
| LYM667 | 0.83 | 2.19E−02 | 18 | 91 | LYM667 | 0.71 | 7.45E−02 | 18 | 76 |
| LYM667 | 0.77 | 4.18E−02 | 18 | 77 | LYM667 | 0.82 | 2.51E−02 | 18 | 89 |
| LYM667 | 0.89 | 7.16E−03 | 18 | 93 | LYM667 | 0.75 | 5.29E−02 | 18 | 77 |
| LYM669 | 0.70 | 7.92E−02 | 18 | 93 | LYM669 | 0.73 | 4.04E−02 | 24 | 74 |
| LYM670 | 0.73 | 9.64E−02 | 1 | 73 | LYM670 | 0.78 | 2.28E−02 | 3 | 90 |
| LYM670 | 0.91 | 1.14E−02 | 8 | 73 | LYM670 | 0.84 | 3.47E−02 | 12 | 73 |
| LYM670 | 0.79 | 3.45E−02 | 14 | 83 | LYM670 | 0.84 | 5.02E−03 | 20 | 82 |
| LYM670 | 0.71 | 3.20E−02 | 20 | 92 | LYM670 | 0.72 | 1.04E−01 | 22 | 90 |
| LYM671 | 0.73 | 9.60E−02 | 1 | 73 | LYM671 | 0.80 | 3.11E−02 | 14 | 76 |
| LYM671 | 0.91 | 4.47E−03 | 14 | 77 | LYM671 | 0.71 | 7.21E−02 | 14 | 86 |
| LYM671 | 0.73 | 1.02E−01 | 16 | 73 | LYM671 | 0.81 | 5.14E−02 | 22 | 93 |
| LYM672 | 0.97 | 1.01E−03 | 1 | 74 | LYM672 | 0.75 | 3.28E−02 | 4 | 74 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM672 | 0.77 | 7.63E−02 | 22 | 93 | LYM673 | 0.85 | 3.30E−02 | 1 | 74 |
| LYM673 | 0.92 | 3.63E−03 | 14 | 88 | LYM673 | 0.81 | 2.63E−02 | 14 | 87 |
| LYM673 | 0.73 | 6.37E−02 | 14 | 82 | LYM673 | 0.72 | 6.74E−02 | 14 | 92 |
| LYM673 | 0.86 | 1.25E−02 | 14 | 79 | LYM673 | 0.75 | 5.24E−02 | 14 | 76 |
| LYM673 | 0.83 | 1.99E−02 | 14 | 77 | LYM673 | 0.74 | 5.93E−02 | 14 | 89 |
| LYM673 | 0.87 | 1.01E−02 | 14 | 86 | LYM673 | 0.89 | 7.41E−03 | 14 | 84 |
| LYM673 | 0.83 | 2.03E−02 | 14 | 85 | LYM673 | 0.93 | 2.81E−03 | 18 | 88 |
| LYM673 | 0.90 | 5.29E−03 | 18 | 87 | LYM673 | 0.83 | 2.21E−02 | 18 | 92 |
| LYM673 | 0.86 | 1.19E−02 | 18 | 79 | LYM673 | 0.76 | 4.83E−02 | 18 | 90 |
| LYM673 | 0.80 | 3.08E−02 | 18 | 91 | LYM673 | 0.78 | 3.73E−02 | 18 | 80 |
| LYM673 | 0.79 | 3.28E−02 | 18 | 76 | LYM673 | 0.79 | 3.49E−02 | 18 | 77 |
| LYM673 | 0.82 | 2.44E−02 | 18 | 89 | LYM673 | 0.76 | 4.79E−02 | 18 | 86 |
| LYM673 | 0.70 | 7.81E−02 | 18 | 93 | LYM673 | 0.83 | 2.20E−02 | 18 | 84 |
| LYM673 | 0.91 | 4.54E−03 | 18 | 85 | LYM673 | 0.79 | 6.79E−02 | 7 | 87 |
| LYM674 | 0.74 | 1.46E−02 | 7 | 90 | LYM674 | 0.72 | 1.81E−02 | 7 | 91 |
| LYM674 | 0.76 | 1.14E−02 | 7 | 76 | LYM674 | 0.78 | 7.37E−03 | 7 | 77 |
| LYM674 | 0.76 | 1.11E−02 | 7 | 89 | LYM674 | 0.79 | 6.82E−03 | 7 | 93 |
| LYM674 | 0.76 | 4.80E−02 | 14 | 83 | LYM674 | 0.73 | 3.94E−02 | 17 | 90 |
| LYM674 | 0.82 | 4.37E−02 | 22 | 90 | LYM674 | 0.76 | 8.23E−02 | 22 | 80 |
| LYM674 | 0.80 | 1.74E−02 | 24 | 74 | LYM675 | 0.80 | 1.63E−02 | 17 | 80 |
| LYM677 | 0.91 | 1.76E−03 | 3 | 78 | LYM677 | 0.70 | 7.74E−02 | 14 | 83 |
| LYM677 | 0.88 | 4.22E−03 | 17 | 81 | LYM677 | 0.81 | 1.44E−02 | 17 | 82 |
| LYM677 | 0.94 | 4.35E−04 | 17 | 75 | LYM677 | 0.92 | 1.03E−03 | 17 | 92 |
| LYM677 | 0.74 | 3.41E−02 | 17 | 79 | LYM677 | 0.88 | 4.14E−03 | 17 | 91 |
| LYM677 | 0.85 | 7.64E−03 | 17 | 76 | LYM677 | 0.92 | 1.24E−03 | 17 | 83 |
| LYM677 | 0.82 | 1.31E−02 | 17 | 77 | LYM677 | 0.95 | 3.32E−04 | 17 | 89 |
| LYM677 | 0.82 | 1.37E−02 | 17 | 86 | LYM677 | 0.83 | 1.09E−02 | 17 | 84 |
| LYM677 | 0.80 | 9.48E−03 | 20 | 78 | LYM677 | 0.71 | 1.11E−01 | 22 | 78 |
| LYM678 | 0.91 | 1.10E−02 | 1 | 73 | LYM678 | 0.89 | 2.81E−03 | 17 | 81 |
| LYM678 | 0.87 | 4.45E−03 | 17 | 75 | LYM678 | 0.78 | 2.17E−02 | 17 | 92 |
| LYM678 | 0.83 | 1.04E−02 | 17 | 91 | LYM678 | 0.74 | 3.61E−02 | 17 | 76 |
| LYM678 | 0.87 | 5.45E−03 | 17 | 83 | LYM678 | 0.74 | 3.45E−02 | 17 | 77 |
| LYM678 | 0.87 | 5.14E−03 | 17 | 89 | LYM678 | 0.83 | 1.11E−02 | 17 | 86 |
| LYM678 | 0.78 | 2.20E−02 | 17 | 84 | LYM678 | 0.73 | 6.51E−02 | 18 | 93 |
| LYM679 | 0.80 | 5.34E−02 | 1 | 74 | LYM679 | 0.73 | 1.02E−01 | 14 | 81 |
| LYM679 | 0.92 | 2.93E−03 | 14 | 88 | LYM679 | 0.92 | 3.63E−03 | 14 | 87 |
| LYM679 | 0.77 | 4.42E−02 | 14 | 82 | LYM679 | 0.80 | 3.22E−02 | 14 | 75 |
| LYM679 | 0.85 | 1.56E−02 | 14 | 92 | LYM679 | 0.86 | 1.26E−02 | 14 | 79 |
| LYM679 | 0.70 | 7.99E−02 | 14 | 90 | LYM679 | 0.84 | 1.70E−02 | 14 | 91 |
| LYM679 | 0.94 | 1.33E−03 | 14 | 76 | LYM679 | 0.96 | 6.68E−04 | 14 | 77 |
| LYM679 | 0.90 | 5.61E−03 | 14 | 89 | LYM679 | 0.97 | 2.29E−04 | 14 | 86 |
| LYM679 | 0.74 | 5.95E−02 | 14 | 93 | LYM679 | 0.93 | 2.78E−03 | 14 | 84 |
| LYM679 | 0.89 | 7.00E−03 | 14 | 85 | LYM679 | 0.97 | 5.30E−05 | 17 | 75 |
| LYM679 | 0.88 | 4.37E−03 | 17 | 92 | LYM679 | 0.96 | 1.78E−04 | 17 | 91 |
| LYM679 | 0.78 | 2.35E−02 | 17 | 83 | LYM679 | 0.88 | 4.30E−03 | 17 | 89 |
| LYM679 | 0.71 | 4.92E−02 | 17 | 86 | LYM679 | 0.73 | 4.01E−02 | 17 | 84 |
| LYM679 | 0.78 | 4.00E−02 | 18 | 82 | LYM679 | 0.75 | 5.04E−02 | 18 | 86 |
| LYM679 | 0.78 | 3.92E−02 | 18 | 84 | LYM679 | 0.71 | 1.15E−01 | 22 | 78 |
| LYM680 | 0.88 | 1.98E−02 | 1 | 74 | LYM680 | 0.91 | 1.45E−03 | 3 | 88 |
| LYM680 | 0.79 | 1.97E−02 | 3 | 87 | LYM680 | 0.86 | 5.77E−03 | 3 | 79 |
| LYM680 | 0.91 | 1.50E−03 | 3 | 80 | LYM680 | 0.76 | 2.85E−02 | 3 | 84 |
| LYM680 | 0.94 | 5.03E−04 | 3 | 85 | LYM680 | 0.80 | 9.92E−03 | 6 | 74 |
| LYM680 | 0.89 | 1.72E−02 | 8 | 74 | LYM680 | 0.88 | 9.19E−03 | 15 | 88 |
| LYM680 | 0.79 | 3.41E−02 | 15 | 87 | LYM680 | 0.77 | 4.16E−02 | 15 | 75 |
| LYM680 | 0.72 | 7.07E−02 | 15 | 92 | LYM680 | 0.96 | 4.71E−04 | 15 | 79 |
| LYM680 | 0.86 | 1.30E−02 | 15 | 80 | LYM680 | 0.82 | 2.35E−02 | 15 | 86 |
| LYM680 | 0.91 | 4.80E−03 | 15 | 84 | LYM680 | 0.84 | 1.89E−02 | 15 | 85 |
| LYM680 | 0.91 | 1.09E−02 | 16 | 74 | LYM680 | 0.87 | 1.18E−02 | 18 | 88 |
| LYM680 | 0.96 | 6.68E−04 | 18 | 87 | LYM680 | 0.95 | 1.09E−03 | 18 | 78 |
| LYM680 | 0.83 | 2.15E−02 | 18 | 75 | LYM680 | 0.97 | 4.09E−04 | 18 | 92 |
| LYM680 | 0.80 | 3.08E−02 | 18 | 79 | LYM680 | 0.98 | 1.20E−04 | 18 | 90 |
| LYM680 | 0.98 | 6.50E−05 | 18 | 91 | LYM680 | 0.88 | 9.77E−03 | 18 | 76 |
| LYM680 | 0.83 | 2.16E−02 | 18 | 77 | LYM680 | 0.96 | 7.87E−04 | 18 | 89 |
| LYM680 | 0.72 | 6.64E−02 | 18 | 86 | LYM680 | 0.97 | 2.72E−04 | 18 | 93 |
| LYM680 | 0.78 | 3.81E−02 | 18 | 84 | LYM680 | 0.94 | 1.58E−03 | 18 | 85 |
| LYM682 | 0.88 | 2.21E−02 | 1 | 74 | LYM682 | 0.83 | 4.15E−02 | 8 | 74 |
| LYM682 | 0.70 | 7.70E−02 | 14 | 75 | LYM682 | 0.73 | 6.13E−02 | 15 | 75 |
| LYM682 | 0.76 | 2.72E−02 | 17 | 81 | LYM682 | 0.81 | 4.93E−02 | 22 | 90 |
| LYM682 | 0.89 | 1.63E−02 | 22 | 80 | LYM744 | 0.72 | 4.57E−02 | 3 | 78 |
| LYM744 | 0.70 | 2.40E−02 | 7 | 78 | LYM744 | 0.89 | 1.64E−02 | 14 | 81 |
| LYM744 | 0.82 | 2.39E−02 | 14 | 75 | LYM744 | 0.89 | 1.72E−02 | 18 | 81 |
| LYM744 | 0.70 | 7.93E−02 | 18 | 78 | LYM744 | 0.80 | 3.02E−02 | 18 | 75 |
| LYM744 | 0.70 | 1.21E−01 | 22 | 78 | LYM744 | 0.81 | 5.01E−02 | 22 | 79 |

TABLE 29-continued

Correlation between the expression level of selected genes of some embodiments of the invention in various tissues and the phenotypic performance under normal conditions across maize varieties

| Gene Name | R | P value | Exp. set | Corr. ID | Gene Name | R | P value | Exp. set | Corr. ID |
|---|---|---|---|---|---|---|---|---|---|
| LYM744 | 0.75 | 8.85E-02 | 22 | 80 | LYM744 | 0.76 | 7.77E-02 | 22 | 85 |
| LYM745 | 0.76 | 7.74E-02 | 12 | 73 | LYM745 | 0.80 | 3.15E-02 | 14 | 83 |
| LYM745 | 0.93 | 8.10E-03 | 16 | 73 | LYM745 | 0.72 | 2.83E-02 | 20 | 78 |
| LYM750 | 0.75 | 3.22E-02 | 3 | 90 | LYM750 | 0.71 | 4.80E-02 | 17 | 82 |
| LYM750 | 0.72 | 4.33E-02 | 17 | 83 | | | | | |
| LYM531_H6 | 0.84 | 0.04 | 22 | 82 | LYM531_H6 | 0.76 | 0.08 | 22 | 77 |
| LYM531_H6 | 0.78 | 0.04 | 24 | 78 | LYM531_H6 | 0.85 | 0.03 | 22 | 76 |
| LYM531_H6 | 0.77 | 0.02 | 24 | 73 | | | | | |

Table 29. Provided are the correlations (R) between the expression levels yield improving genes and their homologues in various tissues [Expression (Exp) sets, Table 25] and the phenotypic performance [yield, biomass, growth rate and/or vigor components (Correlation vector (Corr.)), Corr. ID Table 26] under normal conditions across maize varieties. P = p value.

Example 8

Production of Barley Transcriptom and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web(dot)chem.(dot)agilent(dot)com/Scripts/PDS(dot)asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web(dot)davidmlane(dot)com/hyperstat/A34739 (dot)html].

Experimental Procedures

Analyzed Barley Tissues—

Five tissues [leaf, spike, meristem, root tip and adventitious root] tissues at different developmental stages (vegetative stage, reproductive stage), and treatments (drought, low nitrogen (N) and normal conditions), representing different plant characteristics, were sampled and RNA was extracted as described above. Each micro-array expression information tissue type has received a Set ID as summarized in Table 30 below.

TABLE 30

Barley transcriptom expression sets

| Expression Set | Set ID |
|---|---|
| leaf drought vegetative | 1 |
| booting spike drought reproductive | 2 |
| leaf drought reproductive | 3 |
| meristem drought vegetative | 4 |
| root tip drought vegetative | 5 |
| root tip recovery - drought vegetative | 6 |
| leaf low N vegetative | 7 |
| root tip low N vegetative | 8 |
| Adv. root T3 low N vegetative | 9 |
| Adv. root T3 normal vegetative | 10 |
| leaf T3 normal vegetative | 11 |
| root tip T3 normal vegetative | 12 |

Table 30. "Adv. Root" = adventitious root.
"Root tip recovery" - drought vegetative = the root tip were exposed to drought conditions and then allowed to recover using normal supply of water;

Barley Yield Components and Vigor Related Parameters Assessment—

15 Barley accessions in 5 repetitive blocks, each containing 5 plants per pot were grown at net house. Three different treatments were applied: plants were regularly fertilized and watered during plant growth until harvesting (as recommended for commercial growth) or under low Nitrogen (80% percent less Nitrogen) or drought stress. Plants were phenotyped on a daily basis following the standard descriptor of barley (Table 31, below). Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb(dot)nih(dot)gov/]. Next, analyzed data was saved to text files and processed using the JMP statistical analysis software (SAS institute).

Grains Number—

The total number of grains from all spikes that were manually threshed was counted. No. of grains per plot were counted.

Grain Weight (gr.)—

At the end of the experiment all spikes of the pots were collected. The total grains from all spikes that were manually threshed were weight. The grain yield was calculated by per plot.

Spike Length and Width Analysis—

At the end of the experiment the length and width of five chosen spikes per plant were measured using measuring tape excluding the awns.

Spike Number Analysis—

The spikes per plant were counted.

Plant Height—

Each of the plants was measured for its height using measuring tape. Height was measured from ground level to top of the longest spike excluding awns at two time points at the Vegetative growth (30 days after sowing) and at harvest.

Spike Weight—

The biomass and spikes weight of each plot was separated, measured and divided by the number of plants.

Dry Weight=
total weight of the vegetative portion above ground (excluding roots) after drying at 70° C. in oven for 48 hours at two time points at the Vegetative growth (30 days after sowing) and at harvest.

Root Dry Weight=
total weight of the root portion underground after drying at 70° C. in oven for 48 hours at harvest.

Root/Shoot Ratio—

The Root/Shoot Ratio is calculated using Formula X.

Root/Shoot Ratio=total weight of the root at harvest/ total weight of the vegetative portion above ground at harvest.  Formula X:

Total No of Tillers—
all tillers were counted per plot at two time points at the Vegetative growth (30 days after sowing) and at harvest.

SPAD—

Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), Root Length (cm) and No. of Lateral Roots—

3 plants per plot were selected for measurement of root weight, root length and for counting the number of lateral roots formed.

Shoot FW—
weight of 3 plants per plot were recorded at different time-points.

Relative Water Content—

Fresh weight (FW) of three leaves from three plants each from different seed ID is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to Formula I above.

Harvest Index (for Barley)—

The harvest index is calculated using Formula XI.

Harvest Index=Average grain weight per plant/(Average vegetative dry weight per plant+Average grain weight per plant).  Formula XI:

Relative Growth Rate:
the relative growth rate (RGR) of Plant Height, Spad and number of tillers are calculated as follows:

The relative growth rate of plant height was calculated according to Formula XII.

Relative growth rate of Plant height=Regression coefficient of Plant height along time course.  Formula XII:

Relative growth rate of SPAD=Regression coefficient of SPAD measurements along time course.  Formula XIII:

Relative growth rate of Number of tillers=Regression coefficient of Number of tillers along time course.  Formula XIV:

TABLE 31

Barley correlated parameters (vectors)

| Correlated parameter with | Correlation ID |
|---|---|
| SPAD-Low N-TP2 | 1 |
| Root FW (g)-Low N-TP2 | 2 |
| shoot FW (gr)-Low N-TP2 | 3 |
| No of tillers-Low N-TP2 | 4 |
| Seed Yield (gr)-Low N | 5 |
| Spike Width (cm)-Low N | 6 |
| Root length (cm)-Low N-TP2 | 7 |
| Plant Height (cm)-Low N | 8 |
| Spike Length (cm)-Low N | 9 |
| Plant Height (cm)-Low N-TP2 | 10 |
| Leaf Number-TP4-Low N | 11 |
| No of lateral roots-Low N-TP2 | 12 |
| Max Width (mm)-TP4-Low N | 13 |
| Max Length (mm)-TP4-Low N | 14 |
| Seed Number (per plot)-Low N | 15 |
| Total No of Spikes per plot-Low N | 16 |
| Total Leaf Area (mm$^2$)-TP4-Low N | 17 |
| Total No of tillers per plot-Low N | 18 |
| Spike total weight (per plot)-Low N | 19 |
| Seed Yield (gr)-Normal | 20 |
| Harvest index Drought/recovery | 21 |
| Dry weight vegetative growth Drought/recovery | 22 |
| Relative water content Drought/recovery | 23 |
| Heading date Drought/recovery | 24 |
| Root DW per plant at harvest [gr.]/Shoot DW per plant at harvest [gr.] Drought/recovery | 25 |
| Height Relative growth rate Drought/recovery | 26 |
| Spad Relative growth rate Drought/recovery | 27 |
| Number of tillers Relative growth rate Drought/recovery | 28 |
| Grain number Drought/recovery | 29 |
| Grain weight Drought/recovery | 30 |
| Plant height Drought/recovery | 31 |
| Spike number Drought/recovery | 32 |
| Spike length Drought/recovery | 33 |
| Spike width Drought/recovery | 34 |
| Spike weight per plant Drought/recovery | 35 |
| Tillers number Drought/recovery | 36 |
| Dry weight harvest Drought/recovery | 37 |
| Root dry weight Drought/recovery | 38 |
| Root length Drought/recovery | 39 |
| lateral root number Drought/recovery | 40 |
| Root fresh weight Drought/recovery | 41 |
| Chlorophyll levels Drought/recovery | 42 |
| Fresh weight Drought/recovery | 43 |
| Seed Yield Normal | 44 |
| Num Seeds Normal | 45 |
| Plant Height Normal | 46 |
| Num Spikes Normal | 47 |
| Spike Length Normal | 48 |
| Spike Width Normal | 49 |
| Spike weight Normal | 50 |
| Total Tillers Normal | 51 |
| Root Length Normal | 52 |
| Lateral Roots Normal | 53 |
| Root FW Normal | 54 |
| Num Tillers Normal | 55 |
| SPAD Normal | 56 |
| Shoot FW Normal | 57 |
| Num Leaves Normal | 58 |
| Leaf Area Normal | 59 |

Table 31. Provided are the barley correlated parameters,
TP means time point,
DW—dry weight,
FW—fresh weight and
Low N—Low Nitrogen.

Experimental Results 15 different Barley accessions were grown and characterized for different parameters as described above. The average for each of the measured parameters was calculated using the JMP software and values are summarized in Tables 32-33 below. Subsequent correlation analysis between the various transcriptom sets and the average parameters was conducted (Table 34). Follow, results were integrated to the database.

TABLE 32

Measured parameters of correlation IDs in Barley accessions

| Corr. ID | Ecotype | | | | | | | |
|---|---|---|---|---|---|---|---|---|
| | Line-1 | Line-2 | Line-3 | Line-4 | Line-5 | Line-6 | Line-7 | Line-8 |
| 1 | 24.03 | 23.30 | 26.47 | 23.90 | 26.63 | 23.20 | 25.43 | 24.23 |
| 2 | 0.38 | 0.23 | 0.12 | 0.40 | 0.88 | 0.50 | 0.43 | 0.32 |
| 3 | 0.43 | 0.43 | 0.33 | 0.58 | 0.78 | 0.53 | 0.45 | 0.43 |
| 4 | 0.00 | 0.00 | 0.00 | 0.00 | 0.00 | 0.00 | 0.00 | 0.00 |
| 5 | 9.76 | 7.31 | 3.30 | 5.06 | 6.02 | 9.74 | 7.35 | 5.80 |
| 6 | 7.95 | 8.13 | 9.43 | 4.94 | 9.60 | 7.16 | 7.06 | 8.51 |
| 7 | 24.67 | 21.67 | 22.00 | 21.67 | 22.17 | 23.00 | 30.50 | 22.83 |
| 8 | 41.00 | 82.00 | 61.40 | 59.40 | 65.80 | 47.80 | 53.80 | 56.40 |
| 9 | 15.19 | 19.61 | 16.30 | 19.32 | 90.22 | 16.44 | 20.44 | 18.84 |
| 10 | 16.33 | 18.83 | 17.33 | 26.00 | 22.50 | 18.17 | 19.67 | 19.83 |
| 11 | 8.00 | 8.00 | 7.50 | 8.50 | 10.00 | 11.50 | 8.60 | 6.33 |
| 12 | 5.00 | 6.00 | 4.33 | 6.00 | 6.33 | 6.00 | 6.67 | 4.67 |
| 13 | 5.25 | 5.17 | 5.12 | 5.30 | 5.20 | 5.33 | 5.32 | 5.10 |
| 14 | 102.90 | 107.78 | 111.57 | 142.42 | 152.38 | 149.33 | 124.08 | 95.00 |
| 15 | 230.20 | 164.60 | 88.25 | 133.60 | 106.00 | 222.60 | 219.20 | 143.45 |
| 16 | 12.20 | 9.00 | 11.60 | 25.00 | 7.80 | 14.50 | 15.00 | 7.00 |
| 17 | 39.40 | 46.27 | 51.51 | 57.07 | 67.78 | 64.15 | 52.42 | 46.15 |
| 18 | 16.20 | 14.60 | 16.00 | 20.75 | 12.50 | 18.80 | 21.20 | 11.00 |
| 19 | 13.74 | 13.44 | 9.15 | 11.64 | 11.34 | 15.06 | 12.18 | 10.95 |
| 20 | 46.37 | 19.81 | 10.84 | 22.58 | 30.30 | 54.13 | 36.98 | 42.04 |
| 21 | 0.53 | 0.66 | 0.29 | 0.81 | 0.69 | 0.69 | 0.60 | 0.87 |
| 22 | | 0.21 | 0.13 | | 0.17 | | 0.25 | |
| 23 | 55.87 | 53.40 | 58.32 | | 69.78 | 45.49 | 87.41 | |
| 24 | 65.00 | 71.00 | 90.00 | | 90.00 | 90.00 | 90.00 | |
| 25 | 0.01 | 0.01 | 0.02 | 0.01 | 0.02 | 0.01 | 0.01 | 0.02 |
| 26 | 0.73 | 0.86 | 0.39 | 0.80 | 0.94 | 0.70 | 0.77 | 0.92 |
| 27 | 0.00 | −0.12 | 0.00 | 0.04 | −0.07 | 0.01 | −0.06 | 0.05 |
| 28 | 0.06 | 0.10 | 0.18 | 0.06 | 0.06 | 0.10 | 0.10 | 0.06 |
| 29 | 111.00 | 267.50 | 71.50 | 358.00 | 252.50 | 288.40 | 348.50 | 521.39 |
| 30 | 3.55 | 9.80 | 2.05 | 14.03 | 7.75 | 9.92 | 8.50 | 17.52 |
| 31 | 35.00 | 52.80 | 47.40 | 49.86 | 48.00 | 37.67 | 40.80 | 43.00 |
| 32 | 7.60 | 4.36 | 3.05 | 9.67 | 3.43 | 6.90 | 8.55 | 5.42 |
| 33 | 13.27 | 16.85 | 14.23 | 18.31 | 15.64 | 15.66 | 16.00 | 17.42 |
| 34 | 7.82 | 9.07 | 7.84 | 6.73 | 7.62 | 6.98 | 6.06 | 9.55 |
| 35 | 18.20 | 24.24 | 11.73 | 33.03 | 15.00 | 23.40 | 21.96 | 34.80 |
| 36 | 10.92 | 9.04 | 8.45 | 11.00 | 8.78 | 13.00 | 13.92 | 6.78 |
| 37 | 3.20 | 5.05 | 5.12 | 3.31 | 3.55 | 4.52 | 5.67 | 2.65 |
| 38 | 27.13 | 60.19 | 116.95 | 22.13 | 70.72 | 37.34 | 66.18 | 41.12 |
| 39 | 22.00 | 20.33 | 17.00 | 19.67 | 18.33 | 21.00 | 21.67 | 16.67 |
| 40 | 7.33 | 8.67 | 6.33 | 8.67 | 6.67 | 7.67 | 6.00 | 7.67 |
| 41 | 1.12 | 1.48 | 0.58 | 1.38 | 1.68 | 1.62 | 1.45 | 0.82 |
| 36 | 10.92 | 9.04 | 8.45 | 11.00 | 8.78 | 13.00 | 13.92 | 6.78 |
| 42 | 36.57 | 33.57 | 42.37 | 31.77 | 39.73 | 38.33 | 42.13 | 33.47 |
| 31 | 35.00 | 52.80 | 47.40 | 49.86 | 48.00 | 37.67 | 40.80 | 43.00 |
| 43 | 1.17 | 1.52 | 0.90 | 1.73 | 1.22 | 1.75 | 1.88 | 1.00 |
| 44 | 46.40 | 19.80 | 10.80 | 22.60 | 30.30 | 54.10 | 37.00 | 42.00 |
| 45 | 1090.00 | 510.00 | 242.00 | 582.00 | 621.00 | 1070.00 | 903.00 | 950.00 |
| 46 | 64.70 | 84.00 | 67.40 | 82.00 | 72.00 | 56.60 | 65.80 | 62.80 |
| 47 | 41.50 | 32.00 | 36.00 | 71.40 | 34.20 | 45.60 | 49.80 | 28.00 |
| 48 | 16.50 | 19.20 | 18.30 | 20.40 | 17.20 | 19.10 | 20.30 | 21.70 |
| 49 | 9.54 | 9.05 | 8.25 | 6.55 | 10.50 | 8.83 | 7.38 | 10.40 |
| 50 | 69.40 | 39.40 | 34.90 | 50.30 | 60.80 | 79.10 | 62.70 | 60.00 |
| 51 | 46.70 | 41.60 | 40.00 | 48.80 | 34.60 | 48.60 | 49.20 | 29.00 |
| 52 | 21.30 | 15.00 | 21.80 | 20.30 | 27.20 | 16.00 | 24.00 | 13.50 |
| 53 | 7.00 | 8.67 | 8.33 | 9.67 | 10.70 | 9.67 | 9.67 | 8.67 |
| 54 | 0.27 | 0.27 | 0.25 | 0.35 | 0.62 | 0.27 | 0.35 | 0.32 |
| 55 | 2.00 | 2.00 | 1.00 | 2.33 | 2.33 | 3.33 | 2.33 | 1.33 |
| 56 | 39.10 | 41.40 | 35.20 | 33.70 | 34.20 | 42.80 | 37.00 | 36.90 |
| 57 | 2.17 | 1.90 | 1.25 | 3.00 | 15.60 | 3.02 | 2.58 | 1.75 |
| 46 | 64.70 | 84.00 | 67.40 | 82.00 | 72.00 | 56.60 | 65.80 | 62.80 |
| 58 | 24.20 | 18.20 | 22.70 | 25.50 | 23.20 | 28.30 | 22.20 | 19.00 |
| 59 | 294.00 | 199.00 | 273.00 | 276.00 | 313.00 | 309.00 | 259.00 | 291.00 |

Table 32.

TABLE 33

Measured parameters of correlation IDs in Barley accessions

| Corr. ID | Line-9 | Line-10 | Line-11 | Line-14 | Line-18 | Line-23 | Line-25 |
|---|---|---|---|---|---|---|---|
| 1 | 25.03 | 26.07 | | | | | |
| 2 | 0.30 | 0.55 | | | | | |
| 3 | 0.50 | 0.62 | | | | | |
| 4 | 0.00 | 0.00 | | | | | |
| 5 | 7.83 | 6.29 | | | | | |
| 6 | 10.01 | 9.40 | | | | | |
| 7 | 23.83 | 24.50 | | | | | |
| 8 | 81.80 | 44.60 | | | | | |
| 9 | 18.77 | 16.65 | | | | | |
| 10 | 19.17 | 19.17 | | | | | |
| 11 | 7.50 | 10.00 | | | | | |
| 12 | 5.67 | 7.33 | | | | | |
| 13 | 5.15 | 5.10 | | | | | |
| 14 | 124.12 | 135.17 | | | | | |
| 15 | 201.80 | 125.00 | | | | | |
| 16 | 5.40 | 8.40 | | | | | |
| 17 | 68.02 | 57.91 | | | | | |
| 18 | 6.75 | 14.00 | | | | | |
| 19 | 12.18 | 10.62 | | | | | |
| 20 | 35.37 | 38.25 | | | | | |
| 21 | 0.78 | 0.53 | 0.47 | 0.69 | 0.75 | 0.44 | 0.41 |
| 22 | 0.22 | | 0.21 | | | 0.19 | |
| 23 | 73.09 | 43.21 | 80.60 | | 76.51 | 80.58 | |
| 24 | 90.00 | 66.75 | 75.00 | | | 81.60 | |
| 25 | 0.01 | 0.03 | 0.01 | 0.01 | 0.01 | 0.01 | 0.03 |
| 26 | −0.13 | 0.40 | 0.27 | 0.88 | 0.71 | 0.88 | 0.20 |
| 27 | 0.03 | 0.04 | 0.09 | 0.01 | 0.00 | −0.07 | −0.06 |
| 28 | 0.02 | 0.16 | 0.07 | 0.07 | 0.05 | 0.15 | 0.44 |
| 29 | 376.67 | 153.60 | 170.00 | 205.33 | 274.50 | 160.13 | 105.00 |
| 30 | 11.00 | 5.28 | 5.55 | 7.20 | 10.25 | 5.38 | 2.56 |
| 31 | 52.60 | 45.20 | 46.00 | 38.00 | 41.20 | 64.80 | 32.00 |
| 32 | 3.72 | 4.92 | 4.20 | 8.44 | 5.80 | 4.07 | 3.21 |
| 33 | 16.54 | 14.19 | 16.70 | 13.55 | 17.49 | 14.81 | 12.72 |
| 34 | 8.35 | 8.74 | 8.64 | 7.32 | 8.05 | 7.81 | 5.47 |
| 35 | 21.00 | 19.50 | 17.72 | 18.00 | 28.16 | 18.78 | 9.88 |
| 36 | 5.12 | 10.32 | 11.68 | 10.16 | 7.44 | 9.15 | 16.13 |
| 37 | 3.11 | 4.76 | 6.15 | 3.28 | 3.38 | 6.86 | 3.74 |
| 38 | 37.46 | 117.42 | 77.52 | 18.62 | 25.56 | 84.10 | 98.86 |
| 39 | 27.00 | 20.67 | 21.67 | 24.00 | 20.33 | 15.17 | 15.00 |
| 40 | 7.00 | 6.67 | 8.33 | 7.67 | 6.67 | 7.00 | 6.67 |
| 41 | 1.07 | 1.67 | 2.07 | 1.87 | 0.85 | 0.63 | 0.70 |
| 36 | 5.12 | 10.32 | 11.68 | 10.16 | 7.44 | 9.15 | 16.13 |
| 42 | 36.77 | 45.07 | 41.33 | 40.50 | 36.17 | 42.27 | 40.63 |
| 31 | 52.60 | 45.20 | 46.00 | 38.00 | 41.20 | 64.80 | 32.00 |
| 43 | 1.43 | 1.90 | 1.90 | 1.95 | 1.58 | 0.90 | 0.83 |
| 44 | 35.40 | 38.30 | | | | | |
| 45 | 984.00 | 768.00 | | | | | |
| 46 | 91.60 | 66.20 | | | | | |
| 47 | 19.30 | 38.00 | | | | | |
| 48 | 16.50 | 16.10 | | | | | |
| 49 | 10.20 | 10.30 | | | | | |
| 50 | 55.90 | 59.70 | | | | | |
| 51 | 27.50 | 38.80 | | | | | |
| 52 | 21.50 | 15.20 | | | | | |
| 53 | 10.00 | 9.67 | | | | | |
| 54 | 0.23 | 0.27 | | | | | |
| 55 | 1.33 | 1.67 | | | | | |
| 56 | 35.00 | 36.80 | | | | | |
| 57 | 2.18 | 1.82 | | | | | |
| 46 | 91.60 | 66.20 | | | | | |
| 58 | 17.30 | 22.00 | | | | | |
| 59 | 299.00 | 296.00 | | | | | |

Table 33.

TABLE 34

Correlation between the expression level of selected genes of some embodiments of the invention in various tissues and the phenotypic performance under low nitrogen, normal or drought stress conditions across Barley accessions

| Gene Name | R | P value | Exp. set | Corr. ID | Gene Name | R | P value | Exp. set | Corr. ID |
|---|---|---|---|---|---|---|---|---|---|
| LYM521 | 0.73 | 1.00E−01 | 2 | 39 | LYM521 | 0.77 | 2.67E−02 | 1 | 32 |
| LYM521 | 0.84 | 1.67E−02 | 3 | 34 | LYM521 | 0.85 | 1.43E−02 | 3 | 25 |
| LYM521 | 0.75 | 3.29E−02 | 12 | 48 | LYM521 | 0.83 | 3.08E−03 | 8 | 9 |
| LYM521 | 0.95 | 3.08E−05 | 8 | 2 | LYM521 | 0.86 | 1.25E−03 | 8 | 3 |
| LYM522 | 0.87 | 5.05E−03 | 1 | 34 | LYM522 | 0.80 | 5.55E−02 | 5 | 24 |
| LYM522 | 0.72 | 2.77E−02 | 4 | 36 | LYM522 | 0.74 | 3.68E−02 | 11 | 49 |
| LYM522 | 0.78 | 2.10E−02 | 11 | 59 | LYM523 | 0.74 | 9.16E−02 | 2 | 39 |
| LYM523 | 0.85 | 3.00E−02 | 2 | 42 | LYM523 | 0.74 | 3.49E−02 | 1 | 34 |
| LYM523 | 0.82 | 1.31E−02 | 1 | 37 | LYM523 | 0.70 | 5.26E−02 | 1 | 38 |
| LYM523 | 0.75 | 1.97E−02 | 6 | 21 | LYM523 | 0.87 | 2.32E−03 | 6 | 29 |
| LYM523 | 0.85 | 3.61E−03 | 6 | 30 | LYM523 | 0.87 | 2.14E−03 | 6 | 35 |
| LYM523 | 0.86 | 2.77E−02 | 5 | 23 | LYM523 | 0.72 | 4.30E−02 | 5 | 25 |
| LYM523 | 0.73 | 4.00E−02 | 5 | 42 | LYM523 | 0.97 | 1.73E−03 | 5 | 24 |
| LYM523 | 0.91 | 6.09E−04 | 4 | 38 | LYM523 | 0.75 | 3.04E−02 | 12 | 53 |
| LYM523 | 0.72 | 4.43E−02 | 12 | 54 | LYM523 | 0.76 | 2.72E−02 | 11 | 47 |
| LYM523 | 0.70 | 2.36E−02 | 8 | 13 | LYM523 | 0.78 | 8.06E−03 | 8 | 16 |
| LYM523 | 0.71 | 2.18E−02 | 8 | 14 | LYM523 | 0.81 | 8.73E−03 | 7 | 7 |
| LYM524 | 0.82 | 4.41E−02 | 2 | 40 | LYM524 | 0.70 | 1.21E−01 | 2 | 30 |
| LYM524 | 0.84 | 3.82E−02 | 2 | 31 | LYM524 | 0.71 | 1.15E−01 | 2 | 35 |
| LYM524 | 0.75 | 5.44E−02 | 3 | 40 | LYM524 | 0.81 | 2.81E−02 | 3 | 31 |
| LYM524 | 0.73 | 4.13E−02 | 5 | 28 | LYM524 | 0.80 | 1.72E−02 | 5 | 31 |
| LYM524 | 0.81 | 7.90E−03 | 9 | 2 | LYM524 | 0.81 | 8.75E−03 | 9 | 17 |
| LYM524 | 0.95 | 9.16E−05 | 9 | 3 | LYM524 | 0.85 | 3.67E−03 | 9 | 14 |
| LYM524 | 0.72 | 4.29E−02 | 11 | 53 | LYM524 | 0.83 | 5.48E−03 | 10 | 57 |
| LYM524 | 0.77 | 1.53E−02 | 10 | 54 | LYM524 | 0.92 | 4.38E−04 | 7 | 9 |
| LYM524 | 0.90 | 1.03E−03 | 7 | 2 | LYM524 | 0.84 | 5.09E−03 | 7 | 3 |
| LYM524 | 0.77 | 1.59E−02 | 7 | 14 | LYM524 | 0.78 | 1.40E−02 | 7 | 10 |
| LYM525 | 0.71 | 1.12E−01 | 2 | 40 | LYM525 | 0.75 | 8.86E−02 | 2 | 33 |
| LYM525 | 0.84 | 3.63E−02 | 2 | 31 | LYM525 | 0.85 | 3.03E−02 | 2 | 35 |
| LYM525 | 0.71 | 7.51E−02 | 3 | 39 | LYM525 | 0.80 | 3.02E−02 | 3 | 34 |

TABLE 34-continued

Correlation between the expression level of selected genes of some embodiments of the invention in various tissues and the phenotypic performance under low nitrogen, normal or drought stress conditions across Barley accessions

| Gene Name | R | P value | Exp. set | Corr. ID | Gene Name | R | P value | Exp. set | Corr. ID |
|---|---|---|---|---|---|---|---|---|---|
| LYM525 | 0.79 | 3.48E−02 | 3 | 29 | LYM525 | 0.77 | 4.16E−02 | 3 | 30 |
| LYM525 | 0.84 | 1.67E−02 | 3 | 25 | LYM525 | 0.72 | 4.40E−02 | 5 | 29 |
| LYM525 | 0.74 | 3.52E−02 | 5 | 25 | LYM525 | 0.80 | 1.59E−02 | 5 | 38 |
| LYM525 | 0.77 | 1.54E−02 | 4 | 36 | LYM525 | 0.74 | 5.96E−02 | 4 | 24 |
| LYM525 | 0.71 | 3.12E−02 | 9 | 12 | LYM525 | 0.72 | 3.01E−02 | 9 | 7 |
| LYM525 | 0.73 | 2.66E−02 | 10 | 56 | LYM525 | 0.71 | 3.17E−02 | 10 | 44 |
| LYM525 | 0.70 | 3.39E−02 | 7 | 20 | LYM525 | 0.89 | 1.21E−03 | 7 | 9 |
| LYM525 | 0.83 | 5.52E−03 | 7 | 7 | LYM525 | 0.79 | 1.21E−02 | 7 | 15 |
| LYM526 | 0.79 | 6.03E−02 | 2 | 34 | LYM526 | 0.83 | 1.14E−02 | 1 | 28 |
| LYM526 | 0.83 | 1.04E−02 | 1 | 37 | LYM526 | 0.72 | 6.98E−02 | 6 | 23 |
| LYM526 | 0.76 | 1.76E−02 | 6 | 42 | LYM526 | 0.76 | 4.88E−02 | 6 | 24 |
| LYM526 | 0.82 | 4.36E−02 | 5 | 24 | LYM527 | 0.75 | 8.59E−02 | 2 | 36 |
| LYM527 | 0.95 | 4.00E−03 | 2 | 25 | LYM527 | 0.92 | 9.55E−03 | 2 | 37 |
| LYM527 | 0.98 | 6.62E−04 | 2 | 38 | LYM527 | 0.70 | 5.25E−02 | 1 | 28 |
| LYM527 | 0.71 | 4.92E−02 | 1 | 31 | LYM527 | 0.76 | 4.97E−02 | 3 | 34 |
| LYM527 | 0.73 | 6.19E−02 | 3 | 29 | LYM527 | 0.90 | 5.47E−03 | 3 | 25 |
| LYM527 | 0.83 | 1.13E−02 | 5 | 28 | LYM527 | 0.85 | 7.35E−03 | 5 | 31 |
| LYM527 | 0.78 | 2.23E−02 | 5 | 37 | LYM527 | 0.70 | 3.45E−02 | 4 | 28 |
| LYM527 | 0.71 | 4.62E−02 | 11 | 48 | LYM528 | 0.76 | 8.20E−02 | 2 | 21 |
| LYM528 | 0.76 | 2.90E−02 | 1 | 21 | LYM528 | 0.83 | 1.07E−02 | 1 | 25 |
| LYM528 | 0.77 | 2.54E−02 | 11 | 48 | LYM528 | 0.77 | 1.61E−02 | 10 | 45 |
| LYM528 | 0.70 | 3.41E−02 | 10 | 50 | LYM528 | 0.73 | 2.71E−02 | 10 | 44 |
| LYM529 | 0.71 | 1.17E−01 | 2 | 32 | LYM529 | 0.72 | 1.09E−01 | 2 | 29 |
| LYM529 | 0.83 | 4.14E−02 | 2 | 31 | LYM529 | 0.77 | 2.62E−02 | 1 | 40 |
| LYM529 | 0.73 | 2.53E−02 | 4 | 32 | LYM529 | 0.81 | 4.70E−03 | 8 | 14 |
| LYM530 | 0.95 | 3.93E−03 | 2 | 25 | LYM530 | 0.91 | 1.06E−02 | 2 | 37 |
| LYM530 | 0.97 | 1.38E−03 | 2 | 38 | LYM530 | 0.81 | 1.56E−02 | 1 | 28 |
| LYM530 | 0.83 | 2.00E−02 | 3 | 31 | LYM530 | 0.91 | 4.43E−03 | 3 | 38 |
| LYM530 | 0.78 | 1.35E−02 | 4 | 43 | LYM530 | 0.73 | 2.60E−02 | 9 | 11 |
| LYM530 | 0.81 | 1.38E−02 | 11 | 56 | LYM530 | 0.75 | 3.20E−02 | 11 | 55 |
| LYM530 | 0.87 | 2.40E−03 | 7 | 16 | LYM530 | 0.80 | 9.15E−03 | 7 | 10 |
| LYM531 | 0.85 | 3.15E−02 | 2 | 33 | LYM531 | 0.80 | 5.39E−02 | 2 | 30 |
| LYM531 | 0.90 | 1.38E−02 | 2 | 31 | LYM531 | 0.94 | 5.92E−03 | 2 | 35 |
| LYM531 | 0.79 | 2.05E−02 | 1 | 35 | LYM531 | 0.77 | 1.63E−02 | 6 | 36 |
| LYM531 | 0.75 | 2.02E−02 | 6 | 39 | LYM531 | 0.73 | 6.35E−02 | 3 | 30 |
| LYM531 | 0.75 | 5.34E−02 | 3 | 31 | LYM531 | 0.75 | 5.46E−02 | 3 | 35 |
| LYM531 | 0.80 | 9.83E−03 | 9 | 13 | LYM531 | 0.74 | 2.36E−02 | 10 | 45 |
| LYM531 | 0.71 | 3.31E−02 | 10 | 44 | LYM531 | 1.00 | 2.92E−09 | 7 | 9 |
| LYM531 | 0.83 | 6.10E−03 | 7 | 2 | LYM531 | 0.77 | 1.49E−02 | 7 | 3 |
| LYM532 | 0.71 | 1.15E−01 | 2 | 39 | LYM532 | 0.75 | 3.16E−02 | 1 | 34 |
| LYM532 | 0.74 | 3.75E−02 | 1 | 31 | LYM532 | 0.74 | 3.62E−02 | 1 | 37 |
| LYM532 | 0.77 | 2.56E−02 | 1 | 38 | LYM532 | 0.81 | 2.72E−02 | 6 | 23 |
| LYM532 | 0.76 | 1.84E−02 | 6 | 29 | LYM532 | 0.73 | 2.47E−02 | 6 | 30 |
| LYM532 | 0.78 | 1.33E−02 | 6 | 35 | LYM532 | 0.74 | 5.60E−02 | 3 | 32 |
| LYM532 | 0.76 | 4.79E−02 | 3 | 39 | LYM532 | 0.79 | 2.06E−02 | 5 | 26 |
| LYM532 | 0.79 | 1.95E−02 | 12 | 58 | LYM532 | 0.71 | 5.08E−02 | 12 | 50 |
| LYM532 | 0.75 | 3.04E−02 | 12 | 55 | LYM532 | 0.73 | 2.53E−02 | 9 | 17 |
| LYM532 | 0.73 | 4.05E−02 | 11 | 52 | LYM532 | 0.78 | 8.14E−03 | 8 | 2 |
| LYM532 | 0.83 | 2.92E−03 | 8 | 12 | LYM532 | 0.79 | 6.72E−03 | 8 | 3 |
| LYM532 | 0.76 | 1.84E−02 | 7 | 2 | LYM532 | 0.72 | 2.92E−02 | 7 | 6 |
| LYM532 | 0.72 | 2.74E−02 | 7 | 1 | LYM533 | 0.88 | 2.02E−02 | 2 | 31 |
| LYM533 | 0.75 | 8.28E−02 | 2 | 35 | LYM533 | 0.73 | 4.08E−02 | 5 | 27 |
| LYM533 | 0.72 | 6.55E−02 | 4 | 23 | LYM533 | 0.74 | 3.67E−02 | 11 | 49 |
| LYM534 | 0.71 | 1.14E−01 | 2 | 28 | LYM534 | 0.77 | 7.55E−02 | 2 | 36 |
| LYM534 | 0.92 | 9.05E−03 | 2 | 25 | LYM534 | 0.93 | 7.72E−03 | 2 | 37 |
| LYM534 | 0.97 | 1.30E−03 | 2 | 38 | LYM534 | 0.72 | 1.03E−01 | 2 | 42 |
| LYM534 | 0.71 | 4.77E−02 | 1 | 39 | LYM534 | 0.80 | 1.71E−02 | 1 | 37 |
| LYM534 | 0.79 | 1.15E−02 | 6 | 34 | LYM534 | 0.81 | 8.20E−03 | 6 | 31 |
| LYM534 | 0.75 | 5.14E−02 | 3 | 37 | LYM534 | 0.89 | 7.32E−03 | 3 | 38 |
| LYM534 | 0.76 | 4.88E−02 | 4 | 23 | LYM534 | 0.70 | 5.17E−02 | 11 | 45 |
| LYM534 | 0.74 | 3.67E−02 | 11 | 50 | LYM534 | 0.80 | 1.72E−02 | 11 | 44 |
| LYM679 | 0.78 | 7.01E−02 | 2 | 28 | LYM679 | 0.82 | 4.58E−02 | 2 | 36 |
| LYM679 | 0.77 | 4.40E−02 | 3 | 34 | LYM679 | 0.81 | 2.71E−02 | 3 | 29 |
| LYM679 | 0.79 | 3.53E−02 | 3 | 30 | LYM679 | 0.84 | 1.88E−02 | 3 | 25 |
| LYM742 | 0.74 | 9.25E−02 | 2 | 31 | LYM742 | 0.72 | 1.05E−01 | 2 | 35 |
| LYM742 | 0.95 | 2.73E−04 | 1 | 32 | LYM742 | 0.85 | 1.64E−02 | 3 | 40 |
| LYM742 | 0.74 | 5.85E−02 | 3 | 27 | LYM742 | 0.75 | 1.99E−02 | 4 | 32 |
| LYM742 | 0.70 | 3.54E−02 | 10 | 46 | LYM742 | 0.80 | 8.87E−03 | 7 | 8 |

Table 34. Provided are the correlations (R) between the expression levels yield improving genes and their homologues in various tissues [Expression (Exp) sets] and the phenotypic performance [yield, biomass, growth rate and/or vigor components (Correlation vector (Corr)) according to Table 31] under normal, low nitrogen and drought conditions across barley varieties. P = p value.

Example 9

Production of *Brachypodium* Transcriptom and High Throughput Correlation Analysis Using 60K *Brachypodium* Oligonucleotide Micro-Array In order to produce a high throughput correlation analysis comparing between plant phenotype and gene expression level, the present inventors utilized a *brachypodium* oligonucleotide micro-array, produced by Agilent Technologies [Hypertext Transfer Protocol://World Wide Web(dot)chem.(dot)agilent(dot)com/Scripts/PDS(dot)asp?1Page=50879]. The array oligonucleotide represents about 60K *brachypodium* genes and transcripts. In order to define correlations between the levels of RNA expression and yield or vigor related parameters, various plant characteristics of 24 different *brachypodium* accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [Hypertext Transfer Protocol://World Wide Web(dot)davidmlane(dot)com/hyperstat/A34739 (dot)html].

Additional correlation analysis was done by comparing plant phenotype and gene copy number. The correlation between the normalized copy number hybridization signal and the characterized parameters was analyzed using Pearson correlation test [Hypertext Transfer Protocol://World Wide Web(dot)davidmlane(dot)com/hyperstat/A34739 (dot)html].

Experimental Procedures

Analyzed *Brachypodium* Tissues—
two tissues [leaf and spike] were sampled and RNA was extracted as described above. Each micro-array expression information tissue type has received a Set ID as summarized in Table 35 below.

TABLE 35

| Brachypodium transcriptom expression sets | |
|---|---|
| Expression Set | Set ID |
| Leaf/normal | 1 |
| spike/normal | 2 |

Table 35.

*Brachypodium* Yield Components and Vigor Related Parameters Assessment—

24 *brachypodium* accessions were grown in 4-6 repetitive plots (8 plant per plot), in a green house. The growing protocol was as follows: *brachypodium* seeds were sown in plots and grown under normal condition. Plants were continuously phenotyped during the growth period and at harvest (Table 37-38, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb(dot)nih(dot)gov/]. Next, analyzed data was saved to text files and processed using the JMP statistical analysis software (SAS institute).

At the end of the growing period the grains were separated from the spikes and the following parameters were measured using digital imaging system and collected:

No. Of Tillering—
all tillers were counted per plant at harvest (mean per plot).

Head Number—
At the end of the experiment, heads were harvested from each plot and were counted.

Total Grains Weight Per Plot (gr.)—
At the end of the experiment (plant 'Heads') heads from plots were collected, the heads were threshed and grains were weighted. In addition, the average grain weight per head was calculated by dividing the total grain weight by number of total heads per plot (based on plot).

Highest Number of Spikelets—
The highest spikelet number per head was calculated per plant (mean per plot).

Mean Number of Spikelets—
The mean spikelet number per head was calculated per plot.

Plant Height—
Each of the plants was measured for its height using measuring tape. Height was measured from ground level to spike base of the longest spike at harvest.

Spikelets Weight (gr.)—
The biomass and spikes weight of each plot was separated, measured per plot.

Average Head Weight—
calculated by dividing spikelets weight with head number (gr.).

Harvest Index—
The harvest index was calculated using Formula XIV (described above).

Spikelets Index—
The Spikelets index is calculated using Formula XVII.

$$\text{Spikelets Index} = \text{Average Spikelets weight per plant} / (\text{Average vegetative dry weight per plant plus Average Spikelets weight per plant}). \quad \text{Formula XVII:}$$

Percent Number of Heads with Spikelets—
The number of heads with more than one spikelet per plant were counted and the percent from all heads per plant was calculated.

Total Dry Mater Per Plot—
Calculated as Vegetative portion above ground plus all the spikelet dry weight per plot.

1000 Grain Weight—
At the end of the experiment all grains from all plots were collected and weighted and the weight of 1000 were calculated.

The following parameters were collected using digital imaging system:

At the end of the growing period the grains were separated from the spikes and the following parameters were measured and collected:

(i) Average Grain Area ($cm^2$)—
A sample of ~200 grains was weighted, photographed and images were processed using the below described image processing system. The grain area was measured from those images and was divided by the number of grains.

(ii) Average Grain Length, Perimeter and Width (cm)—
A sample of ~200 grains was weighted, photographed and images were processed using the below described image processing system. The sum of grain lengths and width (longest axis) was measured from those images and was divided by the number of grains.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 36

Brachypodium correlated parameters (vectors)

| Correlated parameter with | Correlation ID |
|---|---|
| Percent Num of heads with spikelets | 1 |
| 1000 grain weight (gr) | 2 |
| Average head weight (gr) | 3 |
| Grain area (cm$^2$) | 4 |
| Grain length (cm) | 5 |
| Grain Perimeter (cm) | 6 |
| Grain width (cm) | 7 |
| Grains weight per plant (gr) | 8 |
| Grains weight per plot (gr) | 9 |
| Harvest index | 10 |
| Heads per plant | 11 |
| Heads per plot | 12 |
| Highest num of spikelets per plot | 13 |

TABLE 36-continued

Brachypodium correlated parameters (vectors)

| Correlated parameter with | Correlation ID |
|---|---|
| Mean num of spikelets per plot | 14 |
| Num of heads with spikelets per plant | 15 |
| Plant height (cm) | 16 |
| Plant Vegetative DW (gr) | 17 |
| Spikelets DW per plant (gr) | 19 |
| Spikelets weight (gr) | 20 |
| Spikes index | 21 |
| Num of tillers | 22 |
| Total dry mater per plant (gr) | 23 |
| Total dry mater per plot (gr) | 24 |
| Vegetative DW (gr) | 25 |

Table 36. Provided are the foxtail millet correlated parameters. "Num" = number.

Experimental Results 24 different Brachypodium accessions were grown and characterized for different parameters as described above. The average for each of the measured parameter was calculated using the JMP software and values are summarized in Tables 37-38 below. Subsequent correlation analysis between the various transcriptom sets and the average parameters (Table 39) was conducted. Follow, results were integrated to the database.

TABLE 37

Measured parameters of correlation IDs in Brachypodium accessions under normal conditions

| Corr. ID | Line-1 | Line-2 | Line-3 | Line-4 | Line-5 | Line-6 | Line-7 | Line-8 | Line-9 | Line-10 | Line-11 |
|---|---|---|---|---|---|---|---|---|---|---|---|
| 1 | 27.61 | 35.33 | 21.67 | 14.00 | 5.42 | 15.42 | 6.40 | 4.51 | 55.41 | 16.51 | 15.52 |
| 2 | 3.75 | 3.78 | 3.35 | 4.88 | 5.54 | 4.98 | 4.83 | 5.54 | 3.84 | 4.76 | 4.73 |
| 3 | 0.06 | 0.04 | 0.05 | 0.07 | 0.04 | 0.06 | 0.05 | 0.04 | 0.08 | 0.06 | 0.05 |
| 4 | 0.10 | 0.10 | 0.09 | 0.09 | 0.11 | 0.11 | 0.10 | 0.11 | 0.10 | 0.11 | 0.10 |
| 5 | 0.73 | 0.72 | 0.72 | 0.74 | 0.83 | 0.82 | 0.78 | 0.90 | 0.75 | 0.79 | 0.75 |
| 6 | 1.67 | 1.62 | 1.62 | 1.69 | 1.82 | 1.83 | 1.74 | 1.93 | 1.68 | 1.82 | 1.69 |
| 7 | 0.18 | 0.17 | 0.17 | 0.16 | 0.16 | 0.17 | 0.17 | 0.16 | 0.17 | 0.18 | 0.17 |
| 8 | 0.14 | 0.06 | 0.08 | 0.26 | 0.14 | 0.14 | 0.14 | 0.11 | 0.08 | 0.07 | 0.39 |
| 9 | 1.05 | 0.44 | 0.61 | 1.96 | 1.11 | 1.07 | 1.09 | 0.84 | 0.50 | 0.39 | 3.07 |
| 10 | 0.13 | 0.14 | 0.15 | 0.20 | 0.20 | 0.16 | 0.14 | 0.26 | 0.07 | 0.11 | 0.22 |
| 11 | 16.29 | 7.08 | 6.59 | 11.63 | 10.48 | 9.09 | 14.13 | 5.88 | 11.89 | 8.02 | 23.75 |
| 12 | 121.75 | 56.60 | 52.75 | 83.40 | 82.40 | 70.13 | 110.33 | 47.00 | 81.50 | 48.60 | 185.50 |
| 13 | 3.00 | 2.60 | 3.00 | 2.20 | 2.00 | 2.25 | 1.83 | 2.00 | 3.50 | 2.00 | 2.50 |
| 14 | 2.10 | 2.10 | 1.72 | 1.69 | 1.38 | 1.65 | 1.43 | 1.25 | 2.41 | 1.56 | 1.76 |
| 15 | 5.27 | 2.50 | 2.06 | 2.08 | 0.71 | 1.94 | 1.08 | 0.35 | 7.59 | 1.87 | 4.98 |
| 16 | 31.65 | 23.44 | 22.75 | 31.95 | 34.36 | 28.65 | 28.88 | 24.74 | 31.40 | 29.15 | 37.30 |
| 17 | 0.42 | 0.12 | 0.13 | 0.38 | 0.32 | 0.32 | 0.39 | 0.13 | 0.44 | 0.31 | 0.87 |
| 18 | 7.50 | 8.00 | 8.00 | 7.20 | 7.80 | 7.75 | 7.83 | 8.00 | 6.50 | 6.40 | 7.75 |
| 19 | 0.96 | 0.31 | 0.33 | 0.88 | 0.44 | 0.56 | 0.67 | 0.26 | 0.92 | 0.45 | 1.14 |
| 20 | 7.18 | 2.50 | 2.68 | 6.42 | 3.45 | 4.29 | 5.29 | 2.04 | 6.25 | 2.66 | 8.89 |
| 21 | 0.71 | 0.72 | 0.73 | 0.71 | 0.58 | 0.66 | 0.64 | 0.66 | 0.69 | 0.60 | 0.59 |
| 22 | 16.84 | 7.20 | 7.00 | 11.97 | 10.67 | 9.38 | 14.58 | 6.35 | 12.38 | 8.60 | 25.50 |
| 23 | 1.38 | 0.43 | 0.47 | 1.25 | 0.76 | 0.88 | 1.06 | 0.38 | 1.36 | 0.76 | 2.01 |
| 24 | 10.26 | 3.45 | 3.74 | 9.12 | 6.00 | 6.78 | 8.34 | 3.04 | 9.21 | 4.47 | 15.79 |
| 25 | 3.08 | 0.95 | 1.06 | 2.69 | 2.55 | 2.48 | 3.05 | 1.00 | 2.96 | 1.81 | 6.89 |

Table 37. Correlation IDs: 1, 2, 3, 4, 5, . . . etc. refer to those described in Table 36 above [Brachypodium correlated parameters (vectors)].

TABLE 38

Measured parameters of correlation IDs in brachypodium accessions under normal conditions

| Corr. ID | Line-12 | Line-13 | Line-14 | Line-15 | Line-16 | Line-17 | Line-18 | Line-19 | Line-20 | Line-21 | Line-22 |
|---|---|---|---|---|---|---|---|---|---|---|---|
| 1 | 20.34 | 8.11 | 53.21 | 47.81 | 42.81 | 34.92 | 52.40 | 20.84 | 17.55 | 47.73 | 59.01 |
| 2 | 5.24 | 4.96 | 4.00 | 4.26 | 5.99 | 4.34 | 3.70 | 3.90 | 4.82 | 4.87 | 3.76 |

TABLE 38-continued

Measured parameters of correlation IDs in brachypodium accessions under normal conditions

| Corr. ID | Line-12 | Line-13 | Line-14 | Line-15 | Line-16 | Line-17 | Line-18 | Line-19 | Line-20 | Line-21 | Line-22 |
|---|---|---|---|---|---|---|---|---|---|---|---|
| 3 | 0.05 | 0.06 | 0.10 | 0.08 | 0.08 | 0.06 | 0.09 | 0.04 | 0.06 | 0.09 | 0.09 |
| 4 | 0.12 | 0.10 | 0.10 | 0.09 | 0.12 | 0.09 | 0.09 | 0.09 | 0.10 | 0.11 | 0.09 |
| 5 | 0.86 | 0.74 | 0.84 | 0.80 | 0.84 | 0.74 | 0.75 | 0.72 | 0.79 | 0.87 | 0.76 |
| 6 | 1.91 | 1.71 | 1.81 | 1.75 | 1.87 | 1.66 | 1.65 | 1.60 | 1.80 | 1.90 | 1.68 |
| 7 | 0.19 | 0.17 | 0.15 | 0.14 | 0.18 | 0.16 | 0.15 | 0.15 | 0.17 | 0.16 | 0.15 |
| 8 | 0.14 | 0.13 | 0.37 | 0.49 | 0.31 | 0.20 | 0.35 | 0.27 | 0.32 | 0.44 | 0.30 |
| 9 | 1.09 | 1.07 | 2.99 | 3.52 | 2.41 | 1.47 | 2.58 | 2.03 | 2.58 | 3.40 | 1.92 |
| 10 | 0.09 | 0.18 | 0.09 | 0.16 | 0.18 | 0.11 | 0.21 | 0.17 | 0.15 | 0.18 | 0.09 |
| 11 | 16.06 | 9.74 | 22.19 | 24.32 | 13.25 | 19.22 | 16.11 | 21.40 | 25.88 | 17.05 | 25.54 |
| 12 | 125.00 | 80.75 | 177.50 | 172.80 | 98.60 | 143.17 | 123.50 | 156.83 | 207.00 | 135.00 | 177.00 |
| 13 | 2.40 | 2.00 | 3.50 | 3.80 | 2.80 | 2.83 | 2.83 | 2.33 | 2.60 | 4.50 | 3.17 |
| 14 | 1.83 | 1.42 | 2.71 | 2.61 | 2.12 | 2.15 | 2.17 | 1.85 | 1.93 | 2.85 | 2.79 |
| 15 | 3.70 | 0.89 | 12.58 | 12.13 | 6.35 | 7.15 | 9.44 | 5.02 | 4.90 | 7.72 | 15.36 |
| 16 | 45.09 | 22.39 | 55.04 | 45.34 | 40.20 | 39.18 | 45.35 | 29.41 | 38.39 | 46.74 | 58.82 |
| 17 | 0.69 | 0.34 | 1.72 | 1.32 | 0.48 | 0.63 | 0.82 | 0.67 | 0.87 | 1.05 | 1.73 |
| 18 | 8.00 | 8.25 | 8.00 | 7.00 | 7.60 | 7.33 | 7.50 | 7.33 | 8.00 | 7.88 | 6.83 |
| 19 | 0.83 | 0.59 | 2.27 | 1.91 | 1.09 | 1.26 | 1.46 | 0.96 | 1.56 | 1.42 | 2.25 |
| 20 | 6.65 | 4.92 | 18.15 | 13.49 | 8.35 | 9.42 | 11.31 | 7.16 | 12.44 | 11.05 | 15.55 |
| 21 | 0.54 | 0.68 | 0.56 | 0.59 | 0.70 | 0.66 | 0.68 | 0.60 | 0.65 | 0.57 | 0.57 |
| 22 | 16.56 | 10.53 | 27.15 | 26.30 | 13.56 | 20.79 | 16.99 | 23.61 | 27.20 | 18.25 | 29.09 |
| 23 | 1.53 | 0.93 | 3.99 | 3.23 | 1.57 | 1.89 | 2.28 | 1.63 | 2.43 | 2.47 | 3.98 |
| 24 | 12.20 | 7.76 | 31.94 | 22.78 | 12.04 | 14.14 | 17.78 | 12.29 | 19.40 | 19.27 | 27.67 |
| 25 | 5.55 | 2.84 | 13.80 | 9.28 | 3.70 | 4.72 | 6.47 | 5.13 | 6.96 | 8.23 | 12.12 |

Table 38. Correlation IDs: 1, 2, 3, 4, 5, . . . etc. refer to those described in Table 36 above [Brachypodium correlated parameters (vectors)].

TABLE 39

Correlation between the expression level of selected genes of some embodiments of the invention in various tissues and the phenotypic performance under normal conditions across brachypodium varieties

| Gene Name | R | P value | Exp. set | Corr. ID | Gene Name | R | P value | Exp. set | Corr. ID |
|---|---|---|---|---|---|---|---|---|---|
| LYM743 | 0.82 | 3.91E−03 | 2 | 1 | LYM743 | 0.86 | 1.47E−03 | 2 | 17 |
| LYM743 | 0.81 | 2.38E−03 | 1 | 1 | LYM743 | 0.71 | 1.44E−02 | 1 | 17 |
| LYM537 | 0.81 | 2.78E−03 | 1 | 2 | LYM537 | 0.74 | 9.12E−03 | 1 | 4 |
| LYM538 | 0.77 | 5.36E−03 | 1 | 2 | LYM538 | 0.84 | 1.38E−03 | 1 | 4 |
| LYM539 | 0.74 | 8.64E−03 | 1 | 2 | LYM743 | 0.75 | 1.17E−02 | 2 | 12 |
| LYM535 | 0.82 | 4.04E−03 | 2 | 5 | LYM535 | 0.78 | 7.68E−03 | 2 | 25 |
| LYM535 | 0.78 | 7.88E−03 | 2 | 6 | LYM535 | 0.76 | 1.07E−02 | 2 | 17 |
| LYM538 | 0.87 | 5.34E−04 | 1 | 7 | LYM539 | 0.72 | 1.98E−02 | 2 | 2 |
| LYM536 | 0.77 | 5.30E−03 | 1 | 9 | LYM537 | 0.70 | 2.42E−02 | 2 | 6 |
| LYM743 | 0.80 | 5.89E−03 | 2 | 11 | LYM743 | 0.75 | 1.28E−02 | 2 | 3 |
| LYM535 | 0.70 | 2.42E−02 | 2 | 12 | LYM535 | 0.73 | 1.55E−02 | 2 | 22 |
| LYM743 | 0.73 | 1.68E−02 | 2 | 14 | LYM743 | 0.79 | 7.02E−03 | 2 | 16 |
| LYM535 | 0.73 | 1.75E−02 | 2 | 15 | LYM535 | 0.78 | 7.44E−03 | 2 | 20 |
| LYM743 | 0.88 | 7.23E−04 | 2 | 15 | LYM743 | 0.80 | 4.96E−03 | 2 | 20 |
| LYM743 | 0.84 | 1.30E−03 | 1 | 15 | LYM743 | 0.77 | 5.17E−03 | 1 | 20 |
| LYM535 | 0.71 | 2.01E−02 | 2 | 16 | LYM535 | 0.71 | 2.02E−02 | 2 | 3 |
| LYM743 | 0.74 | 9.59E−03 | 1 | 16 | LYM743 | 0.78 | 4.57E−03 | 1 | 3 |
| LYM743 | 0.85 | 2.05E−03 | 2 | 19 | LYM743 | 0.82 | 3.67E−03 | 2 | 25 |
| LYM538 | 0.70 | 2.35E−02 | 2 | 21 | LYM538 | 0.81 | 4.66E−03 | 2 | 7 |
| LYM743 | 0.82 | 3.65E−03 | 2 | 22 | LYM743 | 0.81 | 4.08E−03 | 2 | 24 |
| LYM535 | 0.76 | 1.06E−02 | 2 | 23 | LYM536 | 0.72 | 1.30E−02 | 1 | 8 |
| LYM743 | 0.85 | 1.64E−03 | 2 | 23 | LYM743 | 0.70 | 1.63E−02 | 1 | 22 |
| LYM743 | 0.76 | 6.20E−03 | 1 | 23 | | | | | |
| LYM535 | 0.78 | 7.16E−03 | 2 | 24 | LYM535 | 0.76 | 1.14E−02 | 2 | 19 |
| LYM743 | 0.74 | 9.17E−03 | 1 | 24 | LYM743 | 0.80 | 3.25E−03 | 1 | 19 |
| LYM596_H9 | 0.71 | 1.39E−02 | 1 | 17 | LYM596_H9 | 0.70 | 1.60E−02 | 1 | 25 |
| LYM596_H9 | 0.81 | 2.50E−03 | 1 | 16 | | | | | |

Table 39. Provided are the correlations (R) between the expression levels yield improving genes and their homologues in various tissues [Expression (Exp) sets] and the phenotypic performance [yield, biomass, growth rate and/or vigor components (Correlation vector (Corr. ID) according to Table 36 above)] under normal conditions across brachypodium varieties. P = p value.

Example 10

Production of Foxtail Millet Transcriptom and High Throughput Correlation Analysis Using 60K Foxtaill Millet Oligonucleotide Micro-Array In order to produce a high throughput correlation analysis comparing between plant phenotype and gene expression level, the present inventors utilized a foxtail millet oligo-nucleotide micro-array, produced by Agilent Technologies [Hypertext Transfer Protocol://World Wide Web(dot)chem.(dot)agilent(dot)com/Scripts/PDS(dot)asp?1Page=50879]. The array oligonucleotide represents about 60K foxtail millet genes and transcripts. In order to define correlations between the levels of RNA expression and yield or vigor related parameters, various plant characteristics of 15 different foxtail millet accessions were analyzed. Among them, 11 accessions encompassing the observed variance were selected for RNA expression analysis. The correlation between the RNA levels and the characterized parameters was analyzed using Pearson correlation test [Hypertext Transfer Protocol://World Wide Web(dot)davidmlane(dot)com/hyperstat/A34739 (dot)html].

Experimental Procedures

Analyzed Foxtail Millet Tissues— three tissues [leaf, flower, and stem] at different developmental stages [time point 1 (TP1) and 2 (TP2)] under normal conditions, representing different plant characteristics, were sampled and RNA was extracted as described above. Each micro-array expression information tissue type has received a Set ID as summarized in Table 40 below.

TABLE 40

Foxtail millet transcriptom expression sets

| Expression Set | Set ID |
| --- | --- |
| flower:TP1:normal | 1 |
| flower:TP2:normal | 2 |
| leaf:TP1:normal | 3 |
| leaf:TP2:normal | 4 |
| stem:TP1:normal | 5 |
| stem:TP2:normal | 6 |

Table 40.

Foxtail Millet Yield Components and Vigor Related Parameters Assessment—

14 Foxtail millet accessions in 5 repetitive plots, in the field. Foxtail millet seeds were sown in soil and grown under normal condition in the field. Plants were continuously phenotyped during the growth period and at harvest (Table 42-43, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb(dot)nih(dot)gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area ($cm^2$)—

A sample of ~200 grains was weighted, photographed and images were processed using the below described image processing system. The grain area was measured from those images and was divided by the number of grains.

(ii) Average Grain Length and Width (cm)—

A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area ($cm^2$)

The 'Head' area was measured from those images and was divided by the number of 'Heads'.

(ii) Head Average Length (mm)

The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb(dot)nih(dot)gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight (gr.)—

At the end of the experiment (plant 'Heads') heads from plots were collected, the heads were threshed and grains were weighted. In addition, the average grain weight per head was calculated by dividing the total grain weight by number of total heads per plot (based on plot).

Head Weight and Head Number—

At the end of the experiment, heads were harvested from each plot and were counted and weighted (kg).

Biomass at Harvest—

At the end of the experiment the vegetative material from plots was weighted.

Dry Weight= total weight of the vegetative portion above ground (excluding roots) after drying at 70° C. in oven for 48 hours at harvest.

Total Dry Mater Per Plot—

Calculated as Vegetative portion above ground plus all the heads dry weight per plot.

Num Days to Anthesis—

Calculated as the number of days from sowing till 50% of the plot arrive anthesis.

TABLE 41

Foxtail millet correlated parameters (vectors)

| Correlated parameter with | Correlation ID |
| --- | --- |
| Biomass at harvest (Kg) | 1 |
| Total heads weight (gr.) | 2 |
| Total dry matter (Kg) | 3 |
| Num days to Anthesis | 4 |

TABLE 41-continued

Foxtail millet correlated parameters (vectors)

| Correlated parameter with | Correlation ID |
|---|---|
| Grain width (cm) | 5 |
| Total Grains weight (gr) | 6 |
| Grains weight per Head (gr) | 7 |
| Head Area (cm$^2$) | 8 |
| Head length (cm) | 9 |
| Grain area (cm$^2$) | 10 |
| Grain length (cm) | 11 |
| Heads num | 12 |

Table 41. Provided are the foxtail millet correlated parameters.

Experimental Results 14 different foxtail millet accessions were grown and characterized for different parameters as described above. The average for each of the measured parameter was calculated using the JMP software and values are summarized in Tables 42-43 below. Subsequent correlation analysis between the various transcriptom sets and the average parameters was conducted (Table 44). Follow, results were integrated to the database.

TABLE 42

Measured parameters of correlation IDs in foxtail millet accessions under normal conditions

| Corr. ID | Ecotype | | | | | | |
|---|---|---|---|---|---|---|---|
| | Line-1 | Line-2 | Line-3 | Line-4 | Line-5 | Line-6 | Line-7 |
| 1 | 2.14 | 3.99 | 3.17 | 3.58 | 3.60 | 3.06 | 4.04 |
| 2 | 3.81 | 5.95 | 6.20 | 5.64 | 6.27 | 6.07 | 6.32 |
| 3 | 0.62 | 0.85 | 0.96 | 0.92 | 0.90 | 0.48 | 0.92 |
| 4 | 34.00 | 41.00 | 45.00 | 41.00 | 41.00 | 30.00 | 38.00 |
| 5 | 0.17 | 0.19 | 0.17 | 0.16 | 0.16 | 0.17 | 0.16 |
| 6 | 1449.63 | 1067.88 | 1302.82 | 1567.20 | 1794.80 | 1476.11 | 1582.57 |
| 7 | 3.40 | 7.29 | 1.49 | 1.30 | 1.57 | 0.69 | 2.10 |
| 8 | 37.83 | 57.87 | 19.59 | 17.10 | 19.76 | 9.42 | 22.92 |
| 9 | 23.13 | 24.25 | 17.56 | 14.79 | 15.38 | 8.56 | 16.08 |
| 10 | 0.03 | 0.04 | 0.03 | 0.03 | 0.03 | 0.03 | 0.03 |
| 11 | 0.24 | 0.24 | 0.25 | 0.25 | 0.26 | 0.25 | 0.23 |
| 12 | 427.60 | 149.20 | 867.00 | 1204.00 | 1146.40 | 2132.00 | 752.20 |

Table 42: Correlation IDs: 1, 2, 3, 4, 5, . . . etc. refer to those described in Table 41 above [Foxtail millet correlated parameters (vectors)].

TABLE 43

Measured parameters of correlation IDs in foxtail millet accessions under normal conditions

| Corr. ID | Ecotype | | | | | | |
|---|---|---|---|---|---|---|---|
| | Line-8 | Line-9 | Line-10 | Line-11 | Line-12 | Line-13 | Line-14 |
| 1 | 1.15 | 3.20 | 3.90 | 3.58 | 3.68 | 2.94 | 1.48 |
| 2 | 2.82 | 7.25 | 5.24 | 6.58 | 5.85 | 5.62 | 2.73 |
| 3 | 0.45 | 0.59 | 1.00 | 0.91 | 1.03 | 0.62 | 0.46 |
| 4 | 30.00 | 38.00 | 51.00 | 44.00 | 51.00 | 31.00 | 27.00 |
| 5 | 0.15 | 0.18 | 0.16 | 0.18 | 0.17 | 0.18 | 0.16 |
| 6 | 1317.88 | 2131.60 | 937.93 | 1880.21 | 1427.12 | 1216.24 | 1296.69 |
| 7 | 3.34 | 11.46 | 7.17 | 4.35 | 2.26 | 0.44 | 1.31 |
| 8 | 40.89 | 45.29 | 49.34 | 27.69 | 24.18 | 7.13 | 14.69 |
| 9 | 21.88 | 20.41 | 23.32 | 20.87 | 17.98 | 6.35 | 9.78 |
| 10 | 0.02 | 0.03 | 0.02 | 0.04 | 0.03 | 0.04 | 0.03 |
| 11 | 0.20 | 0.22 | 0.20 | 0.26 | 0.25 | 0.27 | 0.24 |
| 12 | 394.20 | 186.60 | 131.80 | 434.20 | 646.40 | 2797.80 | 994.60 |

Table 43: Correlation IDs: 1, 2, 3, 4, 5, . . . etc. refer to those described in Table 41 above [Foxtail millet correlated parameters (vectors)].

TABLE 44

Correlation between the expression level of selected genes of some embodiments of the invention in various tissues and the phenotypic performance under normal conditions across foxtail millet varieties

| Gene Name | R | P value | Exp. set | Corr. ID | Gene Name | R | P value | Exp. set | Corr. ID |
|---|---|---|---|---|---|---|---|---|---|
| LYM540 | 0.89 | 3.06E−03 | 6 | 7 | LYM540 | 0.76 | 2.91E−02 | 6 | 6 |
| LYM540 | 0.78 | 2.31E−02 | 6 | 5 | LYM540 | 0.81 | 1.41E−02 | 6 | 8 |
| LYM540 | 0.94 | 6.81E−05 | 4 | 7 | LYM540 | 0.73 | 1.66E−02 | 4 | 6 |
| LYM540 | 0.78 | 8.14E−03 | 4 | 8 | LYM540 | 0.75 | 8.07E−03 | 1 | 12 |
| LYM540 | 0.82 | 4.46E−02 | 2 | 3 | LYM540 | 0.71 | 1.16E−01 | 2 | 4 |
| LYM540 | 0.71 | 1.14E−01 | 2 | 1 | LYM540 | 0.79 | 5.91E−02 | 2 | 12 |
| LYM541 | 0.92 | 1.32E−03 | 6 | 3 | LYM541 | 0.80 | 1.78E−02 | 6 | 4 |
| LYM541 | 0.74 | 3.77E−02 | 6 | 1 | LYM541 | 0.72 | 1.90E−02 | 4 | 6 |
| LYM541 | 0.84 | 2.11E−03 | 4 | 9 | LYM541 | 0.88 | 9.15E−04 | 4 | 4 |
| LYM541 | 0.72 | 1.88E−02 | 4 | 8 | LYM541 | 0.81 | 4.21E−03 | 3 | 3 |
| LYM541 | 0.76 | 1.14E−02 | 3 | 9 | LYM541 | 0.97 | 6.12E−06 | 3 | 4 |
| LYM541 | 0.73 | 1.71E−02 | 3 | 1 | LYM543 | 0.98 | 2.70E−05 | 6 | 12 |
| LYM543 | 0.81 | 5.13E−02 | 2 | 7 | LYM544 | 0.74 | 1.43E−02 | 4 | 2 |
| LYM544 | 0.85 | 1.87E−03 | 4 | 4 | LYM544 | 0.78 | 7.74E−03 | 4 | 1 |
| LYM544 | 0.75 | 8.03E−03 | 1 | 11 | LYM544 | 0.70 | 2.29E−02 | 3 | 7 |
| LYM544 | 0.91 | 1.14E−02 | 2 | 11 | LYM544 | 0.91 | 1.16E−02 | 2 | 12 |
| LYM545 | 0.72 | 4.23E−02 | 6 | 2 | LYM545 | 0.76 | 2.76E−02 | 6 | 3 |
| LYM545 | 0.74 | 3.43E−02 | 6 | 6 | LYM545 | 0.72 | 4.33E−02 | 6 | 9 |
| LYM545 | 0.79 | 2.08E−02 | 6 | 1 | LYM545 | 0.76 | 1.08E−02 | 4 | 10 |
| LYM545 | 0.80 | 2.82E−03 | 1 | 2 | LYM545 | 0.72 | 1.17E−02 | 1 | 3 |
| LYM545 | 0.75 | 7.35E−03 | 1 | 4 | LYM545 | 0.80 | 3.35E−03 | 1 | 1 |

TABLE 44-continued

Correlation between the expression level of selected genes of some embodiments of the invention in various tissues and the phenotypic performance under normal conditions across foxtail millet varieties

| Gene Name | R | P value | Exp. set | Corr. ID | Gene Name | R | P value | Exp. set | Corr. ID |
|---|---|---|---|---|---|---|---|---|---|
| LYM545 | 0.72 | 1.91E−02 | 3 | 4 | LYM545 | 0.91 | 1.30E−02 | 2 | 9 |
| LYM545 | 0.75 | 8.38E−02 | 2 | 10 | LYM545 | 0.87 | 2.61E−02 | 2 | 5 |
| LYM545 | 0.91 | 1.16E−02 | 2 | 8 | LYM546 | 0.76 | 7.01E−03 | 1 | 10 |
| LYM546 | 0.80 | 3.18E−03 | 1 | 5 | LYM546 | 0.91 | 1.12E−02 | 2 | 9 |
| LYM546 | 0.74 | 9.19E−02 | 2 | 5 | LYM546 | 0.82 | 4.73E−02 | 2 | 8 |
| LYM547 | 0.72 | 1.87E−02 | 4 | 7 | LYM547 | 0.73 | 1.73E−02 | 4 | 9 |
| LYM547 | 0.73 | 1.55E−02 | 4 | 4 | LYM547 | 0.79 | 6.72E−03 | 4 | 8 |
| LYM547 | 0.85 | 1.85E−03 | 3 | 6 | LYM547 | 0.76 | 1.13E−02 | 3 | 4 |
| LYM547 | 0.88 | 2.22E−02 | 2 | 7 | LYM547 | 0.76 | 8.00E−02 | 2 | 9 |
| LYM547 | 0.78 | 6.64E−02 | 2 | 5 | LYM547 | 0.79 | 5.96E−02 | 2 | 8 |
| LYM548 | 0.87 | 5.40E−03 | 6 | 7 | LYM548 | 0.90 | 2.59E−03 | 6 | 6 |
| LYM548 | 0.81 | 1.38E−02 | 6 | 8 | LYM548 | 0.74 | 1.45E−02 | 4 | 3 |
| LYM548 | 0.89 | 5.83E−04 | 4 | 1 | LYM548 | 0.83 | 2.95E−03 | 3 | 10 |
| LYM548 | 0.73 | 1.01E−01 | 2 | 12 | LYM549 | 0.86 | 5.96E−03 | 6 | 7 |
| LYM549 | 0.73 | 1.75E−02 | 4 | 1 | LYM549 | 0.71 | 1.46E−02 | 1 | 11 |
| LYM549 | 0.84 | 1.23E−03 | 1 | 10 | LYM549 | 0.80 | 5.52E−02 | 2 | 11 |
| LYM549 | 0.72 | 1.04E−01 | 2 | 9 | LYM549 | 0.91 | 1.29E−02 | 2 | 10 |
| LYM549 | 0.82 | 4.33E−02 | 2 | 12 | LYM549 | 0.81 | 5.31E−02 | 2 | 5 |
| LYM549 | 0.79 | 6.32E−02 | 2 | 8 | LYM550 | 0.74 | 1.51E−02 | 3 | 6 |
| LYM550 | 0.82 | 4.56E−02 | 2 | 4 | LYM555 | 0.75 | 1.16E−02 | 4 | 7 |
| LYM555 | 0.74 | 1.54E−02 | 4 | 8 | LYM555 | 0.72 | 1.19E−02 | 1 | 3 |
| LYM555 | 0.78 | 7.57E−03 | 3 | 6 | LYM555 | 0.70 | 2.29E−02 | 3 | 5 |
| LYM555 | 0.80 | 5.75E−02 | 2 | 2 | LYM555 | 0.84 | 3.56E−02 | 2 | 7 |
| LYM555 | 0.72 | 1.03E−01 | 2 | 9 | LYM555 | 0.86 | 2.66E−02 | 2 | 5 |
| LYM555 | 0.86 | 2.76E−02 | 2 | 8 | LYM564 | 0.95 | 1.92E−05 | 4 | 7 |
| LYM564 | 0.78 | 8.27E−03 | 4 | 6 | LYM564 | 0.74 | 1.40E−02 | 4 | 8 |
| LYM564 | 0.71 | 1.16E−01 | 2 | 2 | | | | | |

Table 44. Provided are the correlations (R) between the expression levels yield improving genes and their homologues in various tissues [Expression (Exp) sets] and the phenotypic performance [yield, biomass, growth rate and/or vigor components (Correlation vector (Corr) according to Table 41)] under normal, low nitrogen and drought conditions across foxtail millet varieties. P = p value.

Example 11

Production of Soybean (*Glycine Max*) Transcriptom and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [Hypertext Transfer Protocol://World Wide Web(dot) chem.(dot)agilent(dot)com/Scripts/PDS(dot)asp?1Page= 50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 12 varieties were further used for RNA expression analysis. The correlation between the RNA levels and the characterized parameters was analyzed using Pearson correlation test.

Correlation of *Glycine max* Genes' Expression Levels with Phenotypic Characteristics Across Ecotype Experimental Procedures 29 Soybean varieties were grown in three repetitive plots, in field. Briefly, the growing protocol was as follows: Soybean seeds were sown in soil and grown under normal conditions until harvest. In order to define correlations between the levels of RNA expression with yield components or plant architecture related parameters or vigor related parameters, 12 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

RNA Extraction—

All 12 selected Soybean varieties were sampled per treatment. Plant tissues [leaf, root, stem, pod, apical meristem, flower buds] growing under normal conditions were sampled and RNA was extracted as described above.

The collected data parameters were as follows:

Main Branch Base Diameter [Mm] at Pod Set—
the diameter of the base of the main branch (based diameter) average of three plants per plot.

Fresh Weight [gr./Plant] at Pod Set—
total weight of the vegetative portion above ground (excluding roots) before drying at pod set, average of three plants per plot.

Dry Weight [gr./Plant] at Pod Set—
total weight of the vegetative portion above ground (excluding roots) after drying at 70° C. in oven for 48 hours at pod set, average of three plants per plot.

Total Number of Nodes with Pods on Lateral Branches [Value/Plant]—
counting of nodes which contain pods in lateral branches at pod set, average of three plants per plot.

Number of Lateral Branches at Pod Set [Value/Plant]—
counting number of lateral branches at pod set, average of three plants per plot.

Total Weight of Lateral Branches at Pod Set [gr./Plant]—
weight of all lateral branches at pod set, average of three plants per plot.

Total Weight of Pods on Main Stem at Pod Set [gr./Plant]—
weight of all pods on main stem at pod set, average of three plants per plot.

Total Number of Nodes on Main Stem [Value/Plant]—
count of number of nodes on main stem starting from first node above ground, average of three plants per plot.

Total Number of Pods with 1 Seed on Lateral Branches at Pod Set [Value/Plant]—
count of the number of pods containing 1 seed in all lateral branches at pod set, average of three plants per plot.

Total Number of Pods with 2 Seeds on Lateral Branches at Pod Set [Value/Plant]—
count of the number of pods containing 2 seeds in all lateral branches at pod set, average of three plants per plot.

Total Number of Pods with 3 Seeds on Lateral Branches at Pod Set [Value/Plant]—
count of the number of pods containing 3 seeds in all lateral branches at pod set, average of three plants per plot.

Total Number of Pods with 4 Seeds on Lateral Branches at Pod Set [Value/Plant]—
count of the number of pods containing 4 seeds in all lateral branches at pod set, average of three plants per plot.

Total Number of Pods with 1 Seed on Main Stem at Pod Set [Value/Plant]—
count of the number of pods containing 1 seed in main stem at pod set, average of three plants per plot.

Total Number of Pods with 2 Seeds on Main Stem at Pod Set [Value/Plant]—
count of the number of pods containing 2 seeds in main stem at pod set, average of three plants per plot.

Total Number of Pods with 3 Seeds on Main Stem at Pod Set [Value/Plant]—
count of the number of pods containing 3 seeds in main stem at pod set, average of three plants per plot.

Total Number of Pods with 4 Seeds on Main Stem at Pod Set [Value/Plant]—
count of the number of pods containing 4 seeds in main stem at pod set, average of three plants per plot.

Total Number of Seeds Per Plant at Pod Set [Value/Plant]—
count of number of seeds in lateral branches and main stem at pod set, average of three plants per plot.

Total Number of Seeds on Lateral Branches at Pod Set [Value/Plant]—
count of total number of seeds on lateral branches at pod set, average of three plants per plot.

Total Number of Seeds on Main Stem at Pod Set [Value/Plant]—
count of total number of seeds on main stem at pod set, average of three plants per plot.

Plant Height at Pod Set [Cm/Plant]—
total length from above ground till the tip of the main stem at pod set, average of three plants per plot.

Plant Height at Harvest [Cm/Plant]—
total length from above ground till the tip of the main stem at harvest, average of three plants per plot.

Total Weight of Pods on Lateral Branches at Pod Set [gr./Plant]—
weight of all pods on lateral branches at pod set, average of three plants per plot.

Ratio of the Number of Pods Per Node on Main Stem at Pod Set—
calculated in formula XVIII, average of three plants per plot.

$$\text{Total number of pods on main stem/Total number of nodes on main stem, average of three plants per plot.} \quad \text{Formula XVIII:}$$

Ratio of Total Number of Seeds in Main Stem to Number of Seeds on Lateral Branches—
calculated in formula XIX, average of three plants per plot.

$$\text{Total number of seeds on main stem at pod set/Total number of seeds on lateral branches at pod set.} \quad \text{Formula XIX:}$$

Total Weight of Pods Per Plant at Pod Set [Gr./Plant]—
weight of all pods on lateral branches and main stem at pod set, average of three plants per plot.

Days Till 50% Flowering [Days]—
number of days till 50% flowering for each plot.

Days Till 100% Flowering [Days]—
number of days till 100% flowering for each plot.

Maturity [Days]—
measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, Hypertext Transfer Protocol://World Wide Web(dot)ars-grin(dot)gov/cgi-bin/npgs/html/desclist(dot)pl?51].

Seed Quality [Ranked 1-5]—
measure at harvest; a visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [Ranked 1-5]—
is rated at maturity per plot according to the following scores: 1-most plants in a plot are erected; 2-all plants leaning slightly or a few plants down; 3-all plants leaning moderately, or 25%-50% down; 4-all plants leaning considerably, or 50%-80% down; 5-most plants down. Note: intermediate score such as 1.5 are acceptable.

Seed Size [gr.]—
weight of 1000 seeds per plot normalized to 13% moisture, measure at harvest.

Total Weight of Seeds Per Plant [gr./Plant]—
calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Experimental Results

Twelve different Soybean varieties (i.e., V00-3636, V03-1754, V06-1365, V06-7487, V07-7840, V07-8022, V07-8309, V07-8393, V07-8515, V07-8782, V04-7750, V05-5973) were grown and characterized for 34 parameters as specified above. The average for each of the measured parameters was calculated using the JMP software and values are summarized in Tables 45-50 below.

TABLE 45

Measured parameters in Soybean varieties

| GERMPLASM IDENTIFI-CATION | 50% flowering | Maturity | 100% flowering | Plant height at harvest | Seed quality | Total weight of seeds per plant |
|---|---|---|---|---|---|---|
| V00-3636 | 61.00 | 24.00 | 67.33 | 96.67 | 2.33 | 15.09 |
| V03-1754 | 65.33 | 43.67 | 71.67 | 76.67 | 3.50 | 10.50 |
| V04-7750 | 60.67 | 30.33 | 67.67 | 67.50 | 3.00 | 17.23 |
| V05-5973 | 61.00 | 30.33 | 67.33 | 75.83 | 2.17 | 16.51 |
| V06-1365 | 54.67 | 38.33 | 60.00 | 74.17 | 2.83 | 12.06 |
| V06-7487 | 68.33 | 40.00 | 74.00 | 76.67 | 2.00 | 10.25 |
| V07-7840 | 66.50 | 41.00 | 73.00 | 101.67 | 3.50 | 7.30 |
| V07-8022 | 65.67 | 38.33 | 72.33 | 98.33 | 2.50 | 11.38 |
| V07-8309 | 62.33 | 31.00 | 68.67 | 75.83 | 2.17 | 15.68 |
| V07-8393 | 67.67 | 39.00 | 73.67 | 116.67 | 2.33 | 10.83 |
| V07-8515 | 61.67 | 27.33 | 68.00 | 76.67 | 2.17 | 12.98 |
| V07-8782 | 64.33 | 32.67 | 70.67 | 71.67 | 2.17 | 15.16 |

Table 45. Provided are the measured parameters in Soybean varieties.

TABLE 46

Additional measured parameters in Soybean varieties

| GERMPLASM IDENTIFI-CATION | Seed size | Seed size corrected | Lodging | yield at harvest | Base diameter at pod set | DW at podset |
|---|---|---|---|---|---|---|
| V00-3636 | 89.00 | 89.00 | 1.67 | 47.57 | 8.33 | 53.67 |
| V03-1754 | 219.33 |  | 1.83 | 43.77 | 9.54 | 50.33 |
| V04-7750 | 93.00 | 93.00 | 1.17 | 50.37 | 9.68 | 38.00 |
| V05-5973 | 86.00 | 86.00 | 1.67 | 56.30 | 8.11 | 46.17 |
| V06-1365 | 191.33 |  | 2.67 | 44.00 | 8.82 | 60.83 |
| V06-7487 | 71.33 | 71.33 | 2.83 | 40.33 | 10.12 | 55.67 |
| V07-7840 | 88.00 | 88.00 | 2.67 | 34.23 | 8.46 | 48.00 |
| V07-8022 | 75.00 | 75.00 | 2.50 | 44.27 | 8.09 | 52.00 |
| V07-8309 | 80.67 | 80.67 | 1.83 | 53.67 | 8.26 | 44.17 |
| V07-8393 | 75.67 | 75.67 | 3.50 | 42.47 | 7.73 | 52.67 |
| V07-8515 | 76.33 | 76.33 | 3.33 | 43.60 | 8.16 | 56.00 |
| V07-8782 | 77.33 | 77.33 | 1.50 | 52.20 | 7.89 | 47.50 |

Table 46. Provided are the measured parameters in Soybean varieties. "DW" = dry weight.

TABLE 47

Additional measured parameters in Soybean varieties

| GERMPLASM IDENTIFI-CATION | fresh weight at pod set | Total number of nodes with pods on lateral branches | Number of lateral branches | Total weight of lateral branches at pod set | Total weight of pods on main stem at pod set | Total number of nodes on main stem |
|---|---|---|---|---|---|---|
| V00-3636 | 170.89 | 23.00 | 9.00 | 67.78 | 22.11 | 16.56 |
| V03-1754 | 198.22 | 16.00 | 8.67 | 63.78 | 14.33 | 16.78 |
| V04-7750 | 152.56 | 23.11 | 9.11 | 64.89 | 16.00 | 16.11 |
| V05-5973 | 163.89 | 33.00 | 9.89 | 74.89 | 15.00 | 18.11 |
| V06-1365 | 224.67 | 15.22 | 7.67 | 54.00 | 33.78 | 16.78 |
| V06-7487 | 265.00 | 45.25 | 17.56 | 167.22 | 9.00 | 17.11 |
| V07-7840 | 160.67 | 8.25 | 11.67 | 45.44 | 9.03 | 18.78 |
| V07-8022 | 196.33 | 25.44 | 12.11 | 83.22 | 16.00 | 18.89 |
| V07-8309 | 155.33 | 21.88 | 8.00 | 64.33 | 15.89 | 16.78 |
| V07-8393 | 178.11 | 16.33 | 9.11 | 52.00 | 14.56 | 21.11 |
| V07-8515 | 204.44 | 22.56 | 6.78 | 76.89 | 30.44 | 19.33 |
| V07-8782 | 164.22 | 24.22 | 10.00 | 67.00 | 18.00 | 20.78 |

Table 47. Provided are the measured parameters in Soybean varieties.

TABLE 48

Additional measured parameters in Soybean varieties

| GERMPLASM IDENTIFI-CATION | Total no. of pods with 1 seed on lateral branch | Number of pods with 1 seed on main stem at pod set | Total no. of pods with 2 seed on lateral branch | Number of pods with 2 seed on main stem | Total no. of pods with 3 seed on lateral branch | Number of pods with 3 seed on main stem |
|---|---|---|---|---|---|---|
| V00-3636 | 1.56 | 1.11 | 17.00 | 16.89 | 38.44 | 29.56 |
| V03-1754 | 3.00 | 4.38 | 18.75 | 16.25 | 2.00 | 1.75 |
| V04-7750 | 1.78 | 1.44 | 26.44 | 13.22 | 26.44 | 19.78 |
| V05-5973 | 1.78 | 1.44 | 32.33 | 16.89 | 31.33 | 22.33 |
| V06-1365 | 5.67 | 4.56 | 21.56 | 27.00 | 8.89 | 11.67 |
| V06-7487 | 5.63 | 1.67 | 33.50 | 8.11 | 82.00 | 22.78 |
| V07-7840 | 2.88 | 4.00 | 8.50 | 21.33 | 9.00 | 11.11 |
| V07-8022 | 3.00 | 4.33 | 22.78 | 17.67 | 42.11 | 28.22 |
| V07-8309 | 1.25 | 2.11 | 21.75 | 20.33 | 32.75 | 24.11 |
| V07-8393 | 2.67 | 1.89 | 10.67 | 16.11 | 25.67 | 36.44 |
| V07-8515 | 1.78 | 3.44 | 23.78 | 28.11 | 45.00 | 39.67 |
| V07-8782 | 3.00 | 1.22 | 25.67 | 16.56 | 44.33 | 32.33 |

Table 48. Provided are the measured parameters in Soybean varieties.

TABLE 49

Additional measured parameters in Soybean varieties

| GERMPLASM IDENTIFI-CATION | Total no. of pods with 4 seed on lateral branch | Number of pods with 4 seed on main stem | Total number of seeds per plant | Total Number of Seeds on lateral branches | Total Number of Seeds on main stem at pod set | Plant height at pod set |
|---|---|---|---|---|---|---|
| V00-3636 | 0.00 | 0.00 | 274.44 | 150.89 | 123.56 | 86.78 |
| V03-1754 | 0.00 | 0.00 | 99.78 | 55.89 | 43.89 | 69.56 |
| V04-7750 | 0.00 | 0.11 | 221.67 | 134.00 | 87.67 | 62.44 |
| V05-5973 | 0.00 | 0.11 | 263.11 | 160.44 | 102.67 | 70.89 |
| V06-1365 | 0.00 | 0.00 | 169.00 | 75.44 | 93.56 | 69.44 |
| V06-7487 | 1.50 | 0.44 | 412.50 | 324.63 | 88.00 | 63.89 |
| V07-7840 | 0.00 | 0.00 | 136.00 | 46.88 | 80.00 | 89.78 |
| V07-8022 | 0.33 | 0.56 | 302.78 | 176.22 | 126.56 | 82.11 |
| V07-8309 | 0.00 | 0.00 | 260.50 | 143.00 | 115.11 | 70.56 |
| V07-8393 | 1.11 | 3.89 | 264.44 | 105.44 | 159.00 | 101.67 |
| V07-8515 | 0.00 | 0.00 | 363.00 | 184.33 | 178.67 | 79.56 |
| V07-8782 | 0.00 | 0.00 | 318.67 | 187.33 | 131.33 | 67.22 |

Table 49. Provided are the measured parameters in Soybean varieties.

TABLE 50

Additional measured parameters in Soybean varieties

| GERM-PLASM IDENTIFI-CATION | Total weight of pods on lateral branches | Ratio number of pods per node on main stem | Ratio number of seeds per main stem to seeds per lateral branches | Total weight of pods per plant |
|---|---|---|---|---|
| V00-3636 | 26.00 | 2.87 | 0.89 | 48.11 |
| V03-1754 | 14.89 | 1.38 | 0.90 | 29.22 |
| V04-7750 | 20.11 | 2.13 | 0.87 | 36.11 |
| V05-5973 | 20.11 | 2.26 | 0.89 | 35.11 |
| V06-1365 | 21.11 | 2.60 | 2.32 | 54.89 |
| V06-7487 | 30.25 | 1.87 | 0.37 | 38.88 |
| V07-7840 | 4.13 | 1.98 | 3.90 | 14.25 |
| V07-8022 | 20.11 | 2.71 | 0.78 | 36.11 |
| V07-8309 | 17.00 | 2.78 | 1.18 | 32.75 |
| V07-8393 | 9.22 | 2.75 | 1.98 | 23.78 |
| V07-8515 | 28.11 | 3.70 | 1.03 | 58.56 |
| V07-8782 | 22.56 | 2.84 | 0.83 | 40.56 |

Table 50. Provided are the values of each of the parameters (as described above) measured in Soybean varieties under normal conditions.

Example 12

Gene Cloning and Generation of Binary Vectors for Plant Expression

To validate their role in improving plant yield, oil content, seed yield, biomass, growth rate, fiber yield, fiber quality, ABST, NUE and/or vigor, selected genes were over-expressed in plants, as follows.

Cloning Strategy

Selected genes from those listed in Examples 1-11 hereinabove are cloned into binary vectors for the generation of transgenic plants. For cloning, the full-length open reading frame (ORF) was first identified. In case of ORF-EST clusters and in some cases already published mRNA sequences were analyzed to identify the entire open reading frame by comparing the results of several translation algorithms to known proteins from other plant species. To clone the full-length cDNAs, reverse transcription (RT) followed by polymerase chain reaction (PCR; RT-PCR) was performed on total RNA extracted from leaves, flowers, siliques or other plant tissues, growing under normal and different treated conditions. Total RNA was extracted as described in "GENERAL EXPERIMENTAL AND BIOINFORMATICS METHODS" above. Production of cDNA and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.), which are well known to those skilled in the art. PCR products were purified using PCR purification kit (Qiagen). In case where the entire coding sequence was not found, RACE kit from Invitrogen (RACE=Rapid Amplification of cDNA Ends) was used to access the full cDNA transcript of the gene from the RNA samples described above. RACE products were cloned into high copy vector followed by sequencing or directly sequenced.

The information from the RACE procedure was used for cloning of the full length ORF of the corresponding genes.

In case genomic DNA was cloned, the genes were amplified by direct PCR on genomic DNA extracted from leaf tissue using the DNAeasy kit (Qiagen Cat. No. 69104).

Usually, 2 sets of primers were synthesized for the amplification of each gene from a cDNA or a genomic sequence; an external set of primers and an internal set (nested PCR primers). When needed (e.g., when the first PCR reaction does not result in a satisfactory product for sequencing), an additional primer (or two) of the nested PCR primers was used.

To facilitate cloning of the cDNAs/genomic sequences, an 8-12 bp extension was added to the 5' of each primer. The primer extension includes an endonuclease restriction site. The restriction sites were selected using two parameters: (a). The site does not exist in the cDNA sequence; and (b). The restriction sites in the forward and reverse primers are designed such that the digested cDNA is inserted in the sense formation into the binary vector utilized for transformation.

Each digested PCR product was inserted into a high copy vector pUC19 (New England BioLabs Inc], or into plasmids originating from this vector. In some cases the undigested PCR product is inserted into pCR-Blunt II-TOPO (Invitrogen).

Sequencing of the amplified PCR products was performed, using ABI 377 sequencer (Amersham Biosciences Inc). In some cases, after confirming the sequences of the cloned genes, the cloned cDNA was introduced into a modified pGI binary vector containing the At6669 promoter via digestion with appropriate restriction endonucleases. In any case the insert is followed by single copy of the NOS terminator (SEQ ID NO:8543). The digested products and the linearized plasmid vector were ligated using T4 DNA ligase enzyme (Roche, Switzerland).

High copy plasmids containing the cloned genes were digested with the restriction endonucleases (New England BioLabs Inc) according to the sites designed in the primers and cloned into binary vectors.

Several DNA sequences of the selected genes were synthesized by a commercial supplier GeneArt [Hypertext Transfer Protocol://World Wide Web(dot)geneart(dot)com/]. Synthetic DNA was designed in silico. Suitable restriction enzymes sites were added to the cloned sequences at the 5' end and at the 3' end to enable later cloning into the pQFNc binary vector downstream of the At6669 promoter (SEQ ID NO: 8529).

Binary Vectors Used for Cloning:

The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, Acc. No. U12640). pGI (pBXYN) is similar to pPI, but the original gene in the backbone, the GUS gene, was replaced by the GUS-Intron gene followed by the NOS terminator (SEQ ID NO:8543) (Vancanneyt. G, et al MGG 220, 245-50, 1990). pGI was used in the past to clone the polynucleotide sequences, initially under the control of 35S promoter [Odell, J T, et al. Nature 313, 810-812 (28 Feb. 1985); SEQ ID NO:8527].

Figure 2:
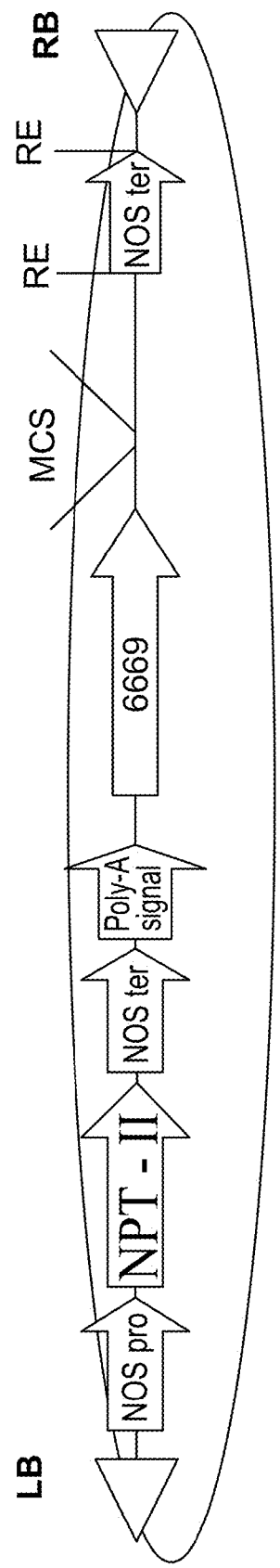
FIG. 2 is a schematic illustration of the modified pGI binary plasmid containing the new At6669 promoter (SEQ ID NO: 8529) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.
Figure 3A:
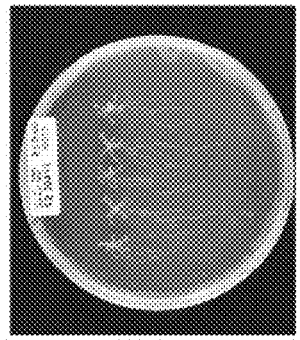
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
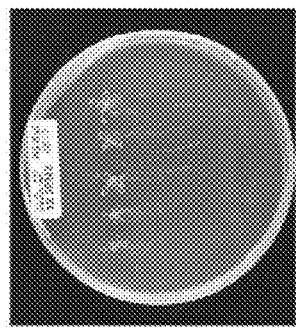
Figure 3E:
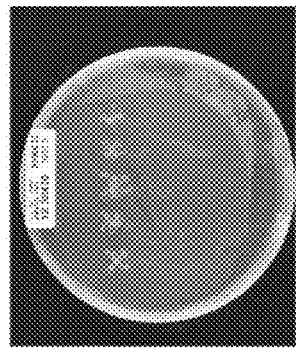
Figure 3B:
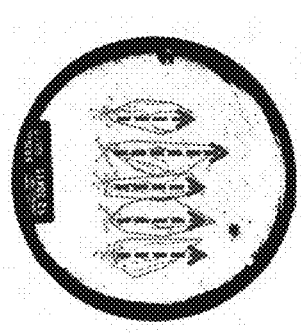
Figure 3D:
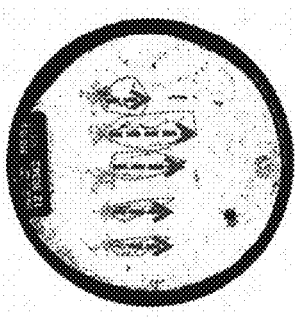
Figure 3F:
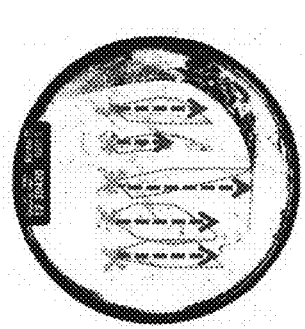
Figure 4:
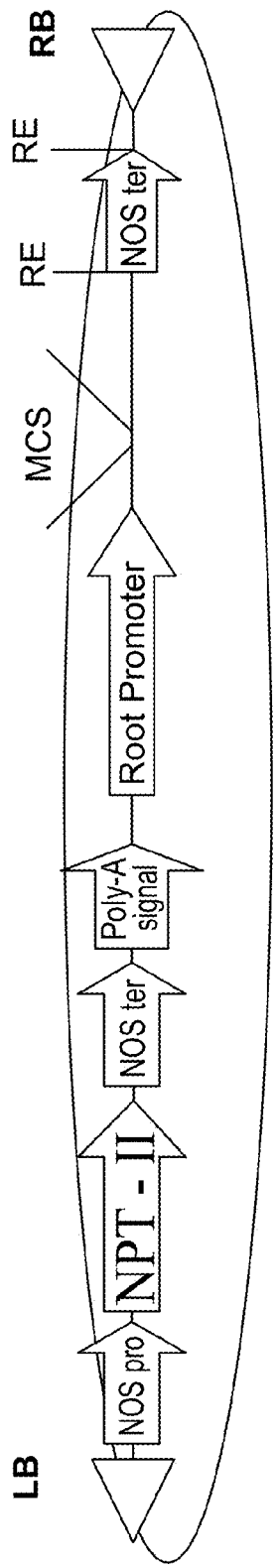
FIG. 4 is a schematic illustration of the modified pGI binary plasmid containing the Root Promoter (pQNa RP; SEQ ID NO: 8541) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal), The isolated polynucleotide sequences according to some embodiments of the invention were cloned into the MCS of the vector.
Figure 5:
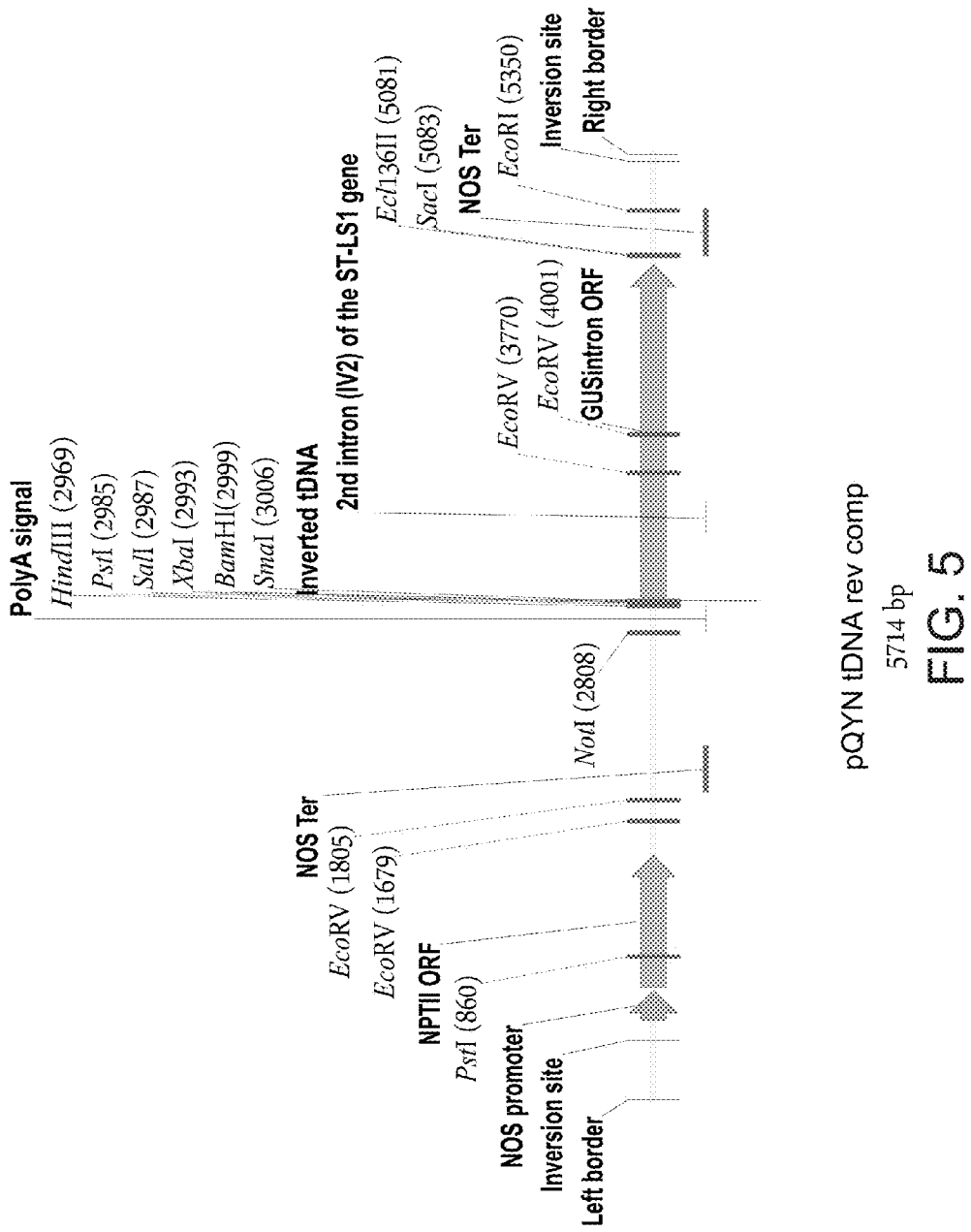
FIG. 5 is a schematic illustration of the pQYN plasmid.
Figure 6:
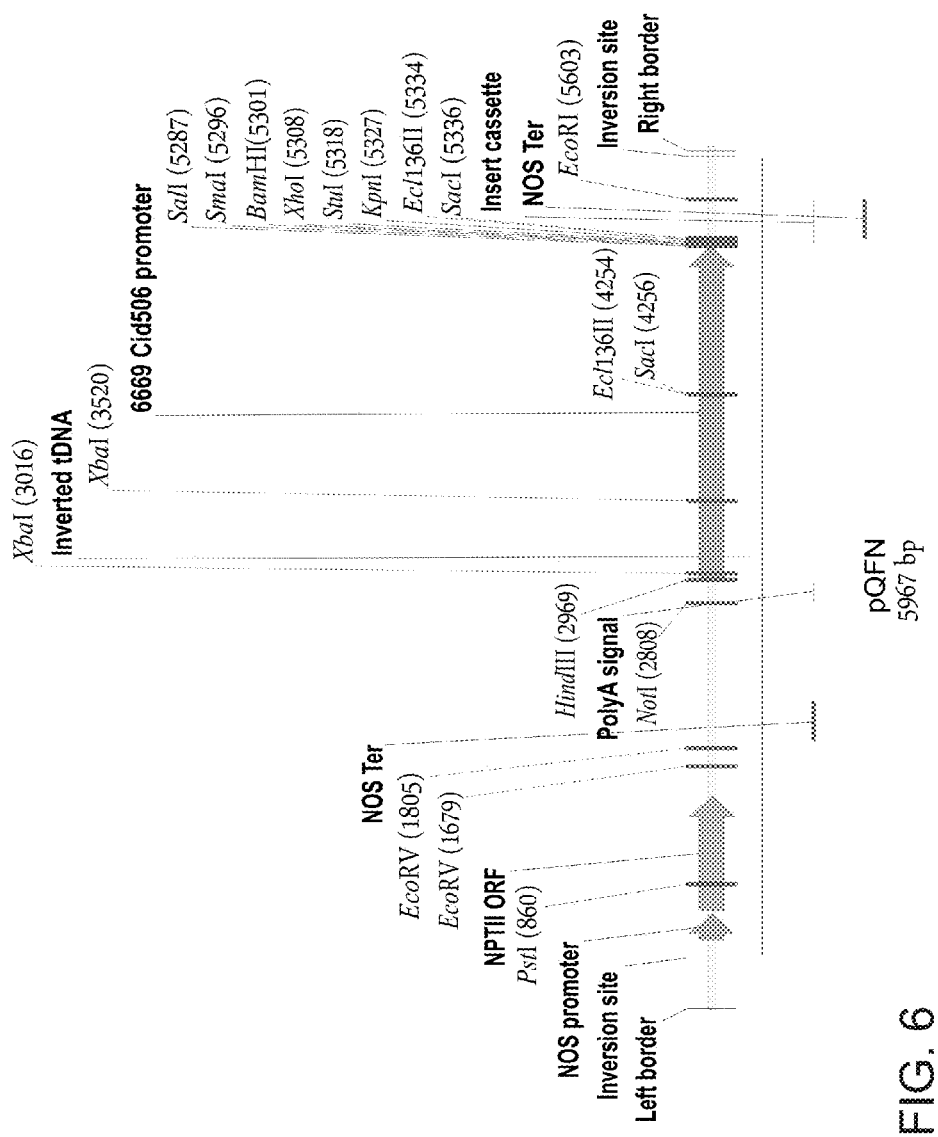
FIG. 6 is a schematic illustration of the pQFN plasmid.
Figure 7:
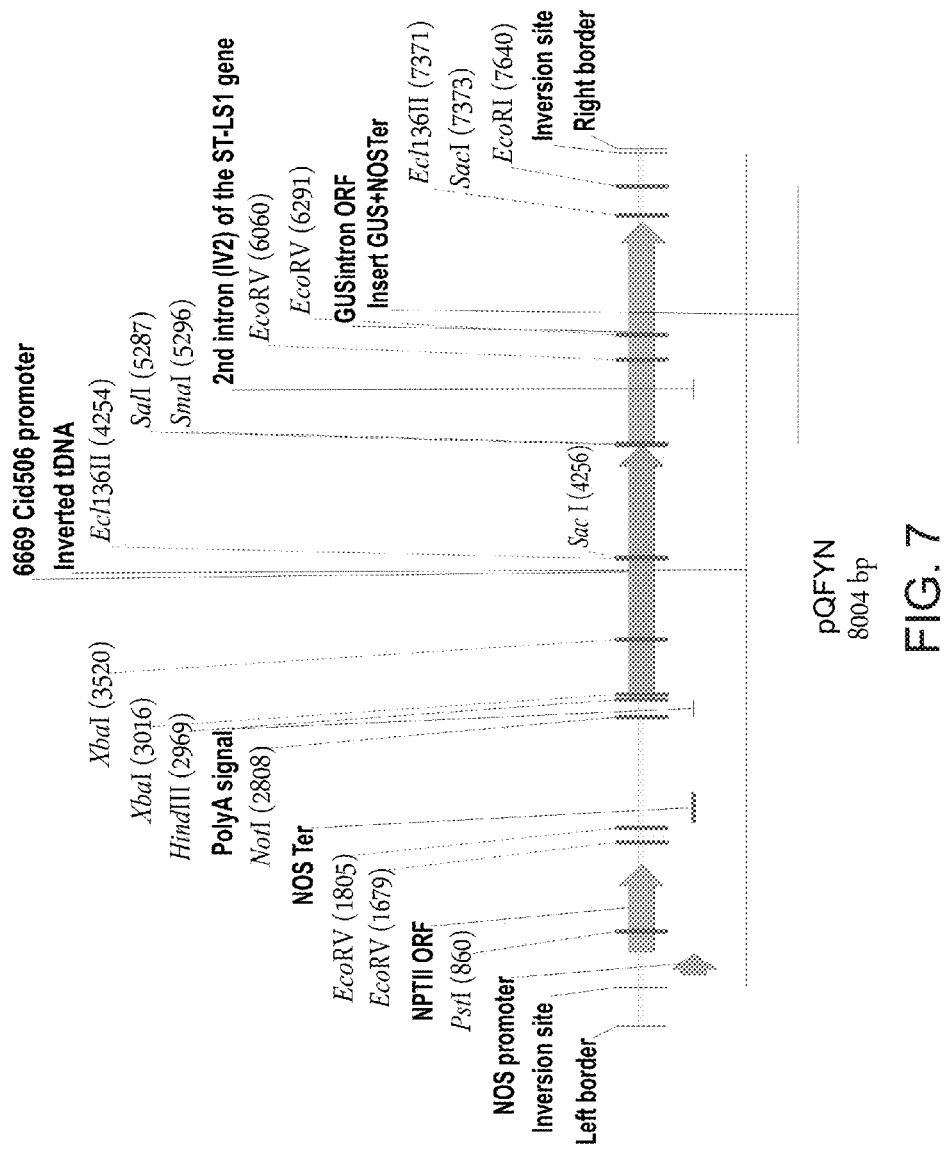
FIG. 7 is a schematic illustration of the pQFYN plasmid.
Figure 8:
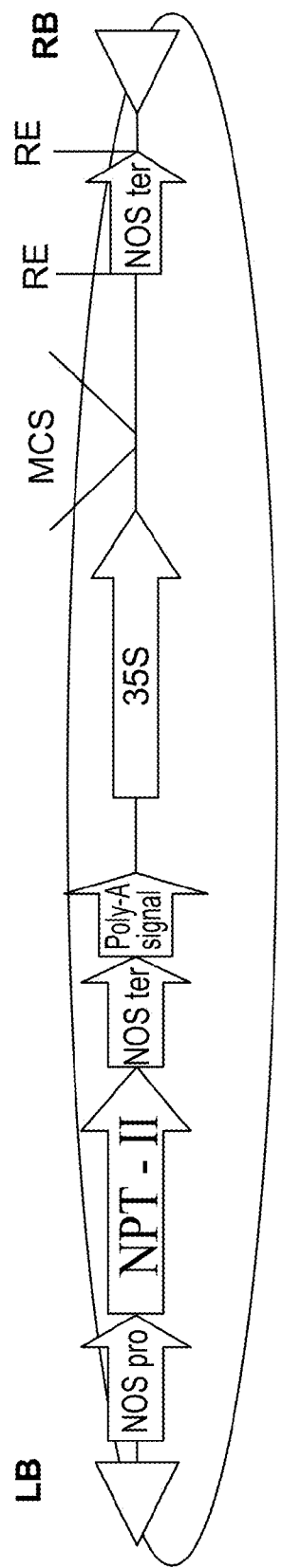
FIG. 8 is a schematic illustration of pQXNc plasmid, which is a modified pGI binary plasmid used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (SEQ ID NO:8525). The isolated polynucleotide sequences of some embodiments of the invention were cloned into the MCS (Multiple cloning site) of the vector.

The modified pGI vectors [pQXNc (FIG. 8); or pQFN (FIG. 2), pQFNc (FIG. 2) or pQYN 6669 (FIG. 1)] are modified versions of the pGI vector in which the cassette was inverted between the left and right borders so the gene and its corresponding promoter are close to the right border and the NPTII gene is close to the left border.

At6669, the *Arabidopsis thaliana* promoter sequence (SEQ ID NO:8529) was inserted in the modified pGI binary vector, upstream to the cloned genes, followed by DNA ligation and binary plasmid extraction from positive *E. coli* colonies, as described above.

Colonies were analyzed by PCR using the primers covering the insert which were designed to span the introduced promoter and gene. Positive plasmids were identified, isolated and sequenced.

Cloning of Genes with a Signal Peptide which Directs Expression of the Gene in *Arabidopsis* Plants:

Two genes (LYM670 and LYM721) were found by bioinformatics analysis to have a biological function in the chloroplast of Maize (LYM670) and *Sorghum* (LYM721). In order to express the genes in the chloroplasts of *Arabidopsis* plants, a signal peptide which directs expression of a polypeptide into *Arabidopsis* chloroplast was inserted into the sequence, by replacing the initiator Methionine coding sequence. The *Arabidopsis* signal peptide that was used is provided by SEQ ID NO: 9179 (MASSMLSSATMVAS-PAQATMVAPFNGLKSSAAFPATRKANNDITSITSNG-GRV NC) and is encoded by SEQ ID NO: 9178 (5'-ATGGCTTCCTCTATGCTCTCTTCCGCTACTATGGTT-GCCTCTCCGGCTCAGGC CACTATGGTCGCTC-CTTTCAACGGACTTAAGTCCTCCGCTGCCTTCCCA-GCC ACCCGCAAGGCTAACAACGACATTACTTCCAT-CACAAGCAACGGCGGAAGA GTTAACTGC). It should be noted that for expression of this genes in the chloroplast of other target plants, alternative signal peptides may be used, based on the target plants.

In addition, LYM745 gene, which is another chloroplast specific gene, was found to be conserved with a start codon of ACG (on the DNA level) yet with a Methionine as the first amino acid on the protein level. The gene was therefore cloned into a plant with the ACG as the initiation codon (the sequence was chemically synthesized by Gene_Art).

Selected genes cloned by the present inventors are provided in Table 51 below.

TABLE 51

| | Genes cloned in high copy number plasmids | | | |
|---|---|---|---|---|
| Gene Name | High copy plasmid | Primers used SEQ ID NOs: | Polyn. SEQ ID NO: | Polyp. SEQ ID NO: |
| LYM521 | pUCl9c_LYM521 | 8544, 8736, 8544, 8736 | 278 | 480 |
| LYM522 | pUCl9c_LYM522 | 8545, 8737, 8928, 9010 | 279 | 734 |
| LYM523 | pUCl9c_LYM523 | 8546, 8738, 8546, 8738 | 280 | 735 |
| LYM524 | pUCl9c_LYM524 | 8547, 8739, 8547, 8739 | 281 | 483 |

TABLE 51-continued

Genes cloned in high copy number plasmids

| Gene Name | High copy plasmid | Primers used SEQ ID NOs: | Polyn. SEQ ID NO: | Polyp. SEQ ID NO: |
|---|---|---|---|---|
| LYM525 | pUCl9c_LYM525 | 8548, 8740 | 282 | 484 |
| LYM526 | pUCl9c_LYM526 | 8549, 874 | 283 | 485 |
| LYM527 | pUCl9c_LYM527 | 8550, 8742 | 284 | 486 |
| LYM528 | pUC19_LYM528 | 8551, 8743, 8551, 9011 | 285 | 736 |
| LYM529 | pMA_LYM529_GA | GeneArt | 286 | 488 |
| LYM531_H6 | pMA_LYM531_H6_GA | GeneArt | 477 | 693 |
| LYM532 | pUCl9c_LYM532 | 8552, 874 | 287 | 491 |
| LYM533 | pUCl9c_LYM533 | 8553, 8745, 8929, 9012 | 288 | 492 |
| LYM535 | pUCl9c_LYM535 | 8554, 8746, 8930, 9013 | 289 | 493 |
| LYM536 | pUCl9d_LYM536 | 8555, 8747, 8555, 8747 | 290 | 494 |
| LYM537 | pQFNc_LYM537 | 8556, 8748, 8556, 8748 | 291 | 495 |
| LYM538 | pUCl9c_LYM538 | 8557, 8749, 8557, 8749 | 292 | 496 |
| LYM539 | pUCl9c_LYM539 | 8558, 8750, 8558, 8750 | 293 | 497 |
| LYM540 | pUC19c_LYM540 | 8559, 8751, 8559, 8751 | 294 | 498 |
| LYM541 | pUCl9c_LYM541 | 8560, 8752 | 295 | 499 |
| LYM543 | pUCl9c_LYM543 | 8561, 8753, 8931, 9014 | 296 | 737 |
| LYM544 | pUCl9c_LYM544 | 8562, 8754 | 297 | 738 |
| LYM545 | pUCl9c_LYM545_9 | 8563, 8755, 8932, 9015 | 298 | 502 |
| LYM546 | pUCl9c_LYM546 | 8564, 8756, 8933, 8756 | 299 | 739 |
| LYM548 | pUCl9c_LYM548 | 8565, 8757, 8565, 8757 | 300 | 740 |
| LYM549 | pUCl9c_LYM549 | 8566, 8758, 8566, 8758 | 301 | 506 |
| LYM550 | pUC19c_LYM550 | 8567, 8759, 8934, 9016 | 302 | 507 |
| LYM552 | pQFNc_LYM552 | 8568, 8760, 8568, 8760 | 303 | 741 |
| LYM553 | pUC19_LYM553 | 8569, 8761, 8569, 8761 | 304 | 509 |
| LYM554 | pQFNc_LYM554 | 8570, 8762, 8935, 8762 | 305 | 510 |
| LYM555 | pUCl9c_LYM555 | 8571, 8763, 8936, 9017 | 306 | 511 |
| LYM557 | pUCl9c_LYM557 | 8572, 8764, 8937, 8764 | 307 | 513 |
| LYM558 | pUCl9c_LYM558 | 8573, 8765, 8938, 9018 | 308 | 514 |
| LYM559 | pUC19_LYM559 | 8574, 8766, 8574, 8766 | 309 | 515 |
| LYM560 | pUC19c_LYM560 | 8575, 8767, 8939, 9019 | 310 | 516 |
| LYM561 | pUCl9c_LYM561 | 8576, 8768, 8576, 8768 | 311 | 517 |
| LYM562 | pUC19_LYM562 | 8577, 8769, 8577, 8769 | 312 | 742 |
| LYM563 | pUC19_LYM563 | 8578, 8770, 8578, 8770 | 313 | 519 |
| LYM565 | pUCl9c_LYM565 | 8579, 8771, 8579, 8771 | 314 | 743 |
| LYM566 | pUCl9c_LYM566 | 8580, 8772, 8940, 9020 | 315 | 744 |
| LYM567 | pUCl9c_LYM567 | 8581, 8773, 8941, 9021 | 316 | 523 |
| LYM568 | pUCl9c_LYM568 | 8582, 8774, 8942, 9022 | 317 | 524 |
| LYM569 | pUCl9c_LYM569 | 8583, 8775 | 318 | 525 |
| LYM570 | pUC19_LYM570 | 8584, 8776, 8584, 9023 | 319 | 745 |
| LYM571 | pMA-RQ_LYM571_GA | GeneArt | 320 | 527 |
| LYM572 | pUCl9c_LYM572 | 8585, 8777, 8585, 8777 | 321 | 528 |
| LYM573 | pUCl9c_LYM573 | 8586, 8778, 8943, 9024 | 322 | 529 |
| LYM574 | pUCl9d_LYM574 | 8587, 8779, 8587, 8779 | 323 | 530 |
| LYM575 | pUCl9c_LYM575 | 8588, 8780, 8944, 9025 | 324 | 531 |
| LYM576 | pUCl9c_LYM576 | 8589, 8781, 8589, 8781 | 325 | 532 |
| LYM577 | pQFNc_LYM577 | 8590, 8782, 8590, 8782 | 326 | 746 |
| LYM578 | pUCl9c_LYM578 | 8591, 8783, 8591, 9026 | 327 | 534 |
| LYM579 | pUCl9c_LYM579 | 8592, 8784, 8592, 8784 | 328 | 535 |
| LYM580 | pUC19c_LYM580 | 8593, 8785, 8945, 9027 | 329 | 747 |
| LYM581 | pUCl9c_LYM581 | 8594, 8786, 8946, 9028 | 330 | 537 |
| LYM582 | pQFNc_LYM582 | 8595, 8787, 8947, 8787 | 331 | 748 |
| LYM583 | pUC19_LYM583 | 8596, 8788, 8948, 9029 | 332 | 749 |
| LYM585 | pUCl9d_LYM585 | 8597, 8789, 8597, 8789 | 333 | 540 |
| LYM586 | pUCl9c_LYM586 | 8598, 8790 | 334 | 541 |
| LYM587 | pMA-RQ_LYM587_GA | GeneArt | 335 | 542 |
| LYM588 | pUCl9c_LYM588 | 8599, 8791, 8949, 9030 | 336 | 543 |
| LYM589 | pUCl9c_LYM589 | 8600, 8792, 8600, 8792 | 337 | 750 |
| LYM590 | pUC19c_LYM590 | 8601, 8793, 8950, 9031 | 338 | 545 |
| LYM591 | pUCl9c_LYM591 | 8602, 8794, 8951, 9032 | 339 | 751 |
| LYM592 | pUCl9c_LYM592 | 8603, 8795, 8603, 8795 | 340 | 752 |
| LYM593 | pUCl9c_LYM593 | 8604, 8796, 8604, 8796 | 341 | 753 |
| LYM594 | pUCl9c_LYM594 | 8605, 8797, 8605, 8797 | 342 | 754 |
| LYM595 | pUCl9c_LYM595 | 8606, 8798, 8606, 8798 | 343 | 550 |
| LYM596_H9 | pMA-T_LYM596_H9_GA | GeneArt | 478 | 694 |
| LYM598 | pUCl9c_LYM598 | 8607, 8799, 8952, 9033 | 344 | 552 |
| LYM599 | pUCl9c_LYM599 | 8608, 8800, 8608, 8800 | 345 | 553 |
| LYM600 | pUCl9c_LYM600 | 8609, 8801, 8953, 9034 | 346 | 554 |
| LYM601 | pUC19c_LYM601 | 8610, 8802, 8954, 9035 | 347 | 555 |
| LYM602 | pUC19c_LYM602 | 8611, 8803, 8611, 9036 | 348 | 755 |

TABLE 51-continued

Genes cloned in high copy number plasmids

| Gene Name | High copy plasmid | Primers used SEQ ID NOs: | Polyn. SEQ ID NO: | Polyp. SEQ ID NO: |
|---|---|---|---|---|
| LYM603 | pUC19c_LYM603 | 8612, 8804, 8955, 9037 | 349 | 557 |
| LYM604 | pUCl9c_LYM604 | 8613, 8805, 8956, 9038 | 350 | 756 |
| LYM606 | pUC19_LYM606 | 8614, 8806, 8614, 8806 | 351 | 757 |
| LYM607 | pUCl9c_LYM607 | 8615, 8807, 8615, 8807 | 352 | 560 |
| LYM608 | pUCl9c_LYM608 | 8616, 8808, 8616, 8808 | 353 | 758 |
| LYM609 | pUCl9c_LYM609 | 8617, 8809, 8617, 8809 | 354 | 562 |
| LYM610 | pUCl9c_LYM610 | 8618, 881 | 355 | 759 |
| LYM611 | pUCl9c_LYM611 | 8619, 8811, 8957, 9039 | 356 | 564 |
| LYM612 | pUCl9c_LYM612 | 8620, 8812, 8958, 9040 | 357 | 565 |
| LYM613 | pUCl9c_LYM613 | 8621, 8813, 8621, 9041 | 358 | 760 |
| LYM614 | pUCl9c_LYM614 | 8622, 8814, 8959, 9042 | 359 | 567 |
| LYM615 | pMA_LYM615_GA | GeneArt | 360 | 568 |
| LYM616 | pUCl9c_LYM616 | 8623, 8815, 8960, 9043 | 361 | 569 |
| LYM617 | pUCl9c_LYM617 | 8624, 8816, 8624, 8816 | 362 | 761 |
| LYM618 | pUCl9c_LYM618 | 8625, 8817, 8625, 8817 | 363 | 571 |
| LYM619 | pUCl9c_LYM619 | 8626, 8818, 8626, 8818 | 364 | 572 |
| LYM620 | pUC19c_LYM620 | 8627, 8819, 8627, 8819 | 365 | 573 |
| LYM621 | pUC19_LYM621 | 8628, 8820, 8628, 8820 | 366 | 574 |
| LYM622 | pMA-RQ_LYM622_GA | GeneArt | 367 | 575 |
| LYM623 | pUCl9c_LYM623 | 8629, 8821, 8961, 9044 | 368 | 762 |
| LYM624 | pUCl9c_LYM624 | 8630, 8822, 8962, 9045 | 369 | 577 |
| LYM625 | pUC19_LYM625 | 8631, 8823, 8631, 8823 | 370 | 763 |
| LYM627 | pUCl9c_LYM627 | 8632, 8824, 8963, 9046 | 371 | 764 |
| LYM628 | pUCl9c_LYM628 | 8633, 8825, 8633, 8825 | 372 | 765 |
| LYM630 | pUC19c_LYM630 | 8634, 8826 | 373 | 581 |
| LYM631 | pUCl9c_LYM631 | 8635, 8827, 8964, 9047 | 374 | 582 |
| LYM632 | pQFNc_LYM632 | 8636, 8828, 8636, 8828 | 375 | 583 |
| LYM633 | pQFNc_LYM633p | 8637, 8829, 8637, 8829 | 479 | — |
| LYM634 | pUCl9c_LYM634 | 8638, 8830, 8638, 8830 | 376 | 766 |
| LYM635 | pUC19_LYM635 | 8639, 8831, 8639, 8831 | 377 | 767 |
| LYM636 | pUCl9c_LYM636 | 8640, 8832, 8640, 8832 | 378 | 768 |
| LYM638 | pUCl9c_LYM638 | 8641, 8833, 8641, 8833 | 379 | 769 |
| LYM639 | pUCl9c_LYM639 | 8642, 8834, 8965, 9048 | 380 | 588 |
| LYM640 | pUC19c_LYM640 | 8643, 8835, 8966, 9049 | 381 | 589 |
| LYM642 | pUCl9c_LYM642 | 8644, 8836 | 382 | 770 |
| LYM643 | pUCl9c_LYM643 | 8645, 8837, 8967, 9050 | 383 | 771 |
| LYM644 | pUC19_LYM644 | 8646, 8838, 8968, 9051 | 384 | 592 |
| LYM645 | pUCl9c_LYM645 | 8647, 8839, 8647, 8839 | 385 | 772 |
| LYM646 | pUCl9c_LYM646 | 8648, 8840, 8969, 9052 | 386 | 773 |
| LYM647 | pUCl9c_LYM647 | 8649, 8841, 8649, 8841 | 387 | 595 |
| LYM648 | pUCl9c_LYM648 | 8650, 8842, 8650, 8842 | 388 | 774 |
| LYM649 | pUCl9c_LYM649 | 8651, 8843, 8651, 8843 | 389 | 597 |
| LYM650 | pUC19_LYM650 | 8652, 8844, 8970, 9053 | 390 | 775 |
| LYM652 | pUCl9c_LYM652 | 8653, 8845, 8653, 9054 | 391 | 599 |
| LYM653 | pUCl9c_LYM653 | 8654, 8846, 8654, 8846 | 392 | 776 |
| LYM654 | pUCl9c_LYM654 | 8655, 8847, 8655, 8847 | 393 | 601 |
| LYM655 | pUCl9c_LYM655 | 8656, 8848, 8971, 9055 | 394 | 777 |
| LYM656 | pUC19_LYM656 | 8657, 8849, 8657, 8849 | 395 | 778 |
| LYM657 | pUCl9c_LYM657 | 8658, 8850 | 396 | 779 |
| LYM658 | pUC19_LYM658 | 8659, 8851, 8659, 8851 | 397 | 780 |
| LYM659 | pUCl9c_LYM659 | 8660, 8852, 8660, 8852 | 398 | 606 |
| LYM660 | pUCl9c_LYM660 | 8661, 8853, 8661, 8853 | 399 | 607 |
| LYM661 | pUCl9c_LYM661 | 8662, 8854, 8662, 8854 | 129 | 608 |
| LYM662 | pUCl9c_LYM662 | 8663, 8855 | 400 | 609 |
| LYM665 | pUCl9c_LYM665 | 8664, 8856, 8664, 8856 | 401 | 781 |
| LYM666 | pUCl9c_LYM666 | 8665, 8857, 8665, 8857 | 402 | 782 |
| LYM667 | pUCl9c_LYM667 | 8666, 8858, 8972, 9056 | 403 | 613 |
| LYM668 | pMA_LYM668_GA | GeneArt | 404 | 614 |
| LYM669 | pUC19_LYM669 | 8667, 8859, 8667, 8859 | 405 | 783 |
| LYM670 | pMA-RQ_LYM670_GA | GeneArt | 137 | 616 |
| LYM671 | pUCl9c_LYM671 | 8668, 8860, 8668, 8860 | 406 | 784 |
| LYM672 | pUC19_LYM672 | 8669, 8861, 8669, 8861 | 407 | 785 |
| LYM673 | pUC19_LYM673 | 8670, 8862, 8973, 9057 | 408 | 786 |
| LYM674 | pUCl9c_LYM674 | 8671, 8863, 8974, 8863 | 409 | 620 |
| LYM675 | pUCl9c_LYM675 | 8672, 8864, 8975, 9058 | 410 | 621 |
| LYM677 | pUC19_LYM677 | 8673, 8865, 8976, 9059 | 411 | 622 |
| LYM678 | pUCl9c_LYM678 | 8674, 8866, 8977, 9060 | 412 | 623 |
| LYM679 | pUCl9c_LYM679 | 8675, 8867, 8978, 9061 | 413 | 624 |
| LYM680 | pUC19_LYM680 | 8676, 8868, 8979, 9062 | 414 | 787 |
| LYM682 | pUCl9c_LYM682 | 8677, 8869, 8677, 8869 | 415 | 626 |
| LYM683 | pUCl9c_LYM683 | 8678, 8870, 8980, 9063 | 416 | 627 |
| LYM684 | pUC19_LYM684 | 8679, 8871 | 417 | 628 |
| LYM686 | pMA_LYM686_GA | GeneArt | 418 | 630 |
| LYM687 | pUCl9c_LYM687 | 8680, 8872, 8680, 8872 | 419 | 631 |

TABLE 51-continued

Genes cloned in high copy number plasmids

| Gene Name | High copy plasmid | Primers used SEQ ID NOs: | Polyn. SEQ ID NO: | Polyp. SEQ ID NO: |
|---|---|---|---|---|
| LYM688 | pUCl9c_LYM688 | 8681, 8873, 8981, 9064 | 420 | 632 |
| LYM689 | pUCl9c_LYM689 | 8682, 8874 | 421 | 633 |
| LYM690 | pUC19c_LYM690 | 8683, 8875, 8683, 8875 | 422 | 634 |
| LYM691 | pUC19_LYM691 | 8684, 8876, 8982, 9065 | 423 | 635 |
| LYM692 | pUCl9c_LYM692 | 8685, 8877, 8983, 9066 | 424 | 788 |
| LYM693 | pUCl9c_LYM693 | 8686, 8878 | 425 | 723 |
| LYM694 | pUCl9c_LYM694 | 8687, 8879, 8984, 9067 | 426 | 789 |
| LYM695 | pUC19_LYM695 | 8688, 8880, 8688, 8880 | 427 | 639 |
| LYM697 | pUCl9c_LYM697 | 8689, 8881, 8985, 9068 | 428 | 640 |
| LYM698 | pUCl9c_LYM698 | 8690, 8882, 8986, 9069 | 429 | 641 |
| LYM699 | pUCl9c_LYM699 | 8691, 8883, 8691, 8883 | 430 | 642 |
| LYM700 | RQ_LYM700_GA | GeneArt | 431 | 643 |
| LYM701_H1 | pMA-RQ_LYM701H1_GA | GeneArt | 216 | 695 |
| LYM702 | pUC19_LYM702 | 8692, 8884, 8987, 8884 | 432 | 790 |
| LYM703 | pUC19_LYM703 | 8693, 8885 | 433 | 791 |
| LYM704 | pUC19c_LYM704 | 8694, 8886, 8988, 8886 | 434 | 792 |
| LYM705 | pUC19_LYM705 | 8695, 8887, 8989, 9070 | 435 | 793 |
| LYM706 | pUC19_LYM706 | 8696, 8888, 8990, 9071 | 436 | 794 |
| LYM707 | pUCl9c_LYM707 | 8697, 8889, 8991, 9072 | 437 | 650 |
| LYM708 | pUCl9c_LYM708 | 8698, 8890, 8992, 9073 | 438 | 795 |
| LYM709 | pUCl9c_LYM709 | 8699, 8891, 8993, 9074 | 439 | 652 |
| LYM710 | pUC19_LYM710 | 8700, 8892, 8700, 8892 | 440 | 653 |
| LYM712 | pUCl9c_LYM712 | 8701, 8893, 8701, 8893 | 441 | 655 |
| LYM713 | pUCl9c_LYM713 | 8702, 8894, 8702, 8894 | 442 | 656 |
| LYM714 | pUCl9c_LYM714 | 8703, 8895, 8703, 9075 | 443 | 796 |
| LYM715 | pUCl9c_LYM715 | 8704, 8896, 8704, 9076 | 444 | 658 |
| LYM716 | pUCl9c_LYM716 | 8705, 8897, 8994, 9077 | 445 | 797 |
| LYM717 | pUCl9c_LYM717 | 8706, 8898, 8995, 9078 | 446 | 660 |
| LYM718 | pUCl9c_LYM718 | 8707, 8899, 8996, 9079 | 447 | 661 |
| LYM719 | pUC19_LYM719 | 8708, 8900, 8997, 9080 | 448 | 662 |
| LYM720 | pUC19c_LYM720 | 8709, 8901, 8709, 8901 | 449 | 798 |
| LYM721 | pMA-T_LYM721_GA | GeneArt | 185 | 664 |
| LYM722 | pQFNc_LYM722 | 8710, 8902, 8998, 9081 | 450 | 665 |
| LYM723 | pUCl9c_LYM723 | 8711, 8903, 8999, 9082 | 451 | 666 |
| LYM724 | pUCl9c_LYM724 | 8712, 8904, 9000, 9083 | 452 | 667 |
| LYM725 | pUCl9c_LYM725 | 8713, 8905, 8713, 8905 | 453 | 668 |
| LYM726 | pUCl9c_LYM726 | 8714, 8906, 8714, 9084 | 454 | 799 |
| LYM727 | pUCl9c_LYM727 | 8715, 8907, 9001, 9085 | 455 | 670 |
| LYM728 | pUC19_LYM728 | 8716, 8908, 9002, 9086 | 456 | 671 |
| LYM729 | pUC19_LYM729 | 8717, 8909 | 457 | 800 |
| LYM730 | pUC19c_LYM730 | 8718, 8910, 9003, 9087 | 458 | 673 |
| LYM731 | pUCl9c_LYM731 | 8719, 8911 | 459 | 801 |
| LYM732 | pUCl9c_LYM732 | 8720, 8912, 8720, 9088 | 460 | 802 |
| LYM733 | pUCl9c_LYM733 | 8721, 8913, 8721, 8913 | 461 | 803 |
| LYM734 | pUCl9c_LYM734 | 8722, 8914, 9004, 9089 | 462 | 677 |
| LYM736 | pUCl9c_LYM736 | 8723, 8915, 9005, 9090 | 463 | 804 |
| LYM737 | pUCl9c_LYM737 | 8724, 8916, 9006, 9091 | 464 | 805 |
| LYM739 | pUCl9c_LYM739 | 8725, 8917, 8725, 8917 | 465 | 806 |
| LYM740 | pUC19c_LYM740 | 8726, 8918 | 466 | 682 |
| LYM741 | pUCl9c_LYM741 | 8727, 8919, 9007, 9092 | 467 | 807 |
| LYM742 | pUCl9c_LYM742 | 8728, 8920, 8728, 8920 | 468 | 808 |
| LYM743 | pUCl9c_LYM743 | 8729, 8921, 9008, 9093 | 469 | 685 |
| LYM744 | pUCl9c_LYM744 | 8730, 8922, 8730, 8922 | 470 | 809 |
| LYM745 | pMA-RQ_LYM745_GA | GeneArt | 471 | 687 |
| LYM746 | pUCl9c_LYM746 | 8731, 8923 | 472 | 810 |
| LYM747 | pUCl9c_LYM747 | 8732, 8924, 9009, 9094 | 473 | 689 |
| LYM748 | pUCl9c_LYM748 | 8733, 8925, 8733, 9095 | 474 | 811 |
| LYM749 | pQFNc_LYM749p | 8734, 8926 | 475 | 691 |
| LYM750 | pUC19c_LYM750 | 8735, 8927, 8735, 8927 | 476 | 812 |

Table 51. "Polyn."—Polynucleotide;
"Polyp."—polypeptide.

For cloning of each gene at least 2 primers were used: Forward (Fwd) or Reverse (Rev). In some cases, 4 primers were used: External forward (EF), External reverse (ER), nested forward (NF) or nested reverse (NR). The sequences of the primers used for cloning the genes are provided in the sequence listing. The genes were cloned from the same organism as identified in the list of genes provided in Table 1 above, except for the genes that were synthetically produced by GeneArt.

Example 13

Producing Transgenic Arabidopsis Plants Expressing Selected Genes According to Some Embodiments of the Invention Experimental Methods Production of Agrobacterium tumefaciens Cells Harboring the Binary Vectors According to Some Embodiments of the Invention—

Each of the binary vectors described in Example 12 above was used to transform Agrobacterium cells. Two additional binary constructs, having only the At6669 or the 35S promoter or no additional promoter were used as negative controls.

The binary vectors were introduced to Agrobacterium tumefaciens GV301, or LB4404 competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (50 mg/L; for Agrobacterium strains GV301) or streptomycin (300 mg/L; for Agrobacterium strain LB4404) and kanamycin (50 mg/L) at 28° C. for 48 hours. Agrobacterium colonies, which were developed on the selective media, were further analyzed by PCR using the primers designed to span the inserted sequence in the pPI plasmid. The resulting PCR products were isolated and sequenced to verify that the correct polynucleotide sequences of the invention were properly introduced to the Agrobacterium cells.

Preparation of Arabidopsis Plants for Transformation—

Arabidopsis thaliana var Columbia ($T_0$ plants) were transformed according to the Floral Dip procedure [Clough S J, Bent A F. (1998) Floral dip: a simplified method for Agrobacterium-mediated transformation of Arabidopsis thaliana. Plant J. 16(6): 735-43; and Desfeux C, Clough S J, Bent A F. (2000) Female reproductive tissues are the primary targets of Agrobacterium-mediated transformation by the Arabidopsis floral-dip method. Plant Physiol. 123(3): 895-904] with minor modifications. Briefly, Arabidopsis thaliana Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Preparation of the agrobacterium Carrying the Binary Vectors to Transformation into Arabidopsis Plants—

Single colonies of Agrobacterium carrying the binary vectors harboring the genes of some embodiments of the invention were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising Agrobacterium cells were resuspended in a transformation medium which contains half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of Arabidopsis Plants with the agrobacterium—

Transformation of $T_0$ plants was performed by inverting each plant into an Agrobacterium suspension such that the above ground plant tissue is submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques are brown and dry, then seeds were harvested from plants and kept at room temperature until sowing.

Generation of T1 and T2 Transgenic Plants—

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ Arabidopsis plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 14

Evaluation of Transgenic Arabidopsis for Seed Yield and Plant Growth Rate Under Normal Conditions in Greenhouse Assays (GH-SM Assays)

Assay 1: Seed Yield Plant Biomass and Plant Growth Rate Under Normal Greenhouse Conditions—

This assay follows seed yield production, the biomass formation and the rosette area growth of plants grown in the greenhouse at non-limiting nitrogen growth conditions. Transgenic Arabidopsis seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter (SEQ ID NO:8529) and the selectable marker were used as control.

The plants were analyzed for their overall size, growth rate, flowering (flowering time), seed yield, 1,000-seed weight, dry matter and harvest index (HI—seed yield/dry matter). Early flowering time (e.g., a decrease in flowering time as compared to control, e.g., having a negative value) is an important agronomical trait that has a potential to contribute to increase in yield under various environmental conditions. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) is used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb(dot)nih(dot)gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, rosette area, rosette diameter, and leaf blade area.

Vegetative Growth Rate:

the relative growth rate (RGR) of leaf number [Formula X (described above)], rosette area (Formula IX above), plot coverage (Formula XX below) and harvest index (Formula IV above) were calculated with the indicated formulas.

RGR plot coverage    Formula XX:

Relative growth rate of plot coverage=Regression coefficient of plot coverage along time course.

Seeds Average Weight—

At the end of the experiment all seeds were collected. The seeds were scattered on a glass tray and a picture was taken. Using the digital analysis, the number of seeds in each sample was calculated.

Dry Weight and Seed Yield—

On about day 80 from sowing, the plants were harvested and left to dry at 30° C. in a drying chamber. The biomass and seed weight of each plot were measured and divided by the number of plants in each plot.

Dry weight=total weight of the vegetative portion above ground (excluding roots) after drying at 30° C. in a drying chamber.

Seed yield per plant=total seed weight per plant (gr.).

1000 seed weight (the weight of 1000 seeds) (gr.).

Oil Percentage in Seeds—

At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane is evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique Length Analysis—

On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical Analyses—

To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 52-56 summarize the observed phenotypes of transgenic plants exogenously expressing the gene constructs using the seed maturation (GH-SM) assays under normal conditions. The evaluation of each gene was performed by testing the performance of different number of events. Event with p-value <0.1 was considered statistically significant.

TABLE 52

Genes showing improved plant performance at normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM642 | 69195.1 | — | — | — | 17.3 | 0.05 | −1 | — | — | — |
| LYM642 | 69198.1 | — | — | — | 16.2 | L | −13 | — | — | — |
| CONT. | — | — | — | — | 18.7 | — | — | — | — | — |
| LYM724 | 69030.2 | — | — | — | 18.2 | L | −10 | — | — | — |
| LYM724 | 69031.3 | — | — | — | 19.3 | 0.13 | −4 | — | — | — |
| LYM724 | 69031.4 | — | — | — | 18.2 | L | −10 | — | — | — |
| LYM690 | 68768.2 | — | — | — | 19.1 | 0.09 | −6 | — | — | — |

TABLE 52-continued

Genes showing improved plant performance at normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM690 | 68768.3 | — | — | — | 18.4 | 0.12 | −9 | — | — | — |
| LYM690 | 68773.7 | — | — | — | 17.8 | 0.12 | −12 | — | — | — |
| LYM688 | 68192.3 | — | — | — | 17.8 | L | −12 | — | — | — |
| LYM688 | 68194.1 | — | — | — | 18.2 | L | −10 | — | — | — |
| LYM679 | 69320.1 | — | — | — | 19.4 | 0.21 | −4 | — | — | — |
| LYM669 | 70649.3 | — | — | — | 18.8 | 0.04 | −7 | — | — | — |
| LYM669 | 70651.2 | — | — | — | 19.0 | 0.18 | −6 | — | — | — |
| LYM644 | 69304.3 | — | — | — | 18.5 | 0.02 | −8 | — | — | — |
| LYM640 | 68948.1 | — | — | — | 18.7 | 0.04 | −8 | — | — | — |
| LYM640 | 68950.2 | — | — | — | 19.3 | 0.15 | −5 | — | — | — |
| LYM638 | 70077.2 | — | — | — | 18.3 | 0.21 | −10 | — | — | — |
| LYM638 | 70081.3 | — | — | — | 19.1 | 0.12 | −6 | — | — | — |
| LYM625 | 70072.1 | — | — | — | 19.5 | 0.22 | −4 | — | — | — |
| LYM625 | 70073.1 | — | — | — | 17.4 | L | −14 | — | — | — |
| LYM622 | 70544.2 | — | — | — | 19.1 | 0.07 | −6 | — | — | — |
| LYM622 | 70545.5 | — | — | — | 18.9 | 0.06 | −7 | — | — | — |
| LYM606 | 70352.1 | — | — | — | 17.6 | 0.04 | −13 | — | — | — |
| LYM591 | 68920.1 | — | — | — | 19.2 | 0.15 | −5 | — | — | — |
| LYM587 | 70346.2 | — | — | — | 19.4 | 0.15 | −4 | — | — | — |
| LYM583 | 70154.1 | — | — | — | 18.6 | 0.02 | −8 | — | — | — |
| LYM583 | 70154.2 | — | — | — | 18.3 | 0.05 | −10 | — | — | — |
| LYM583 | 70159.3 | — | — | — | 17.5 | 0.02 | −14 | — | — | — |
| LYM569 | 69123.3 | — | — | — | 18.5 | 0.01 | −9 | — | — | — |
| LYM569 | 69124.2 | — | — | — | 18.1 | 0.07 | −11 | — | — | — |
| LYM569 | 69125.2 | — | — | — | 19.2 | 0.08 | −5 | — | — | — |
| LYM566 | 69081.2 | — | — | — | 18.9 | 0.10 | −6 | — | — | — |
| LYM566 | 69081.3 | — | — | — | 17.6 | L | −13 | — | — | — |
| LYM566 | 69082.1 | — | — | — | 18.9 | 0.06 | −7 | — | — | — |
| LYM536 | 68590.5 | — | — | — | 18.3 | 0.02 | −9 | — | — | — |
| CONT. | — | — | — | — | 20.2 | — | — | — | — | — |
| LYM734 | 69050.6 | 806.2 | 0.16 | 11 | — | — | — | — | — | — |
| LYM723 | 68822.3 | — | — | — | 17.7 | 0.06 | −3 | — | — | — |
| LYM704 | 69454.2 | 760.6 | 0.21 | 5 | — | — | — | — | — | — |
| LYM703 | 69019.1 | 910.0 | 0.18 | 25 | — | — | — | — | — | — |
| LYM695 | 69442.2 | 791.9 | 0.25 | 9 | — | — | — | — | — | — |
| LYM666 | 69771.2 | 856.4 | 0.28 | 18 | — | — | — | — | — | — |
| LYM603 | 69298.1 | 790.5 | 0.12 | 9 | — | — | — | — | — | — |
| LYM599 | 69291.3 | — | — | — | 17.9 | 0.28 | −2 | — | — | — |
| LYM599 | 69291.4 | — | — | — | 17.0 | 0.26 | −7 | — | — | — |
| LYM586 | 69145.2 | — | — | — | 17.6 | 0.06 | −4 | — | — | — |
| LYM528 | 69464.3 | 750.9 | 0.28 | 3 | — | — | — | — | — | — |
| LYM528 | 69469.2 | — | — | — | 17.7 | 0.04 | −4 | — | — | — |
| CONT. | — | 727.5 | — | — | 18.3 | — | — | — | — | — |
| LYM733 | 69748.3 | 677.5 | 0.07 | 5 | — | — | — | — | — | — |
| LYM726 | 69752.2 | 751.9 | L | 17 | 18.3 | 0.14 | −3 | — | — | — |
| LYM726 | 69753.5 | 723.8 | 0.18 | 13 | — | — | — | — | — | — |
| LYM726 | 69754.4 | 729.7 | 0.27 | 14 | — | — | — | — | — | — |
| LYM724 | 69027.1 | 713.8 | 0.23 | 11 | 17.7 | 0.07 | −6 | — | — | — |
| LYM717 | 69458.3 | 673.8 | 0.11 | 5 | — | — | — | — | — | — |
| LYM717 | 69459.2 | 730.0 | L | 14 | — | — | — | — | — | — |
| LYM717 | 69463.1 | 668.1 | 0.16 | 4 | — | — | — | — | — | — |
| LYM706 | 69024.3 | 686.2 | 0.27 | 7 | 18.1 | 0.04 | −4 | — | — | — |
| LYM702 | 69449.4 | 691.9 | 0.02 | 8 | — | — | — | — | — | — |
| LYM702 | 69451.4 | 709.1 | L | 10 | — | — | — | — | — | — |
| LYM689 | 69160.3 | 748.1 | 0.09 | 16 | — | — | — | — | — | — |
| LYM624 | 68939.2 | — | — | — | 18.2 | 0.09 | −3 | — | — | — |
| LYM617 | 69584.1 | 683.8 | 0.16 | 6 | — | — | — | — | — | — |
| LYM617 | 69587.2 | 685.0 | 0.11 | 7 | — | — | — | — | — | — |
| LYM576 | 69569.2 | 744.4 | 0.29 | 16 | — | — | — | — | — | — |
| LYM576 | 69570.2 | 663.8 | 0.23 | 3 | — | — | — | — | — | — |
| LYM576 | 69570.6 | 697.5 | 0.02 | 9 | — | — | — | — | — | — |
| LYM570 | 69432.2 | 675.0 | 0.19 | 5 | — | — | — | — | — | — |
| LYM557 | 68860.2 | 703.1 | 0.09 | 9 | — | — | — | — | — | — |
| LYM545 | 69557.2 | — | — | — | 17.8 | 0.05 | −6 | — | — | — |
| CONT. | — | 642.7 | — | — | 18.8 | — | — | — | — | — |
| LYM732 | 68364.3 | — | — | — | — | — | — | 17.0 | 0.21 | −0 |
| LYM718 | 68210.2 | — | — | — | 22.5 | 0.04 | −4 | 17.0 | 0.21 | −0 |
| LYM718 | 68214.9 | — | — | — | 23.0 | 0.27 | −2 | 17.0 | 0.21 | −0 |
| LYM716 | 68205.1 | 1031.9 | 0.09 | 4 | 22.3 | 0.02 | −5 | 17.0 | 0.21 | −0 |
| LYM716 | 68208.1 | — | — | — | — | — | — | 17.0 | 0.21 | −0 |
| LYM694 | 68531.1 | 1127.1 | 0.09 | 14 | — | — | — | — | — | — |
| LYM692 | 68362.4 | — | — | — | — | — | — | 17.0 | 0.21 | −0 |
| LYM677 | 68524.3 | — | — | — | — | — | — | 17.0 | 0.21 | −0 |

TABLE 52-continued

Genes showing improved plant performance at normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LYM677 | 68525.2 | — | — | — | — | — | — | 17.0 | 0.21 | −0 |
| LYM677 | 68526.1 | — | — | — | — | — | — | 17.0 | 0.21 | −0 |
| LYM677 | 68526.2 | — | — | — | — | — | — | 17.0 | 0.21 | −0 |
| LYM675 | 68240.2 | 1180.0 | 0.16 | 19 | — | — | — | 17.0 | 0.21 | −0 |
| LYM675 | 68241.5 | — | — | — | 22.8 | 0.08 | −3 | 17.0 | 0.21 | −0 |
| LYM675 | 68244.1 | — | — | — | — | — | — | 17.0 | 0.21 | −0 |
| LYM661 | 68519.2 | 1129.4 | L | 14 | — | — | — | — | — | — |
| LYM630 | 68174.1 | 1162.5 | 0.28 | 18 | — | — | — | — | — | — |
| LYM630 | 68174.3 | — | — | — | — | — | — | 17.0 | 0.21 | −0 |
| LYM630 | 68175.4 | — | — | — | — | — | — | 17.0 | 0.21 | −0 |
| LYM630 | 68175.5 | — | — | — | — | — | — | 17.0 | 0.21 | −0 |
| LYM613 | 68284.2 | — | — | — | — | — | — | 17.0 | 0.21 | −0 |
| LYM613 | 68284.6 | — | — | — | — | — | — | 17.0 | 0.21 | −0 |
| LYM602 | 68440.2 | 1035.6 | 0.21 | 5 | — | — | — | — | — | — |
| LYM602 | 68442.1 | — | — | — | 22.7 | 0.05 | −3 | 17.0 | 0.21 | −0 |
| LYM602 | 68442.8 | 1030.6 | 0.27 | 4 | — | — | — | 17.0 | 0.21 | −0 |
| LYM590 | 68422.1 | 1093.8 | 0.05 | 11 | — | — | — | 17.0 | 0.21 | −0 |
| LYM590 | 68425.1 | — | — | — | 22.9 | 0.11 | −2 | — | — | — |
| LYM585 | 68411.4 | 1066.9 | 0.01 | 8 | — | — | — | 17.0 | 0.21 | −0 |
| LYM580 | 68402.2 | — | — | — | 22.8 | 0.08 | −3 | — | — | — |
| LYM580 | 68402.3 | — | — | — | — | — | — | 17.0 | 0.21 | −0 |
| LYM568 | 68386.2 | 1181.2 | 0.08 | 20 | — | — | — | — | — | — |
| LYM568 | 68386.3 | — | — | — | — | — | — | 17.0 | 0.21 | −0 |
| LYM532 | 68380.1 | 1075.6 | 0.03 | 9 | — | — | — | 17.0 | 0.21 | −0 |
| LYM532 | 68381.3 | 1018.8 | 0.21 | 3 | — | — | — | — | — | — |
| CONT. | — | 987.7 | — | — | 23.5 | — | — | 17.1 | — | — |
| LYM725 | 69177.3 | 927.5 | 0.09 | 5 | — | — | — | — | — | — |
| LYM684 | 68996.1 | 959.6 | 0.16 | 9 | — | — | — | — | — | — |
| LYM680 | 68972.1 | 909.4 | 0.06 | 3 | — | — | — | — | — | — |
| LYM680 | 68972.2 | 925.0 | 0.19 | 5 | — | — | — | — | — | — |
| LYM679 | 69321.1 | 908.1 | 0.13 | 3 | — | — | — | — | — | — |
| LYM679 | 69323.2 | 903.1 | 0.20 | 3 | — | — | — | — | — | — |
| LYM678 | 68368.1 | 917.5 | 0.22 | 4 | — | — | — | — | — | — |
| LYM674 | 68188.3 | 914.4 | 0.04 | 4 | — | — | — | — | — | — |
| LYM673 | 68765.2 | 904.4 | 0.30 | 3 | — | — | — | — | — | — |
| LYM673 | 68766.2 | 902.5 | 0.12 | 3 | — | — | — | — | — | — |
| LYM612 | 68457.4 | 1004.4 | 0.10 | 14 | — | — | — | — | — | — |
| LYM609 | 68559.5 | 920.6 | 0.02 | 5 | — | — | — | — | — | — |
| LYM609 | 68561.4 | 933.8 | 0.23 | 6 | — | — | — | — | — | — |
| LYM609 | 68562.2 | 921.9 | 0.02 | 5 | 17.2 | 0.23 | −8 | — | — | — |
| LYM594 | 69286.1 | 928.8 | 0.19 | 6 | — | — | — | — | — | — |
| LYM594 | 69287.3 | — | — | — | 17.6 | 0.08 | −6 | 14.7 | 0.01 | −7 |
| LYM591 | 68922.1 | 1015.6 | 0.06 | 15 | — | — | — | — | — | — |
| LYM590 | 68422.3 | 914.4 | 0.04 | 4 | — | — | — | — | — | — |
| LYM589 | 68418.4 | — | — | — | 17.7 | 0.10 | −6 | 15.1 | 0.13 | −4 |
| LYM588 | 68912.4 | 943.8 | L | 7 | — | — | — | — | — | — |
| LYM580 | 68402.2 | — | — | — | 17.6 | 0.08 | −6 | — | — | — |
| LYM569 | 69127.1 | — | — | — | 17.4 | 0.06 | −7 | — | — | — |
| LYM566 | 69081.1 | 964.4 | 0.28 | 10 | — | — | — | — | — | — |
| LYM566 | 69081.3 | 903.8 | 0.26 | 3 | — | — | — | — | — | — |
| LYM566 | 69082.1 | — | — | — | — | — | — | 12.7 | 0.28 | −19 |
| CONT. | — | 880.2 | — | — | 18.8 | — | — | 15.7 | — | — |
| LYM712 | 69174.1 | 951.2 | 0.15 | 5 | — | — | — | — | — | — |
| LYM698 | 69329.2 | 947.5 | 0.20 | 4 | — | — | — | — | — | — |
| LYM677 | 68524.3 | — | — | — | 16.7 | L | −8 | 13.1 | 0.18 | −14 |
| LYM675 | 68240.4 | — | — | — | 17.6 | 0.16 | −3 | — | — | — |
| LYM643 | 69155.1 | — | — | — | 17.3 | 0.28 | −4 | — | — | — |
| LYM643 | 69157.4 | 1031.2 | 0.27 | 14 | — | — | — | — | — | — |
| LYM640 | 68950.2 | 998.8 | 0.19 | 10 | — | — | — | — | — | — |
| LYM613 | 68282.1 | — | — | — | 17.6 | 0.16 | −3 | — | — | — |
| LYM613 | 68285.3 | 989.4 | 0.02 | 9 | — | — | — | — | — | — |
| LYM613 | 68285.4 | 950.6 | 0.12 | 5 | — | — | — | — | — | — |
| LYM581 | 68405.6 | — | — | — | — | — | — | 14.1 | 0.25 | −7 |
| LYM567 | 68875.2 | — | — | — | 17.6 | 0.16 | −3 | — | — | — |
| LYM565 | 69079.2 | — | — | — | — | — | — | 13.5 | 0.24 | −11 |
| CONT. | — | 907.1 | — | — | 18.0 | — | — | 15.2 | — | — |
| LYM660 | 68511.2 | 1215.5 | 0.17 | 17 | — | — | — | 17.1 | 0.13 | −2 |
| LYM647 | 68489.2 | — | — | — | — | — | — | 17.0 | 0.06 | −2 |
| LYM631 | 68351.2 | — | — | — | — | — | — | 17.1 | 0.13 | −2 |
| LYM618 | 68171.2 | — | — | — | 23.1 | 0.26 | −3 | 17.1 | 0.13 | −2 |
| LYM618 | 68173.3 | — | — | — | — | — | — | 17.1 | 0.13 | −2 |
| LYM618 | 68173.5 | — | — | — | — | — | — | 17.1 | 0.13 | −2 |
| LYM618 | 68173.6 | — | — | — | 23.2 | 0.23 | −3 | 17.0 | 0.06 | −2 |

TABLE 52-continued

Genes showing improved plant performance at normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM609 | 68559.1 | — | — | — | 23.2 | 0.23 | −3 | 17.0 | 0.06 | −2 |
| LYM609 | 68559.4 | — | — | — | — | — | — | 17.1 | 0.13 | −2 |
| LYM604 | 68444.3 | — | — | — | — | — | — | 17.1 | 0.13 | −2 |
| LYM604 | 68447.1 | — | — | — | — | — | — | 17.0 | 0.06 | −2 |
| LYM600 | 68433.2 | — | — | — | — | — | — | 17.1 | 0.13 | −2 |
| LYM600 | 68436.1 | — | — | — | — | — | — | 17.0 | 0.06 | −2 |
| LYM600 | 68436.3 | — | — | — | — | — | — | 17.0 | 0.06 | −2 |
| LYM598 | 68426.1 | — | — | — | — | — | — | 17.1 | 0.13 | −2 |
| LYM598 | 68426.4 | — | — | — | 23.2 | 0.23 | −3 | 17.1 | 0.13 | −2 |
| LYM598 | 68429.2 | — | — | — | — | — | — | 17.1 | 0.13 | −2 |
| LYM589 | 68415.3 | — | — | — | — | — | — | 17.1 | 0.13 | −2 |
| LYM589 | 68415.4 | — | — | — | — | — | — | 17.1 | 0.13 | −2 |
| LYM589 | 68416.2 | — | — | — | — | — | — | 17.1 | 0.13 | −2 |
| LYM581 | 68406.3 | — | — | — | — | — | — | 17.0 | 0.06 | −2 |
| LYM575 | 68267.1 | — | — | — | — | — | — | 17.1 | 0.13 | −2 |
| LYM575 | 68268.3 | — | — | — | — | — | — | 17.1 | 0.13 | −2 |
| LYM573 | 68276.1 | — | — | — | — | — | — | 17.0 | 0.06 | −2 |
| LYM573 | 68276.2 | 1175.6 | 0.23 | 13 | — | — | — | — | — | — |
| LYM573 | 68276.6 | — | — | — | — | — | — | 17.1 | 0.13 | −2 |
| LYM573 | 68279.3 | — | — | — | — | — | — | 17.0 | 0.06 | −2 |
| LYM573 | 68279.4 | — | — | — | — | — | — | 17.0 | 0.06 | −2 |
| LYM525 | 68578.4 | 1271.2 | 0.22 | 22 | — | — | — | 17.0 | 0.06 | −2 |
| LYM525 | 68579.2 | — | — | — | — | — | — | 17.1 | 0.13 | −2 |
| CONT. | — | 1042.1 | — | — | 23.8 | — | — | 17.4 | — | — |

Table 52. "CONT."—Control; "Ave."—Average; "% Incr." = % increment; "p-val."—p-value, L—p < 0.01.

TABLE 53

Genes showing improved plant performance at normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM749 | 70679.3 | 1.7 | 0.18 | 12 | — | — | — | 97.0 | 0.18 | 14 |
| LYM712 | 69171.1 | 1.7 | 0.12 | 11 | — | — | — | 91.7 | 0.20 | 8 |
| LYM698 | 69326.1 | 1.8 | 0.21 | 20 | — | — | — | — | — | — |
| LYM698 | 69329.3 | 1.7 | 0.06 | 15 | — | — | — | 94.6 | 0.19 | 11 |
| LYM697 | 69003.1 | 1.8 | 0.16 | 17 | — | — | — | 96.0 | 0.28 | 13 |
| LYM691 | 69779.3 | 1.8 | 0.18 | 20 | — | — | — | 100.4 | 0.03 | 18 |
| LYM680 | 68976.1 | — | — | — | 11.1 | 0.03 | 6 | — | — | — |
| LYM671 | 70148.1 | — | — | — | 10.9 | 0.15 | 4 | — | — | — |
| LYM643 | 69157.5 | — | — | — | 10.8 | 0.17 | 3 | 91.0 | 0.25 | 7 |
| LYM642 | 69198.1 | 1.6 | 0.23 | 9 | — | — | — | 100.5 | 0.07 | 18 |
| LYM615 | 70539.1 | 1.6 | 0.24 | 9 | 11.2 | 0.01 | 7 | 102.0 | 0.18 | 20 |
| LYM565 | 69077.1 | 1.8 | 0.11 | 17 | — | — | — | 97.3 | 0.04 | 15 |
| CONT. | — | 1.5 | — | — | 10.5 | — | — | 85.0 | — | — |
| LYM724 | 69030.2 | 1.1 | 0.04 | 49 | 9.6 | 0.09 | 7 | 59.0 | 0.01 | 53 |
| LYM724 | 69031.4 | 1.0 | 0.22 | 41 | 9.3 | 0.26 | 4 | 52.2 | 0.30 | 36 |
| LYM708 | 70361.1 | — | — | — | 9.2 | 0.25 | 3 | — | — | — |
| LYM690 | 68768.3 | — | — | — | — | — | — | 49.3 | 0.13 | 28 |
| LYM690 | 68773.7 | 0.9 | 0.02 | 34 | — | — | — | 54.0 | 0.11 | 40 |
| LYM688 | 68192.3 | 0.9 | 0.12 | 22 | 9.8 | L | 10 | 51.0 | 0.04 | 32 |
| LYM688 | 68194.1 | — | — | — | — | — | — | 45.8 | 0.28 | 19 |
| LYM679 | 69320.1 | 0.8 | 0.18 | 17 | — | — | — | 45.0 | 0.30 | 17 |
| LYM669 | 70649.3 | 1.2 | L | 74 | 9.6 | 0.09 | 7 | 65.6 | L | 70 |
| LYM669 | 70651.2 | 0.9 | 0.02 | 32 | 9.2 | 0.30 | 3 | 52.7 | 0.04 | 37 |
| LYM640 | 68948.1 | — | — | — | 9.2 | 0.30 | 3 | 47.1 | 0.19 | 22 |
| LYM640 | 68950.2 | — | — | — | 9.2 | 0.30 | 3 | — | — | — |
| LYM638 | 70077.2 | 0.9 | 0.29 | 26 | 9.2 | 0.30 | 3 | — | — | — |
| LYM638 | 70080.4 | — | — | — | 9.4 | 0.29 | 5 | — | — | — |
| LYM625 | 70072.1 | 0.8 | 0.18 | 20 | — | — | — | — | — | — |
| LYM625 | 70072.2 | 0.8 | 0.19 | 20 | — | — | — | 45.5 | 0.23 | 18 |
| LYM625 | 70073.1 | 1.0 | L | 41 | 9.6 | 0.09 | 7 | 57.9 | L | 50 |
| LYM622 | 70544.2 | 0.8 | 0.14 | 18 | — | — | — | 44.7 | 0.24 | 16 |
| LYM622 | 70545.5 | 1.0 | 0.20 | 41 | — | — | — | 55.6 | 0.04 | 44 |
| LYM622 | 70548.2 | 0.8 | 0.25 | 19 | — | — | — | 46.2 | 0.20 | 20 |
| LYM606 | 70352.1 | 1.0 | 0.14 | 37 | — | — | — | 55.6 | 0.08 | 44 |
| LYM591 | 68922.1 | 0.8 | 0.27 | 16 | 9.8 | 0.01 | 9 | — | — | — |

TABLE 53-continued

Genes showing improved plant performance at normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM583 | 70154.1 | 1.1 | 0.07 | 50 | — | — | — | 56.8 | 0.05 | 47 |
| LYM583 | 70159.3 | 1.2 | L | 63 | 9.6 | 0.09 | 7 | 66.9 | L | 74 |
| LYM569 | 69123.3 | — | — | — | 9.2 | 0.25 | 3 | 46.6 | 0.26 | 21 |
| LYM569 | 69124.2 | 0.9 | 0.19 | 26 | — | — | — | 49.4 | 0.23 | 28 |
| LYM569 | 69125.1 | — | — | — | 9.2 | 0.30 | 3 | — | — | — |
| LYM566 | 69081.2 | 0.8 | 0.25 | 16 | 9.9 | L | 11 | 49.9 | 0.14 | 30 |
| LYM536 | 68590.5 | 1.1 | L | 48 | — | — | — | 61.1 | L | 59 |
| CONT. | — | 0.7 | — | — | 8.9 | — | — | 38.5 | — | — |
| LYM734 | 69050.6 | 1.0 | L | 17 | — | — | — | 51.4 | 0.17 | 10 |
| LYM734 | 69055.1 | — | — | — | — | — | — | 50.5 | 0.04 | 8 |
| LYM705 | 69266.1 | 1.0 | 0.01 | 13 | — | — | — | 51.1 | 0.03 | 9 |
| LYM704 | 69454.2 | 0.9 | 0.12 | 10 | — | — | — | 51.1 | 0.27 | 9 |
| LYM703 | 69014.2 | — | — | — | 9.5 | 0.22 | 3 | — | — | — |
| LYM703 | 69014.3 | 1.0 | L | 15 | — | — | — | 49.8 | 0.18 | 6 |
| LYM703 | 69016.3 | — | — | — | 9.4 | 0.21 | 2 | — | — | — |
| LYM703 | 69019.1 | — | — | — | — | — | — | 60.8 | 0.26 | 30 |
| LYM695 | 69442.2 | 0.9 | 0.11 | 11 | — | — | — | 52.3 | 0.02 | 12 |
| LYM666 | 69774.4 | 0.9 | 0.25 | 13 | — | — | — | 51.3 | 0.18 | 9 |
| LYM595 | 68926.2 | — | — | — | 9.9 | 0.18 | 7 | — | — | — |
| LYM595 | 68926.3 | 0.9 | 0.21 | 4 | — | — | — | — | — | — |
| LYM586 | 69143.5 | — | — | — | 9.6 | 0.06 | 4 | — | — | — |
| LYM586 | 69145.2 | 0.9 | 0.14 | 5 | — | — | — | — | — | — |
| LYM548 | 69765.2 | — | — | — | 9.4 | 0.21 | 2 | — | — | — |
| LYM548 | 69765.4 | 0.9 | 0.04 | 7 | — | — | — | — | — | — |
| LYM548 | 69768.1 | — | — | — | 9.6 | 0.06 | 4 | — | — | — |
| LYM548 | 69769.1 | 1.0 | 0.03 | 20 | — | — | — | — | — | — |
| LYM535 | 69281.2 | 0.9 | 0.20 | 10 | — | — | — | 52.0 | 0.08 | 11 |
| LYM528 | 69469.2 | 0.9 | 0.16 | 12 | 9.4 | 0.21 | 2 | — | — | — |
| CONT. | — | 0.8 | — | — | 9.2 | — | — | 46.9 | — | — |
| LYM726 | 69752.3 | — | — | — | 9.7 | L | 7 | — | — | — |
| LYM724 | 69027.1 | 0.7 | 0.10 | 6 | — | — | — | — | — | — |
| LYM724 | 69030.2 | 0.7 | 0.08 | 9 | — | — | — | — | — | — |
| LYM717 | 69458.3 | — | — | — | 9.3 | 0.14 | 3 | — | — | — |
| LYM706 | 69022.3 | — | — | — | 9.3 | 0.14 | 3 | — | — | — |
| LYM689 | 69158.3 | 0.8 | 0.24 | 14 | — | — | — | 40.8 | 0.22 | 9 |
| LYM689 | 69160.3 | — | — | — | 9.7 | L | 7 | — | — | — |
| LYM662 | 68818.2 | — | — | — | 9.4 | 0.04 | 4 | — | — | — |
| LYM650 | 69359.2 | 0.8 | L | 14 | — | — | — | 41.0 | 0.02 | 10 |
| LYM650 | 69361.1 | 0.7 | 0.03 | 9 | 9.2 | 0.22 | 2 | — | — | — |
| LYM634 | 69593.1 | 0.7 | 0.13 | 5 | — | — | — | 39.0 | 0.30 | 4 |
| LYM624 | 68939.1 | 0.7 | 0.11 | 9 | — | — | — | 40.5 | 0.04 | 8 |
| LYM617 | 69584.1 | — | — | — | 9.4 | 0.18 | 3 | — | — | — |
| LYM608 | 69272.6 | 0.8 | 0.01 | 12 | — | — | — | — | — | — |
| LYM570 | 69428.3 | 0.8 | L | 18 | — | — | — | 43.7 | 0.15 | 17 |
| LYM558 | 68868.2 | 0.8 | 0.23 | 14 | — | — | — | — | — | — |
| LYM558 | 68868.5 | — | — | — | 9.4 | 0.24 | 4 | — | — | — |
| LYM557 | 68859.1 | — | — | — | — | — | — | 42.2 | L | 13 |
| LYM557 | 68859.2 | 0.8 | 0.02 | 13 | — | — | — | 39.9 | 0.13 | 7 |
| LYM545 | 69555.2 | 0.8 | 0.19 | 13 | — | — | — | — | — | — |
| LYM545 | 69557.2 | 0.9 | 0.01 | 31 | — | — | — | 48.9 | 0.05 | 30 |
| CONT. | — | 0.7 | — | — | 9.1 | — | — | 37.5 | — | — |
| LYM732 | 68364.1 | 1.7 | 0.13 | 20 | — | — | — | 102.5 | L | 17 |
| LYM718 | 68210.2 | — | — | — | — | — | — | 96.2 | 0.07 | 9 |
| LYM718 | 68214.3 | — | — | — | — | — | — | 93.3 | 0.02 | 6 |
| LYM718 | 68214.9 | 1.5 | 0.03 | 5 | — | — | — | 95.0 | L | 8 |
| LYM675 | 68240.2 | — | — | — | 11.9 | 0.15 | 4 | 95.8 | 0.01 | 9 |
| LYM590 | 68424.1 | 1.6 | 0.02 | 7 | — | — | — | 96.7 | L | 10 |
| CONT. | — | 1.4 | — | — | 11.4 | — | — | 87.9 | — | — |
| LYM725 | 69177.4 | 1.4 | 0.16 | 9 | — | — | — | 80.6 | 0.29 | 8 |
| LYM609 | 68559.1 | 1.4 | 0.19 | 10 | 11.9 | 0.01 | 10 | 91.0 | 0.04 | 22 |
| LYM609 | 68562.2 | 1.5 | 0.17 | 18 | — | — | — | 91.9 | 0.29 | 24 |
| LYM594 | 69287.3 | — | — | — | 11.6 | 0.07 | 7 | — | — | — |
| LYM594 | 69288.3 | — | — | — | 11.6 | 0.07 | 7 | — | — | — |
| LYM591 | 68918.1 | — | — | — | — | — | — | 85.9 | 0.08 | 15 |
| LYM589 | 68416.2 | — | — | — | 11.3 | 0.20 | 4 | — | — | — |
| LYM589 | 68418.4 | — | — | — | 11.2 | 0.18 | 4 | — | — | — |
| LYM566 | 69082.1 | 1.5 | 0.12 | 16 | 11.8 | 0.02 | 8 | 91.9 | 0.02 | 24 |
| CONT. | — | 1.3 | — | — | 10.8 | — | — | 74.4 | — | — |
| LYM698 | 69329.2 | 0.8 | 0.03 | 17 | — | — | — | — | — | — |
| LYM698 | 69330.4 | 0.8 | 0.25 | 16 | — | — | — | — | — | — |
| LYM677 | 68522.1 | — | — | — | 9.4 | 0.26 | 2 | — | — | — |
| LYM677 | 68524.3 | 0.8 | 0.12 | 24 | 9.9 | L | 7 | 50.3 | 0.08 | 25 |
| LYM643 | 69154.1 | 0.8 | 0.28 | 20 | — | — | — | — | — | — |

TABLE 53-continued

Genes showing improved plant performance at normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM643 | 69155.1 | 0.7 | 0.09 | 11 | — | — | — | — | — | — |
| LYM643 | 69157.5 | 0.8 | 0.04 | 18 | — | — | — | 46.2 | 0.06 | 15 |
| LYM621 | 69147.1 | 0.7 | 0.20 | 10 | — | — | — | — | — | — |
| LYM621 | 69151.2 | 0.7 | 0.22 | 8 | — | — | — | — | — | — |
| LYM616 | 68472.4 | 0.8 | 0.02 | 18 | — | — | — | 44.1 | 0.19 | 10 |
| LYM613 | 68285.3 | 0.8 | 0.03 | 19 | — | — | — | 45.6 | 0.16 | 13 |
| LYM601 | 69087.3 | — | — | — | 9.7 | 0.02 | 4 | — | — | — |
| LYM601 | 69089.2 | 0.7 | 0.27 | 7 | — | — | — | — | — | — |
| LYM600 | 68433.2 | 0.7 | 0.25 | 8 | 9.8 | 0.27 | 5 | 44.1 | 0.18 | 10 |
| LYM581 | 68403.3 | 0.8 | 0.29 | 20 | — | — | — | 46.7 | 0.05 | 16 |
| LYM581 | 68406.3 | 0.7 | 0.16 | 9 | — | — | — | — | — | — |
| LYM567 | 68874.3 | 0.7 | 0.09 | 12 | — | — | — | 44.0 | 0.19 | 9 |
| LYM565 | 69077.1 | 0.7 | 0.17 | 12 | — | — | — | — | — | — |
| CONT. | — | 0.7 | — | — | 9.3 | — | — | 40.2 | — | — |
| LYM660 | 68513.1 | 1.5 | 0.01 | 11 | — | — | — | 89.2 | 0.23 | 9 |
| LYM647 | 68489.2 | 1.5 | 0.04 | 11 | 11.4 | 0.03 | 6 | 91.4 | 0.27 | 12 |
| LYM618 | 68171.2 | 1.5 | 0.11 | 6 | — | — | — | — | — | — |
| LYM618 | 68173.5 | 1.5 | 0.21 | 7 | 11.4 | 0.17 | 6 | 89.7 | 0.11 | 10 |
| LYM618 | 68173.6 | 1.4 | 0.10 | 5 | 11.7 | 0.13 | 9 | — | — | — |
| LYM609 | 68559.5 | — | — | — | 11.2 | 0.22 | 4 | — | — | — |
| LYM604 | 68444.3 | — | — | — | 11.5 | 0.25 | 7 | — | — | — |
| LYM604 | 68447.1 | — | — | — | 11.1 | 0.21 | 3 | 89.2 | 0.04 | 9 |
| LYM600 | 68433.2 | 1.6 | 0.17 | 14 | 12.2 | L | 14 | 99.8 | 0.21 | 22 |
| LYM600 | 68434.1 | — | — | — | 11.5 | 0.03 | 7 | — | — | — |
| LYM598 | 68426.4 | — | — | — | 11.4 | 0.22 | 6 | 87.4 | 0.26 | 7 |
| LYM598 | 68430.1 | — | — | — | 11.8 | 0.17 | 9 | — | — | — |
| LYM581 | 68403.3 | 1.5 | 0.25 | 10 | — | — | — | 92.5 | L | 13 |
| LYM581 | 68405.6 | — | — | — | 11.1 | 0.25 | 3 | — | — | — |
| LYM581 | 68406.3 | — | — | — | 11.8 | 0.17 | 9 | 87.9 | 0.10 | 7 |
| LYM573 | 68276.1 | — | — | — | 11.8 | 0.02 | 10 | — | — | — |
| LYM573 | 68279.3 | 1.5 | 0.01 | 9 | — | — | — | 89.4 | 0.07 | 9 |
| LYM525 | 68578.4 | 1.5 | L | 11 | 11.4 | 0.04 | 6 | 94.5 | 0.02 | 15 |
| CONT. | — | 1.4 | — | — | 10.8 | — | — | 81.9 | — | — |

Table 53. "CONT."—Control; "Ave."—Average; "% Incr." = % increment; "p-val."—p-value, L—p < 0.01.

TABLE 54

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM691 | 69779.3 | — | — | — | 12.8 | 0.22 | 19 | — | — | — |
| LYM680 | 68976.1 | 0.7 | 0.29 | 15 | — | — | — | — | — | — |
| LYM673 | 68765.1 | 0.7 | 0.25 | 17 | — | — | — | — | — | — |
| LYM673 | 68766.2 | 0.8 | 0.14 | 20 | — | — | — | — | — | — |
| LYM670 | 70554.2 | 0.7 | 0.21 | 18 | — | — | — | — | — | — |
| LYM642 | 69195.1 | 0.8 | 0.18 | 19 | — | — | — | — | — | — |
| LYM642 | 69198.1 | — | — | — | 12.6 | 0.26 | 18 | — | — | — |
| LYM615 | 70539.1 | — | — | — | 12.9 | 0.22 | 20 | — | — | — |
| LYM592 | 69577.3 | 0.8 | 0.03 | 30 | — | — | — | — | — | — |
| LYM588 | 68914.10 | 0.7 | 0.25 | 16 | — | — | — | — | — | — |
| LYM574 | 70638.1 | 0.7 | 0.19 | 18 | — | — | — | — | — | — |
| LYM574 | 70639.5 | 0.8 | 0.12 | 23 | — | — | — | — | — | — |
| CONT. | — | 0.6 | — | — | 10.7 | — | — | — | — | — |
| LYM724 | 69027.1 | 0.8 | 0.05 | 23 | — | — | — | — | — | — |
| LYM724 | 69030.2 | — | — | — | 7.9 | 0.03 | 52 | 0.5 | 0.17 | 20 |
| LYM724 | 69031.4 | — | — | — | 6.9 | 0.14 | 34 | — | — | — |
| LYM690 | 68768.3 | — | — | — | 6.5 | 0.24 | 27 | — | — | — |
| LYM690 | 68769.3 | — | — | — | 7.6 | 0.08 | 46 | — | — | — |
| LYM690 | 68773.7 | 0.8 | 0.21 | 18 | 7.2 | 0.09 | 40 | 0.5 | 0.24 | 17 |
| LYM688 | 68192.3 | — | — | — | 6.8 | 0.18 | 31 | 0.4 | 0.24 | 17 |
| LYM669 | 70649.3 | — | — | — | 8.6 | L | 67 | 0.5 | 0.09 | 24 |
| LYM669 | 70651.2 | — | — | — | 7.1 | 0.11 | 37 | 0.5 | 0.20 | 18 |
| LYM644 | 69304.3 | — | — | — | 7.1 | 0.13 | 37 | — | — | — |
| LYM638 | 70077.2 | — | — | — | 6.5 | 0.27 | 25 | — | — | — |
| LYM625 | 70073.1 | — | — | — | 7.7 | 0.04 | 49 | 0.4 | 0.25 | 16 |

TABLE 54-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM622 | 70545.5 | — | — | — | 7.4 | 0.06 | 44 | 0.4 | 0.23 | 17 |
| LYM606 | 70352.1 | — | — | — | 7.4 | 0.08 | 42 | 0.5 | 0.12 | 22 |
| LYM591 | 68922.1 | 0.7 | 0.26 | 13 | — | — | — | — | — | — |
| LYM583 | 70154.1 | — | — | — | 7.6 | 0.05 | 47 | 0.5 | 0.15 | 20 |
| LYM583 | 70159.3 | — | — | — | 8.9 | L | 71 | 0.5 | 0.14 | 21 |
| LYM569 | 69124.2 | — | — | — | 6.6 | 0.23 | 27 | — | — | — |
| LYM566 | 69081.2 | — | — | — | 6.7 | 0.21 | 29 | — | — | — |
| LYM536 | 68590.5 | — | — | — | 8.1 | 0.02 | 57 | 0.5 | 0.11 | 22 |
| LYM536 | 68592.5 | 0.8 | 0.21 | 15 | — | — | — | — | — | — |
| CONT. | — | 0.7 | — | — | 5.2 | — | — | 0.4 | — | — |
| LYM703 | 69019.1 | — | — | — | 8.0 | 0.06 | 29 | 0.5 | 0.24 | 10 |
| CONT. | — | — | — | — | 6.2 | — | — | 0.4 | — | — |
| LYM689 | 69158.3 | — | — | — | — | — | — | 0.4 | 0.23 | 8 |
| LYM689 | 69160.4 | — | — | — | — | — | — | 0.4 | 0.24 | 8 |
| LYM650 | 69359.2 | — | — | — | — | — | — | 0.4 | 0.10 | 11 |
| LYM570 | 69428.3 | — | — | — | 5.8 | 0.23 | 16 | — | — | — |
| LYM545 | 69557.2 | — | — | — | 6.4 | 0.04 | 30 | 0.5 | 0.09 | 14 |
| CONT. | — | — | — | — | 5.0 | — | — | 0.4 | — | — |
| LYM732 | 68364.1 | — | — | — | 11.8 | 0.09 | 17 | 0.6 | L | 16 |
| LYM718 | 68214.3 | — | — | — | — | — | — | 0.5 | 0.07 | 10 |
| LYM694 | 68530.4 | 0.8 | 0.25 | 12 | — | — | — | — | — | — |
| LYM677 | 68526.1 | — | — | — | — | — | — | 0.5 | 0.28 | 8 |
| LYM675 | 68240.2 | 0.8 | 0.19 | 13 | 11.1 | 0.28 | 10 | 0.5 | 0.30 | 5 |
| LYM630 | 68175.4 | — | — | — | — | — | — | 0.5 | 0.19 | 8 |
| LYM630 | 68175.5 | — | — | — | 11.4 | 0.23 | 12 | 0.5 | 0.29 | 7 |
| LYM602 | 68442.8 | — | — | — | — | — | — | 0.5 | 0.26 | 7 |
| LYM590 | 68424.1 | — | — | — | 11.4 | 0.19 | 13 | 0.5 | 0.11 | 8 |
| LYM580 | 68402.3 | 0.8 | 0.19 | 13 | 11.5 | 0.19 | 14 | — | — | — |
| LYM568 | 68384.3 | — | — | — | — | — | — | 0.5 | 0.28 | 7 |
| CONT. | — | 0.7 | — | — | 10.1 | — | — | 0.5 | — | — |
| LYM679 | 69323.2 | 0.8 | 0.28 | 11 | — | — | — | — | — | — |
| LYM674 | 68186.5 | 0.8 | 0.20 | 13 | — | — | — | — | — | — |
| LYM609 | 68559.1 | — | — | — | 11.3 | 0.19 | 22 | — | — | — |
| LYM609 | 68559.5 | 0.8 | 0.18 | 14 | — | — | — | — | — | — |
| LYM609 | 68562.2 | — | — | — | 11.4 | 0.18 | 23 | — | — | — |
| LYM594 | 69287.3 | 0.8 | 0.13 | 15 | — | — | — | — | — | — |
| LYM589 | 68416.1 | 0.8 | 0.17 | 14 | — | — | — | — | — | — |
| LYM580 | 68402.2 | 0.8 | 0.28 | 11 | — | — | — | — | — | — |
| LYM569 | 69126.1 | 0.8 | 0.24 | 12 | — | — | — | — | — | — |
| LYM566 | 69082.1 | 0.8 | 0.26 | 11 | 11.4 | 0.16 | 24 | 0.5 | 0.28 | 12 |
| LYM550 | 68848.11 | 0.8 | 0.29 | 10 | — | — | — | — | — | — |
| CONT. | — | 0.7 | — | — | 9.2 | — | — | 0.4 | — | — |
| LYM712 | 69174.1 | 0.8 | 0.25 | 14 | — | — | — | — | — | — |
| LYM698 | 69329.2 | — | — | — | — | — | — | 0.4 | 0.27 | 9 |
| LYM677 | 68524.3 | — | — | — | 6.6 | 0.10 | 24 | 0.4 | 0.06 | 15 |
| LYM643 | 69157.4 | — | — | — | — | — | — | 0.4 | 0.28 | 8 |
| LYM643 | 69157.5 | — | — | — | 6.2 | 0.29 | 15 | 0.4 | 0.13 | 12 |
| LYM616 | 68469.2 | — | — | — | 6.3 | 0.27 | 17 | — | — | — |
| LYM600 | 68433.2 | — | — | — | — | — | — | 0.4 | 0.29 | 8 |
| LYM581 | 68403.3 | — | — | — | 6.2 | 0.29 | 15 | — | — | — |
| LYM565 | 69079.3 | 0.8 | 0.29 | 11 | — | — | — | — | — | — |
| CONT. | — | 0.7 | — | — | 5.4 | — | — | 0.4 | — | — |
| LYM647 | 68489.2 | — | — | — | 10.7 | 0.21 | 13 | — | — | — |
| LYM618 | 68173.6 | 0.7 | 0.21 | 15 | — | — | — | — | — | — |
| LYM609 | 68559.1 | — | — | — | 11.0 | 0.13 | 17 | 0.5 | 0.11 | 10 |
| LYM604 | 68444.3 | 0.7 | 0.24 | 13 | — | — | — | — | — | — |
| LYM600 | 68433.2 | 0.8 | 0.02 | 28 | 11.5 | 0.05 | 22 | 0.5 | 0.29 | 6 |
| LYM600 | 68436.3 | 0.7 | 0.13 | 19 | — | — | — | — | — | — |
| LYM598 | 68430.1 | 0.7 | 0.19 | 17 | — | — | — | — | — | — |
| LYM589 | 68416.2 | 0.7 | 0.30 | 11 | — | — | — | — | — | — |
| LYM581 | 68403.3 | — | — | — | 10.6 | 0.22 | 13 | — | — | — |
| LYM573 | 68276.2 | 0.7 | 0.27 | 14 | — | — | — | — | — | — |
| LYM525 | 68578.4 | — | — | — | 10.9 | 0.12 | 15 | 0.5 | 0.24 | 6 |
| CONT. | — | 0.6 | — | — | 9.4 | — | — | 0.5 | — | — |

Table 54. "CONT."—Control; "Ave."—Average; "% Incr." = % increment; "p-val."—p-value, L—p < 0.01.

TABLE 55

Genes showing improved plant performance at normal growth conditions under regulation of At6669 promoter

| Gene Name | Event # | Harvest Index Ave. | Harvest Index P-Val. | Harvest Index % Incr. | Rosette Area [cm²] Ave. | Rosette Area [cm²] P-Val. | Rosette Area [cm²] % Incr. | Rosette Diameter [cm] Ave. | Rosette Diameter [cm] P-Val. | Rosette Diameter [cm] % Incr. |
|---|---|---|---|---|---|---|---|---|---|---|
| LYM749 | 70679.3 | — | — | — | 12.1 | 0.18 | 14 | 5.9 | 0.16 | 6 |
| LYM712 | 69171.1 | — | — | — | 11.5 | 0.20 | 8 | 6.0 | 0.09 | 6 |
| LYM698 | 69329.3 | — | — | — | 11.8 | 0.19 | 11 | 6.0 | 0.12 | 7 |
| LYM697 | 69003.1 | — | — | — | 12.0 | 0.28 | 13 | — | — | — |
| LYM691 | 69779.3 | — | — | — | 12.5 | 0.03 | 18 | 6.2 | 0.21 | 11 |
| LYM643 | 69157.5 | — | — | — | 11.4 | 0.25 | 7 | — | — | — |
| LYM642 | 69198.1 | — | — | — | 12.6 | 0.07 | 18 | 6.0 | 0.10 | 7 |
| LYM615 | 70539.1 | — | — | — | 12.7 | 0.18 | 20 | 6.2 | 0.12 | 10 |
| LYM565 | 69077.1 | — | — | — | 12.2 | 0.04 | 15 | 6.1 | 0.04 | 8 |
| CONT. | — | — | — | — | 10.6 | — | — | 5.6 | — | — |
| LYM724 | 69030.2 | — | — | — | 7.4 | 0.01 | 53 | 4.8 | 0.02 | 28 |
| LYM724 | 69031.4 | — | — | — | 6.5 | 0.30 | 36 | 4.5 | 0.26 | 19 |
| LYM690 | 68768.3 | — | — | — | 6.2 | 0.13 | 28 | 4.2 | 0.24 | 13 |
| LYM690 | 68773.7 | — | — | — | 6.7 | 0.11 | 40 | 4.5 | 0.16 | 19 |
| LYM688 | 68192.3 | — | — | — | 6.4 | 0.04 | 32 | 4.4 | 0.02 | 19 |
| LYM688 | 68194.1 | — | — | — | 5.7 | 0.28 | 19 | 4.1 | 0.16 | 9 |
| LYM679 | 69320.1 | — | — | — | 5.6 | 0.30 | 17 | 4.2 | 0.25 | 11 |
| LYM669 | 70649.3 | — | — | — | 8.2 | L | 70 | 5.0 | L | 34 |
| LYM669 | 70651.2 | — | — | — | 6.6 | 0.04 | 37 | 4.5 | 0.01 | 21 |
| LYM640 | 68948.1 | — | — | — | 5.9 | 0.19 | 22 | 4.2 | 0.18 | 11 |
| LYM640 | 68950.2 | — | — | — | — | — | — | 4.0 | 0.28 | 8 |
| LYM625 | 70072.2 | — | — | — | 5.7 | 0.23 | 18 | — | — | — |
| LYM625 | 70073.1 | — | — | — | 7.2 | L | 50 | 4.6 | L | 23 |
| LYM622 | 70544.2 | — | — | — | 5.6 | 0.24 | 16 | 4.0 | 0.27 | 8 |
| LYM622 | 70545.5 | — | — | — | 7.0 | 0.04 | 44 | 4.6 | 0.03 | 22 |
| LYM622 | 70548.2 | — | — | — | 5.8 | 0.20 | 20 | 4.2 | 0.20 | 13 |
| LYM606 | 70352.1 | — | — | — | 6.9 | 0.08 | 44 | 4.7 | 0.04 | 26 |
| LYM591 | 68922.1 | — | — | — | — | — | — | 4.1 | 0.23 | 10 |
| LYM583 | 70154.1 | — | — | — | 7.1 | 0.05 | 47 | 4.6 | 0.01 | 24 |
| LYM583 | 70159.3 | — | — | — | 8.4 | L | 74 | 4.9 | L | 31 |
| LYM569 | 69123.3 | — | — | — | 5.8 | 0.26 | 21 | 4.1 | 0.27 | 11 |
| LYM569 | 69124.2 | — | — | — | 6.2 | 0.23 | 28 | 4.3 | 0.27 | 15 |
| LYM566 | 69081.2 | — | — | — | 6.2 | 0.14 | 30 | 4.2 | 0.08 | 13 |
| LYM536 | 68590.5 | — | — | — | 7.6 | L | 59 | 4.8 | L | 29 |
| CONT. | — | — | — | — | 4.8 | — | — | 3.7 | — | — |
| LYM734 | 69050.4 | 0.4 | 0.22 | 28 | — | — | — | — | — | — |
| LYM734 | 69050.6 | — | — | — | 6.4 | 0.17 | 10 | 4.7 | 0.23 | 6 |
| LYM734 | 69053.3 | 0.3 | 0.28 | 6 | — | — | — | — | — | — |
| LYM734 | 69055.1 | — | — | — | 6.3 | 0.04 | 8 | — | — | — |
| LYM723 | 68823.1 | 0.4 | L | 22 | — | — | — | — | — | — |
| LYM714 | 69616.2 | 0.3 | 0.12 | 10 | — | — | — | — | — | — |
| LYM714 | 69618.2 | 0.3 | 0.10 | 14 | — | — | — | — | — | — |
| LYM714 | 69619.1 | 0.3 | 0.12 | 10 | — | — | — | — | — | — |
| LYM705 | 69266.1 | — | — | — | 6.4 | 0.03 | 9 | — | — | — |
| LYM705 | 69270.1 | 0.3 | 0.29 | 19 | — | — | — | — | — | — |
| LYM705 | 69270.2 | 0.4 | 0.21 | 22 | — | — | — | — | — | — |
| LYM704 | 69454.1 | 0.3 | 0.22 | 6 | — | — | — | — | — | — |
| LYM704 | 69454.2 | — | — | — | 6.4 | 0.27 | 9 | 4.7 | 0.08 | 6 |
| LYM704 | 69456.1 | 0.3 | 0.23 | 6 | — | — | — | — | — | — |
| LYM703 | 69014.2 | 0.3 | 0.03 | 15 | — | — | — | — | — | — |
| LYM703 | 69014.3 | 0.4 | 0.02 | 24 | 6.2 | 0.18 | 6 | 4.6 | 0.26 | 3 |
| LYM703 | 69018.5 | 0.3 | 0.01 | 16 | — | — | — | — | — | — |
| LYM703 | 69019.1 | — | — | — | 7.6 | 0.26 | 30 | 5.1 | 0.29 | 14 |
| LYM699 | 69008.1 | 0.4 | L | 24 | — | — | — | — | — | — |
| LYM699 | 69010.2 | 0.3 | 0.06 | 10 | — | — | — | — | — | — |
| LYM697 | 69002.2 | 0.4 | 0.05 | 27 | — | — | — | — | — | — |
| LYM697 | 69004.2 | 0.4 | 0.24 | 26 | — | — | — | — | — | — |
| LYM697 | 69006.1 | 0.4 | L | 32 | — | — | — | — | — | — |
| LYM695 | 69440.1 | 0.3 | 0.07 | 13 | — | — | — | — | — | — |
| LYM695 | 69442.2 | — | — | — | 6.5 | 0.02 | 12 | 4.7 | 0.08 | 5 |
| LYM666 | 69774.4 | 0.3 | 0.25 | 15 | 6.4 | 0.18 | 9 | 4.8 | 0.10 | 7 |
| LYM607 | 69363.2 | 0.3 | 0.19 | 11 | — | — | — | — | — | — |
| LYM607 | 69363.4 | 0.3 | 0.03 | 13 | — | — | — | — | — | — |
| LYM607 | 69366.1 | 0.4 | L | 28 | — | — | — | — | — | — |
| LYM603 | 69299.2 | 0.3 | L | 19 | — | — | — | — | — | — |
| LYM603 | 69301.1 | 0.3 | 0.28 | 6 | — | — | — | — | — | — |
| LYM595 | 68925.1 | 0.3 | 0.02 | 14 | — | — | — | — | — | — |
| LYM595 | 68926.3 | 0.3 | 0.12 | 15 | — | — | — | — | — | — |
| LYM595 | 68928.2 | 0.4 | 0.08 | 21 | — | — | — | — | — | — |
| LYM586 | 69143.5 | 0.3 | 0.01 | 16 | — | — | — | — | — | — |
| LYM586 | 69144.4 | 0.4 | L | 22 | — | — | — | — | — | — |
| LYM548 | 69765.2 | 0.3 | 0.24 | 13 | — | — | — | — | — | — |
| LYM548 | 69765.4 | — | — | — | — | — | — | 4.6 | 0.23 | 4 |

TABLE 55-continued

Genes showing improved plant performance at normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM548 | 69768.1 | 0.3 | 0.25 | 14 | — | — | — | — | — | — |
| LYM548 | 69769.1 | — | — | — | — | — | — | 4.8 | 0.20 | 8 |
| LYM535 | 69281.2 | — | — | — | 6.5 | 0.08 | 11 | 4.8 | 0.03 | 7 |
| LYM528 | 69464.2 | 0.3 | 0.23 | 13 | — | — | — | — | — | — |
| LYM528 | 69464.4 | 0.3 | 0.05 | 12 | — | — | — | — | — | — |
| LYM528 | 69469.2 | 0.3 | 0.29 | 5 | — | — | — | — | — | — |
| CONT. | — | 0.3 | — | — | 5.9 | — | — | 4.5 | — | — |
| LYM724 | 69027.1 | — | — | — | — | — | — | 4.1 | 0.28 | 3 |
| LYM717 | 69458.3 | 0.4 | 0.13 | 15 | — | — | — | — | — | — |
| LYM706 | 69022.3 | 0.4 | 0.12 | 11 | — | — | — | — | — | — |
| LYM689 | 69158.3 | — | — | — | 5.1 | 0.22 | 9 | — | — | — |
| LYM689 | 69160.4 | 0.4 | 0.04 | 21 | — | — | — | — | — | — |
| LYM650 | 69358.3 | 0.4 | 0.11 | 10 | — | — | — | — | — | — |
| LYM650 | 69359.2 | 0.4 | 0.29 | 21 | 5.1 | 0.02 | 10 | 4.2 | 0.01 | 7 |
| LYM650 | 69360.2 | 0.4 | L | 21 | — | — | — | — | — | — |
| LYM650 | 69361.1 | 0.4 | 0.11 | 22 | — | — | — | — | — | — |
| LYM650 | 69361.2 | 0.4 | 0.01 | 16 | — | — | — | — | — | — |
| LYM634 | 69593.1 | — | — | — | 4.9 | 0.30 | 4 | 4.1 | 0.26 | 3 |
| LYM624 | 68936.1 | — | — | — | — | — | — | 4.1 | 0.23 | 3 |
| LYM624 | 68939.1 | — | — | — | 5.1 | 0.04 | 8 | 4.1 | 0.22 | 3 |
| LYM608 | 69276.1 | 0.4 | 0.12 | 16 | — | — | — | — | — | — |
| LYM576 | 69567.1 | 0.4 | 0.22 | 16 | — | — | — | — | — | — |
| LYM576 | 69570.6 | 0.3 | 0.16 | 9 | — | — | — | — | — | — |
| LYM570 | 69428.3 | — | — | — | 5.5 | 0.15 | 17 | 4.3 | 0.17 | 8 |
| LYM558 | 68865.1 | 0.4 | 0.01 | 21 | — | — | — | — | — | — |
| LYM558 | 68869.1 | 0.3 | 0.25 | 6 | — | — | — | — | — | — |
| LYM557 | 68858.2 | 0.4 | L | 25 | — | — | — | — | — | — |
| LYM557 | 68859.1 | — | — | — | 5.3 | L | 13 | — | — | — |
| LYM557 | 68859.2 | — | — | — | 5.0 | 0.13 | 7 | — | — | — |
| LYM545 | 69557.2 | — | — | — | 6.1 | 0.05 | 30 | 4.6 | L | 16 |
| CONT. | — | 0.3 | — | — | 4.7 | — | — | 4.0 | — | — |
| LYM732 | 68363.4 | 0.3 | 0.16 | 10 | — | — | — | — | — | — |
| LYM732 | 68364.1 | — | — | - | 12.8 | L | 17 | 6.5 | L | 14 |
| LYM718 | 68210.2 | — | — | - | 12.0 | 0.07 | 9 | 5.8 | 0.07 | 3 |
| LYM718 | 68214.3 | — | — | - | 11.7 | 0.02 | 6 | — | — | — |
| LYM718 | 68214.4 | 0.4 | 0.17 | 16 | — | — | — | — | — | — |
| LYM718 | 68214.9 | — | — | - | 11.9 | L | 8 | — | — | — |
| LYM716 | 68206.4 | 0.3 | 0.20 | 8 | — | — | — | — | — | — |
| LYM694 | 68528.1 | 0.3 | 0.18 | 9 | — | — | — | — | — | — |
| LYM694 | 68530.4 | 0.4 | 0.16 | 19 | — | — | — | — | — | — |
| LYM677 | 68524.3 | 0.3 | 0.19 | 11 | — | — | — | — | — | — |
| LYM677 | 68526.2 | 0.4 | 0.20 | 20 | — | — | — | — | — | — |
| LYM675 | 68240.2 | — | — | - | 12.0 | 0.01 | 9 | 5.9 | 0.26 | 4 |
| LYM630 | 68175.4 | 0.4 | 0.09 | 18 | — | — | — | — | — | — |
| LYM630 | 68175.5 | 0.3 | 0.16 | 10 | — | — | — | — | — | — |
| LYM613 | 68285.4 | 0.4 | 0.13 | 17 | — | — | — | — | — | — |
| LYM602 | 68442.1 | 0.3 | 0.20 | 10 | — | — | — | — | — | — |
| LYM590 | 68423.1 | 0.4 | 0.02 | 18 | — | — | — | — | — | — |
| LYM590 | 68423.2 | 0.3 | 0.29 | 7 | — | — | — | — | — | — |
| LYM590 | 68424.1 | 0.3 | 0.18 | 14 | 12.1 | L | 10 | — | — | — |
| LYM568 | 68386.1 | 0.3 | 0.30 | 15 | — | — | — | — | — | — |
| LYM568 | 68386.3 | 0.3 | 0.18 | 12 | — | — | — | — | — | — |
| LYM532 | 68380.1 | 0.4 | 0.07 | 17 | — | — | — | — | — | — |
| LYM532 | 68380.2 | 0.3 | 0.21 | 9 | — | — | — | — | — | — |
| CONT. | — | 0.3 | — | — | 11.0 | — | — | 5.7 | — | — |
| LYM725 | 69177.4 | — | — | — | 10.1 | 0.29 | 8 | 5.4 | 0.27 | 5 |
| LYM680 | 68974.1 | 0.4 | L | 24 | — | — | — | — | — | — |
| LYM679 | 69321.1 | 0.3 | 0.25 | 7 | — | — | — | — | — | — |
| LYM679 | 69321.2 | 0.4 | 0.19 | 15 | — | — | — | — | — | — |
| LYM678 | 68369.2 | 0.4 | 0.22 | 17 | — | — | — | — | — | — |
| LYM678 | 68369.3 | 0.4 | 0.03 | 14 | — | — | — | — | — | — |
| LYM678 | 68371.3 | 0.4 | 0.02 | 17 | — | — | — | — | — | — |
| LYM674 | 68186.6 | 0.3 | 0.29 | 6 | — | — | — | — | — | — |
| LYM612 | 68459.2 | 0.4 | 0.10 | 14 | — | — | — | — | — | — |
| LYM609 | 68559.1 | — | — | — | 11.4 | 0.04 | 22 | 5.4 | 0.12 | 7 |
| LYM609 | 68559.5 | 0.4 | 0.11 | 12 | — | — | — | — | — | — |
| LYM609 | 68562.2 | 0.3 | 0.14 | 8 | 11.5 | 0.29 | 24 | 5.8 | 0.22 | 14 |
| LYM591 | 68918.1 | 0.4 | 0.27 | 11 | 10.7 | 0.08 | 15 | 5.6 | 0.03 | 11 |
| LYM591 | 68920.3 | 0.4 | 0.01 | 18 | — | — | — | — | — | — |
| LYM590 | 68422.1 | 0.4 | 0.11 | 13 | — | — | — | — | — | — |
| LYM590 | 68422.3 | 0.3 | 0.13 | 9 | — | — | — | — | — | — |
| LYM589 | 68416.1 | 0.4 | 0.19 | 15 | — | — | — | — | — | — |
| LYM588 | 68914.8 | 0.4 | 0.12 | 13 | — | — | — | — | — | — |

TABLE 55-continued

Genes showing improved plant performance at normal growth conditions under regulation of At6669 promoter

| Gene Name | Event # | Harvest Index Ave. | Harvest Index P-Val. | Harvest Index % Incr. | Rosette Area [cm$^2$] Ave. | Rosette Area [cm$^2$] P-Val. | Rosette Area [cm$^2$] % Incr. | Rosette Diameter [cm] Ave. | Rosette Diameter [cm] P-Val. | Rosette Diameter [cm] % Incr. |
|---|---|---|---|---|---|---|---|---|---|---|
| LYM569 | 69125.1 | 0.3 | 0.27 | 7 | — | — | — | — | — | — |
| LYM569 | 69127.1 | 0.4 | 0.05 | 19 | — | — | — | — | — | — |
| LYM566 | 69082.1 | — | — | — | 11.5 | 0.02 | 24 | 5.7 | 0.02 | 12 |
| LYM550 | 68846.1 | 0.3 | 0.11 | 9 | — | — | — | — | — | — |
| LYM550 | 68848.8 | 0.4 | 0.05 | 23 | — | — | — | — | — | — |
| CONT. | — | 0.3 | — | — | 9.3 | — | — | 5.1 | — | — |
| LYM698 | 69329.2 | — | — | — | — | — | — | 4.2 | 0.16 | 6 |
| LYM677 | 68524.3 | 0.4 | 0.20 | 15 | 6.3 | 0.08 | 25 | 4.5 | 0.01 | 14 |
| LYM643 | 69157.5 | — | — | — | 5.8 | 0.06 | 15 | 4.3 | 0.04 | 10 |
| LYM616 | 68472.4 | — | — | — | 5.5 | 0.19 | 10 | 4.2 | 0.13 | 6 |
| LYM613 | 68285.3 | — | — | — | 5.7 | 0.16 | 13 | 4.3 | 0.10 | 8 |
| LYM601 | 69087.5 | — | — | — | — | — | — | 4.2 | 0.13 | 6 |
| LYM600 | 68433.2 | — | — | — | 5.5 | 0.18 | 10 | 4.2 | 0.15 | 6 |
| LYM581 | 68403.3 | 0.4 | 0.18 | 15 | 5.8 | 0.05 | 16 | 4.1 | 0.20 | 5 |
| LYM567 | 68874.3 | 0.5 | 0.03 | 33 | 5.5 | 0.19 | 9 | — | — | — |
| CONT. | — | 0.4 | — | — | 5.0 | — | — | 3.9 | — | — |
| LYM660 | 68513.1 | — | — | — | 11.2 | 0.23 | 9 | 5.8 | 0.28 | 4 |
| LYM660 | 68513.4 | 0.3 | 0.17 | 14 | — | — | — | — | — | — |
| LYM647 | 68488.1 | 0.3 | 0.20 | 12 | — | — | — | — | — | — |
| LYM647 | 68489.2 | — | — | — | 11.4 | 0.27 | 12 | 5.9 | 0.23 | 6 |
| LYM631 | 68348.6 | 0.3 | 0.29 | 12 | — | — | — | — | — | — |
| LYM631 | 68352.1 | 0.3 | 0.26 | 11 | — | — | — | — | — | — |
| LYM618 | 68173.3 | 0.3 | 0.07 | 22 | — | — | — | — | — | — |
| LYM618 | 68173.5 | — | — | — | 11.2 | 0.11 | 10 | — | — | — |
| LYM618 | 68173.6 | 0.3 | 0.10 | 18 | — | — | — | 5.8 | 0.15 | 4 |
| LYM609 | 68559.5 | 0.3 | 0.10 | 18 | — | — | — | — | — | — |
| LYM604 | 68444.3 | — | — | — | — | — | — | 5.8 | 0.30 | 4 |
| LYM604 | 68446.4 | 0.3 | 0.09 | 18 | — | — | — | — | — | — |
| LYM604 | 68447.1 | 0.3 | 0.05 | 22 | 11.1 | 0.04 | 9 | 5.8 | 0.11 | 3 |
| LYM600 | 68433.2 | — | — | — | 12.5 | 0.21 | 22 | — | — | — |
| LYM600 | 68434.1 | 0.3 | 0.17 | 14 | — | — | — | — | — | — |
| LYM598 | 68426.4 | — | — | — | 10.9 | 0.26 | 7 | — | — | — |
| LYM598 | 68429.2 | 0.3 | 0.11 | 16 | — | — | — | — | — | — |
| LYM598 | 68430.1 | 0.3 | 0.20 | 14 | — | — | — | — | — | — |
| LYM589 | 68415.3 | 0.3 | 0.07 | 22 | — | — | — | — | — | — |
| LYM589 | 68416.1 | 0.3 | 0.14 | 15 | — | — | — | — | — | — |
| LYM589 | 68416.2 | 0.3 | 0.16 | 20 | — | — | — | — | — | — |
| LYM581 | 68403.3 | — | — | — | 11.6 | L | 13 | 5.9 | 0.02 | 6 |
| LYM581 | 68406.3 | — | — | — | 11.0 | 0.10 | 7 | — | — | — |
| LYM575 | 68268.3 | 0.3 | 0.05 | 21 | — | — | — | — | — | — |
| LYM573 | 68276.1 | 0.3 | 0.03 | 26 | — | — | — | — | — | — |
| LYM573 | 68279.3 | — | — | — | 11.2 | 0.07 | 9 | 5.7 | 0.19 | 3 |
| LYM525 | 68578.1 | 0.3 | 0.14 | 15 | — | — | — | — | — | — |
| LYM525 | 68578.4 | — | — | — | 11.8 | 0.02 | 15 | 6.1 | 0.20 | 10 |
| LYM525 | 68580.4 | 0.3 | 0.28 | 10 | — | — | — | — | — | — |
| CONT. | — | 0.3 | — | — | 10.2 | — | — | 5.6 | — | — |

Table 55. "CONT."—Control; "Ave."—Average; "% Incr." = % increment; "p-val."—p-value, L—p < 0.01.

TABLE 56

Genes showing improved plant performance at normal growth conditions under regulation of At6669 promoter

| Gene Name | Event # | Seed Yield [mg] Ave. | Seed Yield [mg] P-Val. | Seed Yield [mg] % Incr. | 1000 Seed Weight [mg] Ave. | 1000 Seed Weight [mg] P-Val. | 1000 Seed Weight [mg] % Incr. |
|---|---|---|---|---|---|---|---|
| LYM734 | 69050.6 | 255.5 | 0.02 | 19 | — | — | — |
| LYM723 | 68823.1 | 250.1 | 0.04 | 17 | — | — | — |
| LYM723 | 68825.4 | 265.9 | 0.06 | 24 | — | — | — |
| LYM704 | 69454.2 | 238.1 | 0.18 | 11 | — | — | — |
| LYM703 | 69014.3 | 252.6 | 0.03 | 18 | — | — | — |
| LYM703 | 69018.5 | 242.3 | 0.26 | 13 | — | — | — |
| LYM703 | 69019.1 | — | — | — | 27.4 | 0.27 | 38 |
| LYM699 | 69008.1 | 234.3 | 0.19 | 10 | — | — | — |
| LYM697 | 69002.2 | 277.4 | 0.11 | 30 | — | — | — |
| LYM697 | 69004.2 | 248.7 | 0.13 | 16 | — | — | — |
| LYM697 | 69006.1 | 240.4 | 0.10 | 12 | — | — | — |
| LYM695 | 69440.1 | 244.4 | 0.06 | 14 | — | — | — |
| LYM695 | 69441.1 | — | — | — | 22.1 | 0.03 | 11 |
| LYM695 | 69442.2 | — | — | — | 23.0 | 0.23 | 15 |
| LYM666 | 69771.2 | — | — | — | 22.9 | 0.02 | 15 |
| LYM666 | 69774.4 | 248.5 | 0.06 | 16 | — | — | — |
| LYM607 | 69366.1 | 259.4 | 0.01 | 21 | — | — | — |
| LYM603 | 69298.1 | 242.2 | 0.09 | 13 | 23.4 | 0.24 | 17 |
| LYM603 | 69299.2 | 241.4 | 0.24 | 13 | — | — | — |
| LYM595 | 68925.1 | 232.1 | 0.29 | 9 | — | — | — |
| LYM595 | 68928.1 | — | — | — | 21.7 | 0.06 | 9 |
| LYM595 | 68928.2 | 264.1 | 0.12 | 23 | — | — | — |
| LYM586 | 69143.5 | 254.5 | 0.04 | 19 | — | — | — |
| LYM586 | 69144.4 | 246.7 | 0.06 | 15 | — | — | — |

TABLE 56-continued

Genes showing improved plant performance at normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LYM548 | 69768.1 | 244.6 | 0.06 | 14 | — | — | — |
| LYM528 | 69469.2 | 230.0 | 0.29 | 8 | — | — | — |
| CONT. | — | 213.8 | — | — | 19.9 | — | — |
| LYM733 | 69746.2 | — | — | — | 19.6 | 0.30 | 4 |
| LYM733 | 69750.3 | — | — | — | 20.9 | L | 11 |
| LYM726 | 69752.2 | — | — | — | 25.2 | 0.14 | 34 |
| LYM726 | 69753.5 | — | — | — | 23.1 | 0.04 | 23 |
| LYM726 | 69754.4 | — | — | — | 24.2 | 0.05 | 29 |
| LYM724 | 69027.1 | — | — | — | 21.8 | 0.06 | 16 |
| LYM724 | 69031.4 | — | — | — | 20.9 | 0.02 | 11 |
| LYM717 | 69458.3 | 249.2 | 0.04 | 21 | — | — | — |
| LYM717 | 69459.2 | 228.0 | 0.09 | 11 | 22.7 | 0.02 | 21 |
| LYM717 | 69459.3 | — | — | — | 24.4 | L | 30 |
| LYM717 | 69463.1 | — | — | — | 20.9 | 0.24 | 11 |
| LYM706 | 69024.3 | — | — | — | 19.9 | 0.15 | 6 |
| LYM702 | 69446.2 | — | — | — | 22.5 | 0.06 | 20 |
| LYM702 | 69451.4 | 228.3 | 0.07 | 11 | 19.8 | 0.18 | 6 |
| LYM689 | 69160.4 | 238.8 | 0.23 | 16 | — | — | — |
| LYM662 | 68817.1 | — | — | — | 19.2 | 0.22 | 2 |
| LYM662 | 68818.2 | — | — | — | 19.8 | 0.02 | 5 |
| LYM650 | 69358.3 | 242.4 | 0.11 | 18 | — | — | — |
| LYM650 | 69359.2 | — | — | — | 19.5 | 0.06 | 4 |
| LYM650 | 69360.2 | 257.4 | 0.02 | 25 | 19.4 | 0.19 | 3 |
| LYM650 | 69361.1 | 247.7 | 0.03 | 20 | — | — | — |
| LYM650 | 69361.2 | — | — | — | 20.0 | 0.16 | 6 |
| LYM634 | 69590.1 | — | — | — | 20.4 | 0.28 | 9 |
| LYM634 | 69593.1 | — | — | — | 21.7 | 0.17 | 16 |
| LYM624 | 68937.1 | 231.6 | 0.22 | 12 | 20.3 | L | 8 |
| LYM608 | 69276.1 | 240.8 | 0.01 | 17 | 19.6 | 0.08 | 4 |
| LYM608 | 69276.2 | — | — | — | 20.1 | 0.24 | 7 |
| LYM576 | 69567.1 | 234.6 | 0.16 | 14 | — | — | — |
| LYM576 | 69569.2 | — | — | — | 26.7 | 0.25 | 42 |
| LYM576 | 69570.6 | 243.6 | 0.06 | 18 | — | — | — |
| LYM570 | 69428.2 | — | — | — | 20.1 | 0.30 | 7 |
| LYM570 | 69432.2 | — | — | — | 21.5 | 0.25 | 14 |
| LYM558 | 68865.1 | 262.1 | 0.19 | 27 | 20.0 | 0.03 | 7 |
| LYM558 | 68868.2 | 233.2 | 0.09 | 13 | — | — | — |
| LYM558 | 68868.5 | — | — | — | 19.2 | 0.30 | 2 |
| LYM557 | 68858.2 | 245.8 | 0.02 | 19 | 20.3 | 0.15 | 8 |
| LYM557 | 68859.1 | — | — | — | 19.6 | 0.04 | 4 |
| LYM557 | 68860.2 | — | — | — | 20.6 | L | 10 |
| LYM545 | 69555.2 | — | — | — | 31.6 | 0.11 | 68 |
| LYM545 | 69556.1 | — | — | — | 22.8 | 0.19 | 21 |
| LYM545 | 69557.2 | — | — | — | 21.5 | L | 14 |
| CONT. | — | 206.0 | — | — | 18.8 | — | — |
| LYM718 | 68214.4 | 334.4 | 0.19 | 12 | — | — | — |
| LYM718 | 68214.9 | 322.9 | 0.26 | 8 | — | — | — |
| LYM710 | 68534.3 | 321.5 | 0.26 | 7 | — | — | — |
| LYM694 | 68528.1 | — | — | — | 22.5 | 0.26 | 3 |
| LYM694 | 68530.4 | 333.6 | 0.11 | 12 | — | — | — |
| LYM694 | 68531.1 | 335.6 | 0.09 | 12 | — | — | — |
| LYM677 | 68526.2 | 335.0 | 0.29 | 12 | — | — | — |
| LYM661 | 68519.2 | — | — | — | 27.0 | L | 24 |
| LYM630 | 68174.3 | 323.3 | 0.23 | 8 | — | — | — |
| LYM630 | 68175.4 | 338.7 | 0.07 | 13 | — | — | — |
| LYM630 | 68175.5 | 378.4 | 0.21 | 26 | — | — | — |
| LYM613 | 68285.4 | 327.0 | 0.20 | 9 | — | — | — |
| LYM602 | 68439.1 | — | — | — | 23.8 | 0.11 | 10 |
| LYM602 | 68442.1 | 335.2 | 0.09 | 12 | — | — | — |
| LYM590 | 68423.1 | — | — | — | 22.7 | 0.22 | 4 |
| LYM590 | 68424.1 | 323.4 | 0.22 | 8 | — | — | — |
| LYM585 | 68411.4 | 337.1 | 0.09 | 13 | — | — | — |
| LYM585 | 68413.6 | — | — | — | 26.0 | 0.14 | 19 |
| LYM580 | 68400.4 | — | — | — | 23.0 | 0.08 | 6 |
| LYM580 | 68400.6 | — | — | — | 24.5 | 0.04 | 13 |
| LYM580 | 68402.3 | 352.8 | 0.07 | 18 | — | — | — |
| LYM568 | 68386.2 | 341.5 | 0.06 | 14 | 22.8 | 0.17 | 5 |
| LYM568 | 68386.7 | 325.0 | 0.25 | 9 | — | — | — |
| LYM532 | 68379.4 | 322.9 | 0.25 | 8 | — | — | — |
| LYM532 | 68380.1 | 382.5 | 0.07 | 28 | — | — | — |
| LYM532 | 68381.3 | 321.1 | 0.27 | 7 | — | — | — |
| CONT. | — | 299.2 | — | — | 21.7 | — | — |
| LYM725 | 69179.4 | — | — | — | 21.9 | 0.10 | 9 |
| LYM684 | 68996.1 | 337.0 | 0.17 | 20 | — | — | — |
| LYM680 | 68972.1 | 307.3 | 0.25 | 9 | — | — | — |
| LYM680 | 68974.1 | 337.1 | L | 20 | — | — | — |
| LYM680 | 68974.3 | — | — | — | 24.1 | 0.28 | 21 |
| LYM680 | 68976.1 | 363.4 | 0.26 | 29 | — | — | — |
| LYM679 | 69321.1 | 312.8 | 0.18 | 11 | — | — | — |
| LYM679 | 69321.2 | 322.3 | 0.05 | 14 | — | — | — |
| LYM678 | 68369.3 | 301.5 | 0.18 | 7 | — | — | — |
| LYM678 | 68370.1 | — | — | — | 25.3 | 0.08 | 26 |
| LYM678 | 68371.3 | 319.2 | 0.13 | 13 | — | — | — |
| LYM674 | 68188.3 | — | — | — | 23.6 | L | 18 |
| LYM674 | 68188.4 | — | — | — | 23.6 | L | 18 |
| LYM612 | 68457.4 | — | — | — | 25.6 | 0.14 | 28 |
| LYM612 | 68459.2 | 317.4 | 0.26 | 13 | — | — | — |
| LYM609 | 68559.5 | 330.4 | 0.09 | 17 | — | — | — |
| LYM609 | 68561.4 | 326.6 | 0.03 | 16 | 20.9 | 0.07 | 5 |
| LYM609 | 68562.2 | 319.2 | L | 13 | — | — | — |
| LYM594 | 69286.1 | 305.4 | 0.05 | 8 | 23.2 | 0.12 | 16 |
| LYM591 | 68920.3 | 328.0 | 0.02 | 16 | — | — | — |
| LYM591 | 68922.1 | 313.9 | 0.14 | 11 | 23.9 | 0.15 | 19 |
| LYM590 | 68422.1 | 304.2 | 0.10 | 8 | — | — | — |
| LYM590 | 68422.3 | 319.2 | 0.04 | 13 | — | — | — |
| LYM589 | 68416.1 | 318.2 | 0.17 | 13 | — | — | — |
| LYM588 | 68914.8 | 328.7 | 0.28 | 17 | — | — | — |
| LYM569 | 69125.2 | 300.8 | 0.16 | 7 | — | — | — |
| LYM569 | 69127.1 | 333.4 | 0.10 | 18 | — | — | — |
| LYM550 | 68846.1 | — | — | — | 22.9 | 0.05 | 15 |
| LYM550 | 68848.11 | — | — | — | 23.3 | 0.26 | 16 |
| LYM550 | 68848.8 | — | — | — | 21.9 | 0.27 | 9 |
| CONT. | — | 281.8 | — | — | 20.0 | — | — |
| LYM690 | 68768.2 | — | — | — | 25.2 | 0.20 | 22 |
| LYM690 | 68768.3 | — | — | — | 22.8 | 0.03 | 10 |
| LYM677 | 68524.3 | 375.1 | 0.20 | 18 | — | — | — |
| LYM675 | 68241.5 | 363.6 | 0.19 | 14 | — | — | — |
| LYM644 | 69304.2 | — | — | — | 23.1 | L | 12 |
| LYM643 | 69157.4 | 423.5 | 0.15 | 33 | — | — | — |
| LYM640 | 68950.2 | — | — | — | 24.8 | L | 20 |
| LYM640 | 68953.5 | — | — | — | 21.9 | 0.22 | 6 |
| LYM613 | 68285.3 | 371.8 | 0.21 | 17 | — | — | — |
| LYM600 | 68433.2 | — | — | — | 22.9 | 0.23 | 11 |
| LYM600 | 68436.1 | — | — | — | 22.3 | 0.19 | 8 |
| LYM600 | 68436.3 | — | — | — | 24.6 | L | 19 |
| LYM581 | 68403.3 | 371.5 | 0.15 | 17 | — | — | — |
| LYM567 | 68874.3 | 401.2 | 0.05 | 26 | — | — | — |
| CONT. | — | 317.9 | — | — | 20.6 | — | — |
| LYM660 | 68511.2 | 321.6 | 0.23 | 17 | — | — | — |
| LYM660 | 68513.1 | — | — | — | 27.3 | 0.16 | 13 |
| LYM660 | 68513.5 | 311.0 | 0.26 | 13 | — | — | — |
| LYM631 | 68351.4 | 312.2 | 0.25 | 13 | — | — | — |
| LYM631 | 68352.1 | 312.2 | 0.25 | 13 | — | — | — |
| LYM618 | 68171.4 | — | — | — | 25.6 | 0.17 | 6 |
| LYM618 | 68173.6 | 330.9 | 0.20 | 20 | — | — | — |
| LYM604 | 68447.1 | 319.9 | 0.19 | 16 | — | — | — |
| LYM600 | 68436.1 | — | — | — | 25.4 | 0.30 | 5 |
| LYM589 | 68415.3 | 323.9 | 0.14 | 18 | — | — | — |
| LYM581 | 68403.3 | — | — | — | 25.3 | 0.17 | 5 |
| LYM581 | 68405.2 | — | — | — | 28.3 | 0.08 | 17 |
| LYM581 | 68406.3 | — | — | — | 30.4 | 0.19 | 26 |
| LYM573 | 68276.2 | — | — | — | 27.5 | 0.17 | 14 |
| LYM573 | 68279.3 | — | — | — | 27.5 | 0.08 | 14 |
| LYM525 | 68578.4 | — | — | — | 27.1 | L | 12 |
| LYM525 | 68579.2 | — | — | — | 33.5 | 0.20 | 38 |
| LYM525 | 68580.4 | 313.2 | 0.23 | 14 | — | — | — |
| CONT. | — | 275.3 | — | — | 24.2 | — | — |

Table 56. "CONT."—Control; "Ave."—Average; "% Incr." = % increment; "p-val."—p-value, L—p < 0.01.

Example 15

Evaluation of Transgenic *Arabidopsis* for Seed Yield and Plant Growth Rate Under Normal Conditions in Greenhouse Assays Until Bolting (GH-SB Assays)

Assay 2: Plant Performance Improvement Measured Until Bolting Stage: Plant Biomass and Plant Growth Rate Under Normal Greenhouse Conditions (GH-SB Assays)—

This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until bolting stage. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the 35S promoter and the selectable marker were used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb(dot)nih(dot)gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf Analysis—

Using the digital analysis leaves data was calculated, including leaf number, rosette area, rosette diameter, and leaf blade area.

Vegetative Growth Rate:

the relative growth rate (RGR) of leaf number (Formula IX, described above), rosette area (Formula VIII described above) and plot coverage (Formula XV, described below) were calculated using the indicated formulas.

RGR plot coverage          Formula XV:

Relative growth rate of plot coverage=Regression coefficient of plot coverage along time course.

Plant Fresh and Dry Weight—

On about day 80 from sowing, the plants were harvested and directly weight for the determination of the plant fresh weight (FW) and left to dry at 50° C. in a drying chamber for about 48 hours before weighting to determine plant dry weight (DW).

Statistical Analyses—

To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

Tables 57-59 summarize the observed phenotypes of transgenic plants expressing the genes constructs using the GH-SB Assays.

The genes listed in Tables 57-59 improved plant performance when grown at normal conditions. These genes produced larger plants with a larger photosynthetic area, biomass (fresh weight, dry weight, rosette diameter, rosette area and plot coverage), relative growth rate, blade relative area and petiole relative area. The genes were cloned under the regulation of a constitutive At6669 promoter (SEQ ID NO:8529). The evaluation of each gene was performed by testing the performance of different number of events. Event with p-value <0.1 was considered statistically significant.

TABLE 57

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM725 | 69177.3 | — | — | — | 981.2 | 0.23 | 8 | 11.8 | 0.18 | 8 |
| LYM684 | 68996.1 | — | — | — | — | — | — | 11.2 | 0.25 | 3 |
| LYM684 | 68997.3 | 110.6 | 0.26 | 8 | 1000.0 | 0.12 | 10 | — | — | — |
| LYM679 | 69321.2 | — | — | — | 1093.8 | 0.10 | 20 | 11.9 | L | 9 |
| LYM678 | 68371.3 | — | — | — | — | — | — | 11.8 | L | 9 |
| LYM674 | 68186.6 | — | — | — | 1000.0 | 0.19 | 10 | — | — | — |

TABLE 57-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM612 | 68459.2 | — | — | — | — | — | — | 11.8 | L | 9 |
| LYM612 | 68461.1 | — | — | — | — | — | — | 11.5 | 0.16 | 6 |
| LYM612 | 68461.4 | 112.5 | 0.28 | 9 | 1087.5 | 0.25 | 19 | 11.6 | 0.03 | 6 |
| LYM609 | 68558.3 | — | — | — | — | — | — | 11.8 | 0.22 | 9 |
| LYM609 | 68559.1 | — | — | — | 1031.2 | 0.13 | 13 | 11.8 | 0.11 | 9 |
| LYM609 | 68562.2 | — | — | — | 1262.5 | 0.04 | 39 | 12.2 | L | 12 |
| LYM592 | 69573.2 | — | — | — | — | — | — | 11.4 | 0.09 | 5 |
| LYM590 | 68423.1 | — | — | — | — | — | — | 11.8 | L | 9 |
| LYM590 | 68425.1 | — | — | — | — | — | — | 11.9 | 0.05 | 9 |
| LYM589 | 68416.1 | 140.3 | L | 36 | 1420.5 | 0.22 | 56 | — | — | — |
| LYM589 | 68416.2 | — | — | — | — | — | — | 11.2 | 0.25 | 3 |
| LYM589 | 68418.7 | — | — | — | 987.5 | 0.24 | 8 | — | — | — |
| LYM588 | 68912.4 | — | — | — | — | — | — | 11.5 | 0.29 | 6 |
| LYM588 | 68914.10 | 137.5 | 0.05 | 34 | 1243.8 | 0.24 | 37 | 12.1 | L | 12 |
| LYM580 | 68399.2 | — | — | — | — | — | — | 11.3 | 0.13 | 4 |
| LYM580 | 68399.5 | — | — | — | 1025.0 | 0.27 | 13 | 11.6 | 0.19 | 6 |
| LYM580 | 68402.2 | — | — | — | — | — | — | 11.2 | 0.21 | 4 |
| LYM580 | 68402.3 | 148.1 | 0.02 | 44 | 1406.2 | 0.01 | 54 | 11.6 | 0.19 | 6 |
| LYM566 | 69081.1 | 119.4 | 0.23 | 16 | — | — | — | — | — | — |
| LYM566 | 69081.2 | — | — | — | — | — | — | 11.6 | 0.07 | 6 |
| LYM566 | 69082.1 | 130.6 | 0.06 | 27 | 1200.0 | L | 32 | 12.0 | 0.12 | 11 |
| LYM550 | 68848.10 | — | — | — | — | — | — | 12.6 | 0.23 | 16 |
| CONT. | — | 102.9 | — | — | 910.7 | — | — | 10.9 | — | — |
| LYM750 | 69212.1 | — | — | — | 1185.7 | 0.19 | 12 | — | — | — |
| LYM750 | 69213.2 | — | — | — | — | — | — | 10.9 | 0.20 | 6 |
| LYM750 | 69214.3 | 190.4 | L | 44 | 1331.2 | 0.06 | 26 | — | — | — |
| LYM750 | 69215.1 | — | — | — | — | — | — | 10.9 | 0.09 | 7 |
| LYM746 | 69206.3 | 173.1 | 0.03 | 31 | — | — | — | — | — | — |
| LYM746 | 69207.4 | 197.5 | L | 50 | 1556.2 | 0.09 | 48 | 11.4 | 0.04 | 11 |
| LYM746 | 69208.1 | — | — | — | 1256.2 | 0.06 | 19 | — | — | — |
| LYM706 | 69024.3 | — | — | — | 1235.7 | 0.15 | 17 | — | — | — |
| LYM689 | 69158.3 | 214.4 | L | 63 | — | — | — | 11.2 | 0.12 | 9 |
| LYM689 | 69159.2 | 168.1 | 0.08 | 27 | 1406.2 | 0.01 | 33 | 10.8 | 0.30 | 5 |
| LYM689 | 69160.4 | — | — | — | 1300.0 | 0.03 | 23 | — | — | — |
| LYM665 | 68582.1 | — | — | — | — | — | — | 10.8 | 0.20 | 5 |
| LYM665 | 68582.3 | — | — | — | 1312.5 | 0.29 | 24 | — | — | — |
| LYM658 | 69315.1 | — | — | — | — | — | — | 11.0 | 0.14 | 7 |
| LYM658 | 69319.1 | — | — | — | 1206.2 | 0.23 | 14 | — | — | — |
| LYM655 | 68994.3 | — | — | — | — | — | — | 10.9 | 0.22 | 7 |
| LYM655 | 68994.5 | — | — | — | 1200.0 | 0.19 | 14 | 10.7 | 0.25 | 4 |
| LYM650 | 69359.2 | 176.4 | 0.02 | 34 | 1221.4 | 0.23 | 16 | — | — | — |
| LYM650 | 69360.2 | — | — | — | — | — | — | 10.9 | 0.22 | 7 |
| LYM645 | 68954.1 | — | — | — | — | — | — | 10.8 | 0.30 | 5 |
| LYM645 | 68957.1 | 213.1 | 0.12 | 62 | 1475.0 | L | 40 | — | — | — |
| LYM645 | 68957.2 | — | — | — | — | — | — | 10.9 | 0.20 | 6 |
| LYM627 | 68980.2 | — | — | — | — | — | — | 10.9 | 0.09 | 7 |
| LYM595 | 68925.1 | — | — | — | — | — | — | 11.1 | 0.04 | 8 |
| LYM595 | 68926.2 | 167.9 | 0.05 | 27 | 1300.0 | 0.04 | 23 | — | — | — |
| LYM595 | 68926.3 | — | — | — | — | — | — | 11.5 | L | 12 |
| LYM567 | 68870.2 | 166.9 | 0.25 | 27 | — | — | — | 10.8 | 0.21 | 5 |
| LYM567 | 68871.3 | — | — | — | 1393.8 | 0.13 | 32 | — | — | — |
| CONT. | — | 131.9 | — | — | 1054.3 | — | — | 10.3 | — | — |
| LYM737 | 68552.2 | — | — | — | — | — | — | 11.3 | 0.18 | 4 |
| LYM737 | 68552.3 | — | — | — | — | — | — | 11.1 | 0.29 | 2 |
| LYM718 | 68212.3 | — | — | — | 2381.2 | 0.06 | 12 | — | — | — |
| LYM718 | 68214.3 | — | — | — | — | — | — | 11.3 | 0.18 | 4 |
| LYM718 | 68214.4 | 285.0 | 0.10 | 33 | 2625.0 | L | 24 | — | — | — |
| LYM716 | 68205.2 | — | — | — | 2412.5 | 0.27 | 14 | — | — | — |
| LYM716 | 68206.4 | 243.1 | 0.24 | 13 | 2343.8 | 0.29 | 11 | — | — | — |
| LYM716 | 68208.1 | — | — | — | 2362.5 | 0.08 | 12 | — | — | — |
| LYM715 | 68542.1 | 233.8 | 0.25 | 9 | — | — | — | — | — | — |
| LYM715 | 68544.4 | — | — | — | 2300.0 | 0.20 | 9 | 11.2 | 0.14 | 3 |
| LYM710 | 68537.3 | — | — | — | — | — | — | 11.4 | 0.02 | 5 |
| LYM652 | 68493.1 | 231.2 | 0.27 | 8 | — | — | — | — | — | — |
| LYM639 | 68182.5 | 236.2 | 0.22 | 10 | — | — | — | — | — | — |
| LYM630 | 68174.1 | — | — | — | 2362.5 | 0.28 | 12 | — | — | — |
| LYM630 | 68174.4 | 255.0 | 0.06 | 19 | — | — | — | — | — | — |
| LYM630 | 68175.4 | — | — | — | — | — | — | 11.1 | 0.20 | 2 |
| LYM630 | 68175.5 | — | — | — | 2262.5 | 0.24 | 7 | — | — | — |
| LYM620 | 68474.1 | 250.6 | 0.24 | 17 | — | — | — | — | — | — |
| LYM620 | 68478.1 | 233.8 | 0.20 | 9 | 2306.2 | 0.23 | 9 | — | — | — |
| LYM620 | 68478.5 | 238.1 | 0.23 | 11 | 2362.5 | 0.12 | 12 | — | — | — |
| LYM614 | 68464.5 | 257.5 | 0.02 | 20 | 2412.5 | 0.06 | 14 | — | — | — |

TABLE 57-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM614 | 68466.1 | — | — | — | 2327.7 | 0.19 | 10 | — | — | — |
| LYM612 | 68457.4 | — | — | — | 2256.2 | 0.28 | 6 | — | — | — |
| LYM602 | 68442.1 | 264.4 | 0.11 | 23 | 2437.5 | 0.08 | 15 | — | — | — |
| LYM602 | 68442.8 | — | — | — | 2306.2 | 0.23 | 9 | — | — | — |
| LYM575 | 68268.3 | 235.0 | 0.17 | 9 | — | — | — | — | — | — |
| LYM575 | 68268.4 | — | — | — | 2312.5 | 0.14 | 9 | — | — | — |
| LYM573 | 68276.2 | — | — | — | — | — | — | 11.2 | 0.08 | 3 |
| LYM572 | 68389.1 | — | — | — | 2293.8 | 0.17 | 8 | — | — | — |
| CONT. | — | 215.0 | — | — | 2118.8 | — | — | 10.9 | — | — |
| LYM750 | 69212.1 | — | — | — | — | — | — | 11.6 | 0.13 | 6 |
| LYM690 | 68768.3 | 123.1 | 0.23 | 15 | 1075.0 | 0.19 | 10 | — | — | — |
| LYM677 | 68522.1 | 126.2 | 0.07 | 18 | 1206.2 | 0.01 | 24 | — | — | — |
| LYM677 | 68524.3 | 170.0 | 0.18 | 59 | — | — | — | — | — | — |
| LYM675 | 68241.3 | 141.2 | 0.13 | 32 | 1175.0 | 0.10 | 20 | 11.9 | 0.02 | 9 |
| LYM675 | 68244.1 | — | — | — | — | — | — | 11.5 | 0.22 | 5 |
| LYM644 | 69304.1 | 133.1 | 0.28 | 25 | — | — | — | — | — | — |
| LYM644 | 69304.5 | 123.8 | 0.04 | 16 | — | — | — | — | — | — |
| LYM643 | 69155.1 | 139.4 | 0.25 | 30 | 1156.2 | 0.06 | 18 | — | — | — |
| LYM621 | 69146.5 | 115.0 | 0.28 | 8 | — | — | — | — | — | — |
| LYM621 | 69150.1 | 173.9 | L | 63 | 1102.4 | 0.27 | 13 | — | — | — |
| LYM616 | 68469.2 | — | — | — | — | — | — | 11.4 | 0.15 | 5 |
| LYM613 | 68285.3 | 123.8 | 0.06 | 16 | — | — | — | — | — | — |
| LYM613 | 68285.4 | — | — | — | — | — | — | 11.6 | 0.24 | 6 |
| LYM601 | 69088.1 | 117.5 | 0.25 | 10 | 1062.5 | 0.23 | 9 | — | — | — |
| LYM600 | 68436.3 | — | — | — | — | — | — | 11.5 | 0.11 | 5 |
| LYM581 | 68406.3 | — | — | — | — | — | — | 11.8 | 0.20 | 8 |
| LYM565 | 69079.1 | — | — | — | — | — | — | 11.6 | 0.09 | 6 |
| LYM565 | 69079.3 | 133.1 | L | 25 | 1143.8 | 0.04 | 17 | 11.4 | 0.21 | 5 |
| CONT. | — | 106.8 | — | — | 976.5 | — | — | 10.9 | — | — |
| LYM714 | 69619.1 | — | — | — | 1268.8 | 0.20 | 9 | — | — | — |
| LYM704 | 69455.3 | 101.9 | 0.10 | 12 | 1281.2 | 0.16 | 10 | 10.1 | 0.11 | 6 |
| LYM704 | 69457.2 | — | — | — | 1333.9 | 0.02 | 14 | — | — | — |
| LYM702 | 69449.4 | 100.0 | 0.19 | 10 | — | — | — | — | — | — |
| LYM702 | 69451.4 | 111.2 | L | 22 | — | — | — | — | — | — |
| LYM691 | 69779.2 | — | — | — | 1268.8 | 0.20 | 9 | — | — | — |
| LYM691 | 69779.3 | 104.4 | 0.11 | 14 | — | — | — | — | — | — |
| LYM691 | 69780.4 | — | — | — | — | — | — | 10.1 | 0.11 | 6 |
| LYM671 | 70148.1 | 117.5 | 0.15 | 29 | — | — | — | 10.4 | 0.09 | 9 |
| LYM671 | 70148.2 | 103.1 | 0.04 | 13 | 1243.8 | 0.18 | 7 | — | — | — |
| LYM671 | 70149.2 | 101.9 | 0.10 | 12 | — | — | — | — | — | — |
| LYM671 | 70153.1 | 108.8 | 0.08 | 19 | 1393.8 | 0.10 | 20 | — | — | — |
| LYM653 | 68967.1 | — | — | — | 1256.2 | 0.18 | 8 | 9.8 | 0.23 | 3 |
| LYM653 | 68969.2 | — | — | — | — | — | — | 10.0 | 0.07 | 5 |
| LYM642 | 69198.1 | — | — | — | — | — | — | 10.3 | L | 9 |
| LYM617 | 69587.2 | 107.5 | 0.10 | 18 | 1312.5 | 0.03 | 13 | 10.2 | 0.01 | 7 |
| LYM587 | 70346.4 | — | — | — | — | — | — | 9.8 | 0.16 | 3 |
| LYM587 | 70351.1 | 103.8 | 0.03 | 14 | — | — | — | — | — | — |
| LYM576 | 69566.2 | — | — | — | 1325.0 | 0.27 | 14 | — | — | — |
| LYM576 | 69569.2 | — | — | — | — | — | — | 10.0 | 0.07 | 5 |
| LYM570 | 69433.3 | 107.5 | L | 18 | 1331.2 | 0.03 | 14 | — | — | — |
| LYM548 | 69768.1 | 111.2 | 0.11 | 22 | 1318.8 | 0.08 | 13 | — | — | — |
| LYM545 | 69556.1 | — | — | — | — | — | — | 10.0 | 0.07 | 5 |
| LYM536 | 68590.6 | — | — | — | — | — | — | 9.9 | 0.15 | 4 |
| LYM536 | 68592.9 | — | — | — | 1281.2 | 0.23 | 10 | 9.8 | 0.16 | 3 |
| CONT. | — | 91.2 | — | — | 1166.1 | — | — | 9.5 | — | — |
| LYM732 | 68363.4 | — | — | — | — | — | — | 11.4 | 0.15 | 10 |
| LYM732 | 68364.3 | 197.5 | 0.24 | 7 | 1987.5 | 0.23 | 13 | 10.9 | 0.16 | 5 |
| LYM719 | 68546.6 | — | — | — | — | — | — | 11.2 | 0.05 | 8 |
| LYM719 | 68550.1 | — | — | — | — | — | — | 10.8 | 0.26 | 4 |
| LYM682 | 68354.4 | — | — | — | — | — | — | 10.8 | 0.26 | 4 |
| LYM682 | 68356.2 | — | — | — | 1912.5 | 0.16 | 9 | — | — | — |
| LYM665 | 68582.3 | 228.1 | 0.07 | 23 | 1981.2 | 0.18 | 13 | — | — | — |
| LYM665 | 68584.1 | 200.0 | 0.25 | 8 | 1943.8 | 0.09 | 11 | 11.2 | 0.26 | 8 |
| LYM665 | 68585.1 | 210.6 | 0.05 | 14 | 2100.0 | 0.23 | 19 | — | — | — |
| LYM661 | 68519.2 | — | — | — | — | — | — | 10.9 | 0.22 | 5 |
| LYM647 | 68488.1 | 221.9 | L | 20 | 2156.2 | 0.02 | 23 | 11.5 | 0.05 | 11 |
| LYM631 | 68348.6 | 220.6 | 0.07 | 19 | 2275.0 | 0.09 | 29 | 11.4 | 0.15 | 10 |
| LYM623 | 68484.3 | 207.5 | 0.27 | 12 | — | — | — | 11.1 | 0.13 | 7 |
| LYM618 | 68171.2 | 200.0 | 0.12 | 8 | — | — | — | — | — | — |
| LYM618 | 68171.4 | — | — | — | — | — | — | 10.9 | 0.16 | 5 |
| LYM604 | 68444.3 | — | — | — | 1937.5 | 0.23 | 10 | — | — | — |
| LYM598 | 68426.4 | 203.1 | 0.25 | 10 | 2093.8 | 0.08 | 19 | — | — | — |
| LYM598 | 68429.4 | — | — | — | — | — | — | 11.5 | 0.05 | 11 |

TABLE 57-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM585 | 68412.1 | 213.8 | 0.01 | 16 | 2025.0 | 0.04 | 15 | — | — | — |
| LYM568 | 68384.2 | 222.5 | L | 20 | 2043.8 | 0.02 | 16 | — | — | — |
| LYM568 | 68386.3 | — | — | — | 1964.3 | 0.12 | 12 | — | — | — |
| LYM532 | 68380.1 | 220.6 | 0.19 | 19 | 2181.2 | 0.27 | 24 | 11.2 | 0.26 | 8 |
| LYM532 | 68381.3 | — | — | — | — | — | — | 10.9 | 0.22 | 5 |
| LYM524 | 68258.2 | — | — | — | 1862.5 | 0.29 | 6 | — | — | — |
| LYM524 | 68261.4 | — | — | — | 1937.5 | 0.10 | 10 | — | — | — |
| LYM524 | 68262.2 | — | — | — | 2037.5 | 0.17 | 16 | — | — | — |
| CONT. | — | 185.0 | — | — | 1758.3 | — | — | 10.4 | — | — |
| LYM745 | 71269.4 | — | — | — | 1087.5 | 0.23 | 7 | — | — | — |
| LYM745 | 71273.4 | 86.9 | 0.26 | 5 | — | — | — | — | — | — |
| LYM708 | 70359.2 | — | — | — | — | — | — | 11.4 | L | 6 |
| LYM708 | 70361.1 | — | — | — | 1087.5 | 0.19 | 7 | — | — | — |
| LYM688 | 68196.3 | — | — | — | — | — | — | 11.3 | 0.03 | 4 |
| LYM671 | 70148.1 | 91.9 | 0.03 | 11 | 1125.0 | 0.14 | 10 | — | — | — |
| LYM642 | 69195.1 | 94.4 | 0.02 | 14 | 1218.8 | 0.01 | 20 | — | — | — |
| LYM642 | 69197.1 | 88.1 | 0.20 | 6 | — | — | — | — | — | — |
| LYM642 | 69198.1 | 90.0 | 0.25 | 9 | 1131.2 | 0.16 | 11 | — | — | — |
| LYM642 | 69198.3 | — | — | — | — | — | — | 11.1 | 0.22 | 3 |
| LYM638 | 70077.1 | 92.5 | 0.03 | 12 | 1137.5 | 0.04 | 12 | — | — | — |
| LYM638 | 70081.1 | — | — | — | — | — | — | 11.4 | L | 6 |
| LYM638 | 70081.3 | 97.5 | 0.02 | 18 | 1168.8 | 0.04 | 15 | — | — | — |
| LYM625 | 70075.2 | — | — | — | — | — | — | 11.8 | 0.24 | 9 |
| LYM620 | 68477.1 | — | — | — | — | — | — | 11.3 | 0.16 | 4 |
| LYM615 | 70539.1 | 106.2 | L | 28 | 1325.0 | L | 30 | — | — | — |
| LYM615 | 70539.4 | — | — | — | — | — | — | 11.3 | 0.14 | 4 |
| LYM615 | 70540.3 | — | — | — | 1081.2 | 0.25 | 6 | 11.2 | 0.04 | 4 |
| LYM615 | 70540.4 | — | — | — | 1125.0 | 0.22 | 10 | 11.5 | L | 6 |
| LYM587 | 70346.4 | 92.5 | 0.02 | 12 | 1168.8 | 0.02 | 15 | — | — | — |
| LYM587 | 70347.1 | 96.9 | 0.11 | 17 | 1212.5 | 0.03 | 19 | — | — | — |
| LYM583 | 70154.2 | 90.6 | 0.05 | 9 | — | — | — | — | — | — |
| LYM583 | 70157.4 | — | — | — | — | — | — | 11.1 | 0.22 | 3 |
| LYM582 | 71053.4 | 93.8 | 0.02 | 13 | — | — | — | — | — | — |
| LYM574 | 70638.5 | — | — | — | — | — | — | 11.1 | 0.23 | 2 |
| LYM554 | 71109.5 | — | — | — | 1218.8 | 0.28 | 20 | 11.4 | 0.26 | 6 |
| LYM537 | 70671.1 | 93.7 | 0.22 | 13 | 1155.4 | 0.25 | 13 | 11.2 | 0.10 | 4 |
| LYM536 | 68590.5 | 100.0 | 0.22 | 21 | — | — | — | — | — | — |
| LYM536 | 68592.5 | — | — | — | — | — | — | 11.1 | 0.23 | 2 |
| CONT. | — | 82.9 | — | — | 1019.6 | — | — | 10.8 | — | — |
| LYM746 | 69207.4 | 121.2 | 0.11 | 54 | 1287.5 | 0.05 | 28 | — | — | — |
| LYM746 | 69208.1 | 100.6 | 0.01 | 27 | 1200.0 | 0.08 | 19 | 10.1 | 0.22 | 5 |
| LYM746 | 69208.3 | 87.5 | 0.20 | 11 | — | — | — | — | — | — |
| LYM746 | 69210.1 | — | — | — | 1231.2 | 0.14 | 22 | — | — | — |
| LYM717 | 69463.2 | 91.2 | 0.18 | 16 | — | — | — | — | — | — |
| LYM708 | 70363.1 | 104.4 | 0.07 | 32 | 1243.8 | 0.04 | 24 | — | — | — |
| LYM708 | 70363.4 | 102.5 | 0.11 | 30 | 1218.8 | 0.08 | 21 | — | — | — |
| LYM688 | 68192.3 | — | — | — | 1181.2 | 0.19 | 17 | 10.2 | 0.04 | 7 |
| LYM688 | 68196.2 | 87.5 | 0.20 | 11 | 1200.0 | 0.14 | 19 | — | — | — |
| LYM680 | 68972.2 | 96.9 | 0.20 | 23 | — | — | — | — | — | — |
| LYM680 | 68976.1 | — | — | — | 1193.8 | 0.24 | 19 | — | — | — |
| LYM667 | 70161.1 | 97.5 | 0.07 | 24 | 1137.5 | 0.21 | 13 | — | — | — |
| LYM667 | 70162.2 | 103.8 | L | 31 | 1218.8 | 0.06 | 21 | — | — | — |
| LYM667 | 70163.1 | 103.8 | 0.10 | 31 | 1262.5 | 0.12 | 26 | — | — | — |
| LYM666 | 69774.4 | 95.6 | 0.12 | 21 | 1193.8 | 0.09 | 19 | — | — | — |
| LYM666 | 69774.5 | 100.6 | 0.02 | 27 | 1168.8 | 0.16 | 16 | 10.6 | L | 11 |
| LYM648 | 68988.4 | 88.1 | 0.18 | 12 | — | — | — | — | — | — |
| LYM645 | 68954.1 | 99.4 | 0.01 | 26 | 1181.2 | 0.27 | 17 | — | — | — |
| LYM645 | 68957.2 | 106.9 | 0.21 | 35 | 1143.8 | 0.20 | 14 | — | — | — |
| LYM645 | 68958.1 | 98.8 | 0.24 | 25 | — | — | — | — | — | — |
| LYM638 | 70081.1 | — | — | — | 1250.0 | 0.07 | 24 | — | — | — |
| LYM638 | 70081.3 | 98.1 | 0.05 | 24 | — | — | — | — | — | — |
| LYM634 | 69590.1 | — | — | — | 1228.6 | 0.12 | 22 | — | — | — |
| LYM634 | 69593.1 | — | — | — | 1156.2 | 0.21 | 15 | — | — | — |
| LYM634 | 69594.2 | 103.1 | L | 31 | — | — | — | — | — | — |
| LYM625 | 70072.2 | 95.2 | 0.04 | 21 | 1125.0 | 0.26 | 12 | — | — | — |
| LYM625 | 70073.2 | 115.0 | L | 46 | 1293.8 | 0.04 | 29 | — | — | — |
| LYM593 | 69580.2 | 96.2 | 0.19 | 22 | — | — | — | — | — | — |
| LYM593 | 69581.1 | — | — | — | 1181.2 | 0.16 | 17 | — | — | — |
| LYM583 | 70154.2 | 100.6 | 0.02 | 27 | 1168.8 | 0.30 | 16 | — | — | — |
| LYM583 | 70157.2 | 128.1 | 0.01 | 62 | 1431.2 | 0.08 | 42 | — | — | — |
| LYM583 | 70157.4 | 111.2 | 0.29 | 41 | 1237.5 | 0.19 | 23 | 10.2 | 0.04 | 7 |
| LYM557 | 68859.1 | 106.9 | 0.06 | 35 | — | — | — | — | — | — |
| LYM557 | 68860.3 | 94.4 | 0.04 | 20 | 1150.0 | 0.18 | 14 | — | — | — |

TABLE 57-continued

Genes showing improved plant performance at normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM535 | 69278.3 | 98.8 | 0.03 | 25 | — | — | — | — | — | — |
| LYM535 | 69281.2 | 93.1 | 0.05 | 18 | 1112.5 | 0.30 | 11 | — | — | — |
| LYM528 | 69464.4 | 90.0 | 0.17 | 14 | — | — | — | 10.0 | 0.12 | 4 |
| CONT. | — | 78.9 | — | — | 1005.4 | — | — | 9.6 | — | — |
| LYM745 | 71269.2 | 82.5 | 0.16 | 8 | — | — | — | — | — | — |
| LYM700 | 70904.4 | 86.9 | 0.04 | 14 | 1012.5 | 0.02 | 17 | — | — | — |
| LYM700 | 70908.3 | 86.9 | 0.03 | 14 | — | — | — | — | — | — |
| LYM682 | 68353.6 | 90.6 | 0.16 | 19 | 956.2 | 0.16 | 10 | — | — | — |
| LYM682 | 68354.4 | 83.8 | 0.10 | 10 | — | — | — | — | — | — |
| LYM678 | 68369.3 | — | — | — | 981.2 | 0.15 | 13 | 11.7 | 0.10 | 6 |
| LYM678 | 68369.6 | 95.0 | 0.03 | 25 | — | — | — | — | — | — |
| LYM678 | 68370.1 | — | — | — | — | — | — | 11.4 | 0.27 | 4 |
| LYM674 | 68186.5 | — | — | — | 931.2 | 0.29 | 7 | — | — | — |
| LYM674 | 68188.3 | 94.4 | 0.17 | 24 | 1125.0 | L | 30 | 11.6 | 0.14 | 6 |
| LYM674 | 68188.4 | — | — | — | 1006.3 | 0.17 | 16 | — | — | — |
| LYM670 | 70553.5 | — | — | — | 925.0 | 0.25 | 7 | — | — | — |
| LYM667 | 70160.1 | — | — | — | 931.2 | 0.22 | 7 | — | — | — |
| LYM667 | 70162.2 | 88.1 | 0.06 | 16 | 956.2 | 0.10 | 10 | — | — | — |
| LYM660 | 68511.2 | 84.4 | 0.26 | 11 | 993.8 | 0.20 | 15 | — | — | — |
| LYM652 | 68495.2 | — | — | — | 968.8 | 0.06 | 12 | — | — | — |
| LYM632 | 70751.2 | — | — | — | 950.0 | 0.11 | 10 | — | — | — |
| LYM632 | 70752.2 | 88.8 | 0.24 | 17 | — | — | — | — | — | — |
| LYM622 | 70544.2 | 85.0 | 0.28 | 12 | 1068.8 | 0.23 | 23 | — | — | — |
| LYM622 | 70545.1 | — | — | — | 943.8 | 0.21 | 9 | — | — | — |
| LYM606 | 70357.1 | — | — | — | 937.5 | 0.29 | 8 | — | — | — |
| LYM593 | 69580.2 | 94.4 | L | 24 | — | — | — | — | — | — |
| LYM593 | 69582.2 | — | — | — | 968.8 | 0.06 | 12 | — | — | — |
| LYM546 | 68841.1 | — | — | — | 1000.0 | 0.02 | 15 | — | — | — |
| CONT. | — | 76.2 | — | — | 867.3 | — | — | 11.0 | — | — |

Table 57. "CONT."—Control; "Ave."—Average; "% Incr." = % increment; "p-val."—p-value, L—p < 0.01.

TABLE 58

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM725 | 69177.3 | 82.8 | 0.03 | 14 | 10.3 | 0.03 | 14 | 5.4 | 0.27 | 3 |
| LYM684 | 68997.3 | 81.0 | 0.05 | 12 | 10.1 | 0.05 | 12 | 5.5 | 0.14 | 4 |
| LYM679 | 69321.2 | 103.9 | 0.07 | 43 | 13.0 | 0.07 | 43 | 6.3 | 0.08 | 20 |
| LYM612 | 68457.4 | 82.2 | 0.27 | 13 | 10.3 | 0.27 | 13 | — | — | — |
| LYM612 | 68459.2 | 80.3 | 0.07 | 11 | 10.0 | 0.07 | 11 | 5.5 | 0.09 | 5 |
| LYM612 | 68461.4 | 78.0 | 0.24 | 8 | 9.8 | 0.24 | 8 | 5.5 | 0.10 | 5 |
| LYM609 | 68559.1 | 88.1 | L | 21 | 11.0 | L | 21 | 5.7 | L | 9 |
| LYM609 | 68562.2 | 103.9 | L | 43 | 13.0 | L | 43 | 6.3 | 0.04 | 21 |
| LYM594 | 69286.1 | 81.6 | 0.29 | 12 | 10.2 | 0.29 | 12 | — | — | — |
| LYM589 | 68416.1 | — | — | — | — | — | — | 6.6 | 0.28 | 26 |
| LYM589 | 68418.7 | 78.7 | 0.13 | 8 | 9.8 | 0.13 | 8 | 5.6 | 0.06 | 6 |
| LYM588 | 68914.10 | 106.1 | 0.27 | 46 | 13.3 | 0.27 | 46 | — | — | — |
| LYM580 | 68399.5 | 78.2 | 0.25 | 8 | 9.8 | 0.25 | 8 | 5.4 | 0.21 | 4 |
| LYM580 | 68402.3 | 116.5 | 0.08 | 60 | 14.6 | 0.08 | 60 | 6.5 | L | 24 |
| LYM566 | 69082.1 | 101.1 | 0.03 | 39 | 12.6 | 0.03 | 39 | 6.2 | L | 17 |
| LYM550 | 68848.10 | 100.5 | L | 38 | 12.6 | L | 38 | 5.9 | L | 12 |
| CONT. | — | 72.6 | — | — | 9.1 | — | — | 5.2 | — | — |
| LYM750 | 69212.1 | — | — | — | 10.8 | 0.04 | 16 | 5.8 | 0.25 | 7 |
| LYM750 | 69213.2 | 87.5 | 0.04 | 17 | 10.9 | 0.04 | 17 | 6.1 | 0.09 | 11 |
| LYM750 | 69215.1 | 88.5 | 0.09 | 18 | 11.1 | 0.09 | 18 | 5.8 | 0.16 | 6 |
| LYM746 | 69207.4 | 89.6 | 0.16 | 20 | 11.2 | 0.16 | 20 | 6.0 | 0.14 | 9 |
| LYM746 | 69208.1 | 84.8 | 0.11 | 14 | 10.6 | 0.11 | 14 | 6.0 | 0.04 | 9 |
| LYM734 | 69050.4 | — | — | — | — | — | — | 5.7 | 0.22 | 5 |
| LYM725 | 69177.2 | 80.2 | 0.28 | 7 | 10.0 | 0.28 | 7 | — | — | — |
| LYM725 | 69177.4 | 80.1 | 0.29 | 7 | 10.0 | 0.29 | 7 | 5.7 | 0.30 | 4 |
| LYM706 | 69022.3 | 89.7 | 0.07 | 20 | 11.2 | 0.07 | 20 | 5.9 | 0.29 | 8 |
| LYM689 | 69158.2 | — | — | — | — | — | — | 5.8 | 0.10 | 6 |
| LYM689 | 69158.3 | 95.6 | 0.18 | 28 | 11.9 | 0.18 | 28 | 6.1 | 0.02 | 12 |
| LYM689 | 69159.2 | 90.2 | 0.01 | 21 | 11.3 | 0.01 | 21 | 6.0 | 0.02 | 10 |
| LYM689 | 69160.3 | 82.2 | 0.18 | 10 | — | — | — | 6.2 | 0.29 | 14 |

TABLE 58-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM689 | 69160.4 | 92.6 | 0.12 | 24 | 11.6 | 0.12 | 24 | 6.3 | 0.02 | 15 |
| LYM665 | 68582.1 | 84.0 | 0.19 | 12 | 10.5 | 0.19 | 12 | 5.8 | 0.24 | 6 |
| LYM665 | 68582.3 | 84.9 | 0.15 | 14 | 10.6 | 0.15 | 14 | — | — | — |
| LYM658 | 69315.1 | 89.4 | 0.21 | 20 | 11.2 | 0.21 | 20 | — | — | — |
| LYM658 | 69316.3 | 84.0 | 0.09 | 13 | 10.5 | 0.09 | 13 | 5.7 | 0.24 | 5 |
| LYM655 | 68994.2 | — | — | — | — | — | — | 5.7 | 0.26 | 4 |
| LYM650 | 69358.3 | — | — | — | — | — | — | 5.7 | 0.19 | 5 |
| LYM650 | 69360.2 | 86.4 | 0.06 | 16 | 10.8 | 0.06 | 16 | 5.9 | 0.04 | 9 |
| LYM645 | 68954.1 | 84.0 | 0.10 | 12 | 10.5 | 0.10 | 12 | — | — | — |
| LYM645 | 68955.1 | 86.1 | 0.05 | 15 | 10.8 | 0.05 | 15 | 5.8 | 0.19 | 7 |
| LYM645 | 68957.2 | 93.6 | L | 25 | 11.7 | L | 25 | 6.1 | 0.01 | 12 |
| LYM603 | 69299.2 | 81.2 | 0.22 | 9 | 10.1 | 0.22 | 9 | 5.7 | 0.26 | 5 |
| LYM595 | 68925.1 | 97.4 | 0.11 | 30 | 12.2 | 0.11 | 30 | 6.3 | L | 15 |
| LYM595 | 68926.2 | 81.7 | 0.21 | 9 | 10.2 | 0.21 | 9 | 5.7 | 0.17 | 5 |
| LYM595 | 68926.3 | 83.6 | 0.10 | 12 | 10.5 | 0.10 | 12 | 5.8 | 0.21 | 5 |
| LYM567 | 68870.2 | 88.5 | 0.22 | 18 | 11.1 | 0.22 | 18 | 6.0 | 0.19 | 10 |
| LYM567 | 68871.3 | — | — | — | — | — | — | 6.0 | 0.15 | 10 |
| CONT. | — | 74.7 | — | — | 9.3 | — | — | 5.5 | — | — |
| LYM718 | 68214.4 | 107.7 | 0.02 | 18 | 13.5 | 0.02 | 18 | 6.5 | 0.04 | 8 |
| LYM716 | 68208.1 | 105.0 | 0.05 | 15 | 13.1 | 0.05 | 15 | 6.5 | 0.04 | 8 |
| LYM639 | 68182.6 | — | — | — | — | — | — | 6.2 | 0.24 | 4 |
| LYM620 | 68478.1 | — | — | — | — | — | — | 6.2 | 0.29 | 4 |
| LYM620 | 68478.5 | — | — | — | — | — | — | 6.2 | 0.27 | 4 |
| LYM614 | 68466.1 | — | — | — | 13.3 | 0.03 | 16 | 6.4 | 0.10 | 7 |
| LYM612 | 68457.4 | — | — | — | 12.3 | 0.23 | 7 | 6.3 | 0.09 | 6 |
| LYM573 | 68276.1 | 98.2 | 0.23 | 7 | 12.3 | 0.23 | 7 | 6.4 | 0.16 | 8 |
| LYM572 | 68389.1 | 101.5 | 0.16 | 11 | 12.7 | 0.16 | 11 | 6.2 | 0.20 | 5 |
| LYM525 | 68580.4 | — | — | — | — | — | — | 6.3 | 0.15 | 5 |
| CONT. | — | 91.6 | — | — | 11.5 | — | — | 6.0 | — | — |
| LYM750 | 69212.1 | 90.1 | 0.21 | 19 | 11.3 | 0.21 | 19 | 5.9 | 0.05 | 9 |
| LYM690 | 68768.3 | 82.9 | 0.22 | 9 | 10.4 | 0.22 | 9 | — | — | — |
| LYM677 | 68522.1 | 84.4 | 0.13 | 11 | 10.6 | 0.13 | 11 | — | — | — |
| LYM677 | 68525.2 | 85.0 | 0.28 | 12 | 10.6 | 0.28 | 12 | — | — | — |
| LYM643 | 69155.1 | 81.5 | 0.27 | 8 | 10.2 | 0.27 | 8 | — | — | — |
| LYM600 | 68436.3 | 85.4 | 0.20 | 13 | 10.7 | 0.20 | 13 | — | — | — |
| LYM565 | 69079.1 | 84.4 | 0.13 | 11 | 10.5 | 0.13 | 11 | 5.6 | 0.20 | 4 |
| CONT. | — | 75.8 | — | — | 9.5 | — | — | 5.4 | — | — |
| LYM714 | 69619.1 | 56.8 | 0.12 | 10 | 7.1 | 0.12 | 10 | 4.7 | 0.07 | 8 |
| LYM704 | 69455.3 | 58.9 | 0.02 | 14 | 7.4 | 0.02 | 14 | 4.6 | 0.07 | 7 |
| LYM691 | 69779.3 | 61.6 | 0.02 | 19 | 7.7 | 0.02 | 19 | 4.8 | 0.04 | 11 |
| LYM671 | 70148.2 | 57.3 | 0.18 | 11 | 7.2 | 0.18 | 11 | 4.5 | 0.29 | 4 |
| LYM671 | 70153.1 | — | — | — | 7.9 | 0.14 | 22 | 4.8 | 0.18 | 11 |
| LYM587 | 70346.4 | 54.6 | 0.28 | 6 | 6.8 | 0.28 | 6 | — | — | — |
| LYM576 | 69566.2 | 56.5 | 0.15 | 9 | 7.1 | 0.15 | 9 | 4.5 | 0.15 | 5 |
| LYM570 | 69433.3 | 57.6 | 0.04 | 12 | 7.2 | 0.04 | 12 | 4.6 | 0.04 | 7 |
| LYM536 | 68592.9 | 55.8 | 0.11 | 8 | 7.0 | 0.11 | 8 | 4.5 | 0.14 | 5 |
| CONT. | — | 51.6 | — | — | 6.5 | — | — | 4.3 | — | — |
| LYM732 | 68363.4 | 102.1 | L | 24 | 12.8 | L | 24 | 6.1 | 0.03 | 9 |
| LYM732 | 68364.3 | 95.6 | 0.14 | 16 | 12.0 | 0.14 | 16 | 6.0 | 0.20 | 6 |
| LYM719 | 68546.6 | 89.0 | 0.10 | 8 | 11.1 | 0.10 | 8 | 6.1 | 0.04 | 8 |
| LYM719 | 68550.1 | — | — | — | — | — | — | 5.9 | 0.09 | 6 |
| LYM682 | 68354.3 | — | — | — | — | — | — | 5.9 | 0.12 | 5 |
| LYM665 | 68584.1 | 97.1 | 0.01 | 18 | 12.1 | 0.01 | 18 | 6.1 | 0.02 | 8 |
| LYM665 | 68585.1 | 102.4 | 0.20 | 24 | 12.8 | 0.20 | 24 | 6.2 | 0.21 | 11 |
| LYM665 | 68586.1 | 88.4 | 0.19 | 7 | 11.0 | 0.19 | 7 | 6.0 | 0.05 | 6 |
| LYM661 | 68517.5 | — | — | — | — | — | — | 5.9 | 0.15 | 5 |
| LYM647 | 68488.1 | 100.2 | 0.02 | 21 | 12.5 | 0.02 | 21 | 6.3 | 0.04 | 13 |
| LYM631 | 68348.6 | 99.9 | 0.04 | 21 | 12.5 | 0.04 | 21 | 6.2 | L | 10 |
| LYM623 | 68484.3 | 89.8 | 0.25 | 9 | 11.2 | 0.25 | 9 | 6.0 | 0.08 | 7 |
| LYM618 | 68171.4 | 89.0 | 0.11 | 8 | 11.1 | 0.11 | 8 | 5.8 | 0.21 | 3 |
| LYM604 | 68444.3 | — | — | — | — | — | — | 5.8 | 0.29 | 4 |
| LYM598 | 68426.4 | 96.1 | L | 16 | 12.0 | L | 16 | 6.2 | 0.10 | 9 |
| LYM598 | 68429.4 | 97.2 | 0.29 | 18 | 12.1 | 0.29 | 18 | 6.1 | 0.26 | 9 |
| LYM585 | 68412.1 | 94.3 | 0.08 | 14 | 11.8 | 0.08 | 14 | 6.1 | 0.01 | 8 |
| LYM568 | 68386.3 | 92.7 | 0.10 | 12 | 11.6 | 0.10 | 12 | 6.0 | 0.13 | 7 |
| LYM532 | 68379.4 | — | — | — | — | — | — | 5.8 | 0.29 | 3 |
| LYM532 | 68380.6 | — | — | — | 11.0 | 0.18 | 7 | 6.1 | 0.02 | 8 |
| LYM524 | 68258.2 | 88.1 | 0.16 | 7 | 11.0 | 0.16 | 7 | — | — | — |
| LYM524 | 68262.2 | 96.3 | 0.29 | 17 | 12.0 | 0.29 | 17 | 6.4 | L | 13 |
| LYM707 | 68203.8 | — | — | — | 10.7 | 0.6 | 4 | — | — | — |
| CONT. | — | 82.6 | — | — | 10.3 | — | — | 5.6 | — | — |
| LYM705 | 69266.1 | 98.1 | 0.30 | 5 | 12.3 | 0.30 | 5 | — | — | — |
| LYM594 | 69286.1 | 99.3 | 0.15 | 7 | 12.4 | 0.15 | 7 | — | — | — |

TABLE 58-continued

Genes showing improved plant performance at normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM594 | 69287.2 | 98.5 | 0.23 | 6 | 12.3 | 0.23 | 6 | 6.3 | 0.27 | 3 |
| LYM586 | 69144.3 | 98.1 | 0.24 | 5 | 12.3 | 0.24 | 5 | — | — | — |
| LYM586 | 69144.4 | — | — | — | — | — | — | 6.5 | 0.18 | 6 |
| CONT. | — | 93.0 | — | — | 11.6 | — | — | 6.1 | — | — |
| LYM745 | 71269.2 | — | — | — | — | — | — | 5.7 | 0.17 | 4 |
| LYM708 | 70360.1 | — | — | — | — | — | — | 5.7 | 0.27 | 3 |
| LYM708 | 70363.1 | — | — | — | — | — | — | 5.7 | 0.26 | 3 |
| LYM671 | 70148.1 | 92.2 | 0.11 | 12 | 11.5 | 0.11 | 12 | 5.8 | 0.05 | 6 |
| LYM642 | 69195.1 | 93.1 | 0.03 | 13 | 11.6 | 0.03 | 13 | — | — | — |
| LYM642 | 69198.1 | 100.7 | L | 22 | 12.6 | L | 22 | 6.2 | 0.01 | 12 |
| LYM638 | 70077.1 | 93.0 | 0.02 | 13 | 11.6 | 0.02 | 13 | 5.9 | 0.03 | 8 |
| LYM638 | 70081.3 | 87.1 | 0.24 | 6 | 10.9 | 0.24 | 6 | — | — | — |
| LYM625 | 70075.2 | 91.8 | 0.05 | 12 | 11.5 | 0.05 | 12 | 5.9 | 0.05 | 6 |
| LYM615 | 70539.1 | 111.0 | L | 35 | 13.9 | L | 35 | 6.3 | L | 14 |
| LYM587 | 70346.4 | 89.2 | 0.23 | 8 | 11.1 | 0.23 | 8 | — | — | — |
| LYM587 | 70347.1 | — | — | — | — | — | — | 5.9 | 0.10 | 7 |
| LYM554 | 71109.5 | 91.2 | 0.10 | 11 | 11.4 | 0.10 | 11 | 5.7 | 0.16 | 4 |
| CONT. | — | 82.2 | — | — | 10.3 | — | — | 5.5 | — | — |
| LYM746 | 69207.4 | 59.5 | 0.09 | 11 | 7.4 | 0.09 | 11 | — | — | — |
| LYM746 | 69208.1 | 60.9 | 0.06 | 14 | 7.6 | 0.06 | 14 | 4.6 | 0.20 | 5 |
| LYM746 | 69210.1 | 63.3 | 0.15 | 18 | 7.9 | 0.15 | 18 | 4.7 | 0.10 | 8 |
| LYM708 | 70363.1 | 62.6 | 0.03 | 17 | 7.8 | 0.03 | 17 | 4.7 | 0.04 | 8 |
| LYM708 | 70363.4 | 60.4 | 0.08 | 13 | 7.5 | 0.08 | 13 | 4.7 | 0.06 | 7 |
| LYM688 | 68192.3 | 63.1 | 0.02 | 18 | 7.9 | 0.02 | 18 | 4.8 | 0.12 | 10 |
| LYM688 | 68196.2 | — | — | — | — | — | — | 4.7 | 0.08 | 7 |
| LYM680 | 68976.1 | — | — | — | — | — | — | 4.6 | 0.23 | 4 |
| LYM667 | 70161.1 | 59.7 | 0.08 | 11 | 7.5 | 0.08 | 11 | 4.7 | 0.05 | 9 |
| LYM667 | 70162.2 | 62.9 | 0.03 | 17 | 7.9 | 0.03 | 17 | 4.6 | 0.14 | 6 |
| LYM667 | 70163.1 | 59.8 | 0.09 | 12 | 7.5 | 0.09 | 12 | 4.6 | 0.19 | 5 |
| LYM666 | 69774.4 | 60.4 | 0.08 | 13 | 7.5 | 0.08 | 13 | 4.8 | 0.03 | 9 |
| LYM666 | 69774.5 | 63.1 | 0.23 | 18 | 7.9 | 0.23 | 18 | 4.8 | 0.08 | 11 |
| LYM645 | 68954.1 | 61.0 | 0.21 | 14 | 7.6 | 0.21 | 14 | — | — | — |
| LYM625 | 70072.1 | 57.7 | 0.25 | 8 | 7.2 | 0.25 | 8 | 4.6 | 0.21 | 5 |
| LYM625 | 70073.2 | 63.5 | 0.15 | 19 | 7.9 | 0.15 | 19 | 4.7 | 0.27 | 8 |
| LYM625 | 70075.2 | — | — | — | 7.7 | 0.23 | 14 | 4.7 | 0.21 | 9 |
| LYM583 | 70154.2 | 60.2 | 0.06 | 12 | 7.5 | 0.06 | 12 | 4.8 | 0.02 | 10 |
| LYM583 | 70157.4 | 61.7 | 0.03 | 15 | 7.7 | 0.03 | 15 | 4.6 | 0.13 | 6 |
| LYM557 | 68859.2 | — | — | — | — | — | — | 4.5 | 0.27 | 4 |
| CONT. | — | 53.5 | — | — | 6.7 | — | — | 4.4 | — | — |
| LYM700 | 70904.4 | 85.7 | 0.01 | 21 | 10.7 | 0.01 | 21 | 5.5 | 0.03 | 10 |
| LYM700 | 70906.1 | — | — | — | — | — | — | 5.2 | 0.30 | 4 |
| LYM682 | 68353.6 | 78.6 | 0.22 | 11 | 9.8 | 0.22 | 11 | 5.3 | 0.24 | 5 |
| LYM682 | 68356.2 | 76.5 | 0.28 | 8 | 9.6 | 0.28 | 8 | — | — | — |
| LYM678 | 68369.3 | 82.9 | 0.12 | 17 | 10.4 | 0.12 | 17 | — | — | — |
| LYM678 | 68369.6 | 83.0 | 0.06 | 17 | 10.4 | 0.06 | 17 | 5.5 | 0.06 | 8 |
| LYM674 | 68188.3 | 89.4 | L | 26 | 11.2 | L | 26 | 5.7 | 0.03 | 13 |
| LYM674 | 68188.4 | 87.9 | 0.10 | 24 | 11.0 | 0.10 | 24 | 5.7 | 0.02 | 13 |
| LYM670 | 70553.5 | — | — | — | — | — | — | 5.4 | 0.23 | 7 |
| LYM667 | 70160.1 | 80.6 | 0.07 | 14 | 10.1 | 0.07 | 14 | 5.6 | 0.03 | 10 |
| LYM667 | 70161.1 | — | — | — | — | — | — | 5.3 | 0.27 | 5 |
| LYM667 | 70162.2 | 78.9 | 0.28 | 12 | 9.9 | 0.28 | 12 | 5.4 | 0.29 | 8 |
| LYM660 | 68511.2 | 87.3 | 0.02 | 23 | 10.9 | 0.02 | 23 | 5.5 | 0.11 | 10 |
| LYM652 | 68495.2 | 78.5 | 0.12 | 11 | 9.8 | 0.12 | 11 | 5.4 | 0.30 | 6 |
| LYM622 | 70544.2 | 87.6 | 0.23 | 24 | 11.0 | 0.23 | 24 | 5.8 | L | 14 |
| LYM622 | 70545.1 | 78.6 | 0.28 | 11 | 9.8 | 0.28 | 11 | 5.5 | 0.21 | 9 |
| LYM622 | 70545.4 | 76.9 | 0.29 | 9 | 9.6 | 0.29 | 9 | 5.3 | 0.17 | 6 |
| LYM622 | 70548.2 | 76.3 | 0.23 | 8 | 9.5 | 0.23 | 8 | 5.3 | 0.20 | 5 |
| LYM606 | 70354.1 | — | — | — | — | — | — | 5.3 | 0.25 | 5 |
| LYM593 | 69582.2 | 78.4 | 0.13 | 11 | 9.8 | 0.13 | 11 | — | — | — |
| LYM546 | 68841.1 | 79.0 | 0.10 | 12 | 9.9 | 0.10 | 12 | 5.3 | 0.15 | 6 |
| CONT. | — | 70.7 | — | — | 8.8 | — | — | 5.0 | — | — |

Table 58. "CONT."—Control; "Ave."—Average; "% Incr." = % increment; "p-val."—p-value, L—p < 0.01.

TABLE 59

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM725 | 69177.3 | 0.8 | 0.24 | 18 | — | — | — | — | — | — |
| LYM684 | 68996.1 | 0.8 | 0.24 | 16 | — | — | — | — | — | — |
| LYM684 | 68997.3 | 0.7 | 0.29 | 15 | — | — | — | — | — | — |
| LYM679 | 69321.2 | — | — | — | 13.0 | L | 44 | 0.6 | 0.04 | 20 |
| LYM678 | 68371.3 | 0.8 | 0.27 | 16 | — | — | — | — | — | — |
| LYM673 | 68765.1 | 0.8 | 0.22 | 17 | — | — | — | — | — | — |
| LYM612 | 68459.2 | 0.8 | 0.17 | 19 | — | — | — | — | — | — |
| LYM612 | 68461.1 | 0.8 | 0.20 | 18 | — | — | — | — | — | — |
| LYM609 | 68558.3 | 0.8 | 0.08 | 26 | — | — | — | — | — | — |
| LYM609 | 68559.1 | — | — | — | 10.9 | 0.18 | 20 | 0.5 | 0.25 | 10 |
| LYM609 | 68562.2 | — | — | — | 12.7 | 0.01 | 40 | 0.5 | 0.05 | 18 |
| LYM594 | 69286.1 | 0.7 | 0.30 | 14 | — | — | — | — | — | — |
| LYM592 | 69573.2 | 0.8 | 0.13 | 20 | — | — | — | — | — | — |
| LYM590 | 68425.1 | 0.8 | 0.09 | 25 | — | — | — | — | — | — |
| LYM589 | 68416.1 | — | — | — | 13.8 | L | 52 | 0.6 | 0.06 | 23 |
| LYM588 | 68912.4 | 0.7 | 0.29 | 15 | — | — | — | — | — | — |
| LYM588 | 68914.10 | — | — | — | 13.2 | L | 46 | 0.5 | 0.11 | 18 |
| LYM580 | 68402.3 | — | — | — | 14.5 | L | 59 | 0.5 | 0.04 | 19 |
| LYM569 | 69123.1 | 0.8 | 0.23 | 18 | — | — | — | — | — | — |
| LYM566 | 69082.1 | 0.7 | 0.26 | 16 | 12.6 | 0.01 | 39 | 0.5 | 0.12 | 14 |
| LYM550 | 68848.10 | 0.8 | 0.06 | 28 | 12.4 | 0.01 | 37 | — | — | — |
| CONT. | — | 0.6 | — | — | 9.1 | — | — | 0.5 | — | — |
| LYM750 | 69213.2 | — | — | — | 10.6 | 0.26 | 18 | 0.6 | 0.27 | 12 |
| LYM750 | 69215.1 | — | — | — | 10.8 | 0.22 | 19 | — | — | — |
| LYM746 | 69207.4 | 0.8 | 0.21 | 18 | 10.8 | 0.22 | 20 | — | — | — |
| LYM706 | 69022.3 | — | — | — | 10.7 | 0.22 | 19 | — | — | — |
| LYM697 | 69004.1 | 0.8 | 0.27 | 14 | — | — | — | — | — | — |
| LYM689 | 69158.3 | — | — | — | 11.5 | 0.09 | 27 | — | — | — |
| LYM689 | 69159.2 | — | — | — | 10.9 | 0.19 | 21 | — | — | — |
| LYM689 | 69160.3 | — | — | — | — | — | — | 0.6 | 0.17 | 16 |
| LYM689 | 69160.4 | — | — | — | 11.2 | 0.14 | 24 | 0.6 | 0.23 | 14 |
| LYM658 | 69315.1 | — | — | — | 10.7 | 0.24 | 18 | — | — | — |
| LYM645 | 68955.1 | — | — | — | 10.5 | 0.30 | 16 | — | — | — |
| LYM645 | 68957.2 | — | — | — | 11.3 | 0.11 | 26 | — | — | — |
| LYM627 | 68980.2 | 0.8 | 0.29 | 14 | — | — | — | — | — | — |
| LYM627 | 68982.2 | — | — | — | 10.7 | 0.24 | 19 | — | — | — |
| LYM595 | 68925.1 | — | — | — | 11.6 | 0.08 | 29 | — | — | — |
| LYM595 | 68926.3 | 0.8 | 0.11 | 21 | — | — | — | — | — | — |
| LYM567 | 68870.2 | — | — | — | 10.7 | 0.24 | 19 | — | — | — |
| LYM567 | 68871.3 | — | — | — | 10.9 | 0.21 | 21 | — | — | — |
| CONT. | — | 0.7 | — | — | 9.0 | — | — | 0.5 | — | — |
| LYM718 | 68214.1 | 0.8 | 0.20 | 11 | — | — | — | — | — | — |
| LYM718 | 68214.4 | — | — | — | 14.3 | 0.23 | 17 | — | — | — |
| LYM630 | 68175.4 | 0.8 | 0.26 | 11 | — | — | — | — | — | — |
| CONT. | — | 0.8 | — | — | 12.2 | — | — | — | — | — |
| LYM750 | 69212.1 | — | — | — | 11.2 | 0.27 | 18 | — | — | — |
| LYM675 | 68241.3 | 0.8 | 0.12 | 23 | — | — | — | — | — | — |
| LYM616 | 68472.3 | 0.8 | 0.17 | 19 | — | — | — | — | — | — |
| LYM616 | 68472.4 | 0.8 | 0.26 | 15 | — | — | — | — | — | — |
| LYM613 | 68285.3 | 0.8 | 0.26 | 16 | — | — | — | — | — | — |
| LYM613 | 68285.4 | 0.7 | 0.29 | 14 | — | — | — | — | — | — |
| CONT. | — | 0.7 | — | — | 9.5 | — | — | — | — | — |
| LYM714 | 69619.1 | — | — | — | — | — | — | 0.5 | 0.18 | 11 |
| LYM704 | 69455.3 | — | — | — | 7.9 | 0.27 | 15 | — | — | — |
| LYM691 | 69779.3 | — | — | — | 8.3 | 0.15 | 19 | 0.5 | 0.16 | 12 |
| LYM671 | 70148.1 | — | — | — | 8.2 | 0.21 | 18 | — | — | — |
| LYM671 | 70153.1 | — | — | — | 7.9 | 0.29 | 14 | 0.5 | 0.18 | 11 |
| LYM642 | 69198.1 | — | — | — | 8.1 | 0.22 | 17 | — | — | — |
| LYM617 | 69584.1 | — | — | — | 8.0 | 0.26 | 16 | — | — | — |
| LYM617 | 69587.2 | — | — | — | — | — | — | 0.5 | 0.27 | 10 |
| LYM545 | 69556.1 | — | — | — | 8.3 | 0.14 | 21 | — | — | — |
| CONT. | — | — | — | — | 6.9 | — | — | 0.4 | — | — |
| LYM732 | 68363.4 | — | — | — | 13.3 | 0.10 | 23 | — | — | — |
| LYM732 | 68364.3 | — | — | — | 12.7 | 0.22 | 17 | 0.6 | 0.26 | 11 |
| LYM719 | 68546.6 | — | — | — | — | — | — | 0.6 | 0.17 | 14 |
| LYM665 | 68584.1 | — | — | — | 12.7 | 0.20 | 18 | — | — | — |
| LYM665 | 68585.1 | — | — | — | 13.5 | 0.10 | 25 | 0.6 | 0.26 | 12 |
| LYM665 | 68586.1 | — | — | — | — | — | — | 0.6 | 0.28 | 10 |
| LYM647 | 68488.1 | — | — | — | 13.2 | 0.13 | 22 | 0.6 | 0.11 | 16 |
| LYM631 | 68348.6 | — | — | — | 13.1 | 0.14 | 22 | 0.6 | 0.25 | 11 |
| LYM598 | 68426.4 | — | — | — | 12.7 | 0.21 | 18 | 0.6 | 0.20 | 13 |
| LYM598 | 68429.4 | — | — | — | 12.9 | 0.19 | 19 | 0.6 | 0.28 | 11 |

TABLE 59-continued

Genes showing improved plant performance at normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM585 | 68412.1 | — | — | — | — | — | — | 0.6 | 0.20 | 13 |
| LYM568 | 68386.3 | — | — | — | — | — | — | 0.6 | 0.26 | 11 |
| LYM532 | 68380.1 | — | — | — | 13.6 | 0.11 | 26 | 0.6 | 0.07 | 22 |
| LYM532 | 68380.6 | — | — | — | — | — | — | 0.6 | 0.17 | 14 |
| LYM524 | 68262.2 | — | — | — | 12.7 | 0.25 | 17 | 0.6 | 0.05 | 22 |
| CONT. | — | — | — | — | 10.8 | — | — | 0.5 | — | — |
| LYM648 | 68988.4 | 0.8 | 0.26 | 12 | — | — | — | — | — | — |
| CONT. | — | 0.8 | — | — | — | — | — | — | — | — |
| LYM745 | 71269.2 | — | — | — | — | — | — | 0.5 | 0.21 | 13 |
| LYM708 | 70359.2 | 0.8 | 0.16 | 21 | — | — | — | — | — | — |
| LYM642 | 69198.1 | — | — | — | 12.2 | 0.12 | 22 | 0.5 | 0.14 | 15 |
| LYM638 | 70077.1 | — | — | — | — | — | — | 0.5 | 0.23 | 12 |
| LYM638 | 70081.3 | — | — | — | — | — | — | 0.5 | 0.28 | 11 |
| LYM625 | 70072.1 | 0.8 | 0.20 | 21 | — | — | — | — | — | — |
| LYM615 | 70539.1 | — | — | — | 13.7 | 0.01 | 37 | 0.5 | 0.20 | 13 |
| LYM536 | 68590.5 | — | — | — | 11.6 | 0.28 | 15 | 0.5 | 0.26 | 12 |
| CONT. | — | 0.6 | — | — | 10.0 | — | — | 0.5 | — | — |
| LYM746 | 69210.1 | — | — | — | 8.4 | 0.19 | 18 | 0.5 | 0.26 | 10 |
| LYM708 | 70363.1 | — | — | — | 8.3 | 0.22 | 17 | 0.5 | 0.18 | 11 |
| LYM708 | 70363.4 | — | — | — | — | — | — | 0.5 | 0.18 | 11 |
| LYM688 | 68192.3 | — | — | — | 8.4 | 0.17 | 19 | 0.5 | 0.11 | 14 |
| LYM688 | 68196.2 | — | — | — | — | — | — | 0.5 | 0.19 | 11 |
| LYM680 | 68976.1 | — | — | — | — | — | — | 0.5 | 0.19 | 11 |
| LYM667 | 70161.1 | — | — | — | — | — | — | 0.5 | 0.14 | 12 |
| LYM667 | 70162.2 | — | — | — | 8.3 | 0.20 | 18 | — | — | — |
| LYM666 | 69774.4 | — | — | — | — | — | — | 0.5 | 0.24 | 9 |
| LYM666 | 69774.5 | 0.8 | 0.24 | 17 | 8.4 | 0.19 | 18 | 0.5 | 0.17 | 12 |
| LYM645 | 68954.1 | — | — | — | — | — | — | 0.5 | 0.12 | 13 |
| LYM638 | 70081.1 | — | — | — | — | — | — | 0.5 | 0.22 | 11 |
| LYM625 | 70073.2 | — | — | — | 8.5 | 0.15 | 20 | 0.5 | 0.13 | 13 |
| LYM625 | 70075.2 | — | — | — | — | — | — | 0.5 | 0.15 | 12 |
| LYM583 | 70154.2 | — | — | — | — | — | — | 0.5 | 0.22 | 10 |
| LYM583 | 70157.4 | — | — | — | 8.2 | 0.26 | 15 | 0.4 | 0.28 | 8 |
| CONT. | — | 0.7 | — | — | 7.1 | — | — | 0.4 | — | — |
| LYM700 | 70904.4 | — | — | — | 10.3 | 0.20 | 20 | — | — | — |
| LYM678 | 68369.6 | — | — | — | 10.1 | 0.29 | 17 | — | — | — |
| LYM674 | 68188.3 | — | — | — | 10.8 | 0.10 | 26 | — | — | — |
| LYM674 | 68188.4 | — | — | — | 10.8 | 0.11 | 26 | 0.5 | 0.16 | 18 |
| LYM670 | 70553.5 | — | — | — | — | — | — | 0.5 | 0.30 | 13 |
| LYM667 | 70160.1 | — | — | — | — | — | — | 0.5 | 0.25 | 15 |
| LYM660 | 68511.2 | — | — | — | 10.5 | 0.16 | 22 | — | — | — |
| LYM622 | 70544.2 | — | — | — | 10.7 | 0.13 | 24 | 0.5 | 0.27 | 14 |
| CONT. | — | — | — | — | 8.6 | — | — | 0.4 | — | — |

Table 59. "CONT."—Control; "Ave."—Average; "% Incr." = % increment; "p-val."—p-value, L—$p < 0.01$.

Example 16

Evaluating Transgenic *Arabidopsis* Under Normal Conditions Using In Vitro Assays [Tissue Culture T2 and T1 Plants, TC-T2 and TC-T1 Assays]

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital Imaging—

A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb(dot)nih(dot)gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling Analysis—

Using the digital analysis seedling data was calculated, including leaf area, root coverage and root length.

The relative growth rate for the various seedling parameters was calculated according to the following formulas XVI (RGR leaf area, below), V (RGR root coverage, described above) and XVII (RGR root length, below).

Relative growth rate of leaf area=Regression coefficient of leaf area along time course.    Formula XVI:

Relative growth rate of root length=Regression coefficient of root length along time course.    Formula XVII:

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights were provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical Analyses—

To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if $p<0.1$. The JMP statistics software package was used (Version 5.2.1, SAS Institute Inc., Cary, N.C., USA).

Experimental Results:

Tables 60-62 summarize the observed phenotypes of transgenic plants expressing the gene constructs using the TC-T2 Assays.

The genes presented in Table 60 showed a significant improvement as they produced larger plant biomass (plant fresh and dry weight) in T2 generation when grown under normal growth conditions, compared to control plants. The genes were cloned under the regulation of a constitutive promoter (At6669, SEQ ID NO:8529).

The evaluation of each gene was carried out by testing the performance of different number of events. Some of the genes were evaluated in more than one tissue culture assay. The results obtained in these second experiments were significantly positive as well.

TABLE 60

Genes showing improved plant performance at normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYM720 | 68248.3 | 8.6 | 0.14 | 26 | 166.4 | 0.13 | 26 |
| LYM709 | 69097.2 | 8.7 | 0.21 | 28 | 176.2 | 0.07 | 34 |
| LYM649 | 69602.1 | — | — | — | 177.6 | 0.21 | 35 |
| LYM628 | 68946.1 | 8.2 | 0.29 | 21 | 159.4 | 0.20 | 21 |
| LYM544 | 69236.1 | 8.4 | 0.13 | 24 | 165.4 | 0.09 | 26 |
| LYM544 | 69240.1 | 10.8 | 0.01 | 60 | 213.2 | L | 62 |
| LYM526 | 69228.4 | — | — | — | 167.6 | 0.23 | 27 |
| CONT. | — | 6.8 | — | — | 131.7 | — | — |
| LYM742 | 69204.2 | — | — | — | 125.1 | 0.16 | 21 |
| LYM741 | 69062.1 | 7.4 | 0.01 | 41 | 140.0 | 0.03 | 35 |
| LYM736 | 69060.3 | 6.6 | 0.13 | 25 | 126.0 | 0.12 | 21 |
| LYM683 | 69436.2 | — | — | — | 143.7 | 0.02 | 38 |
| LYM683 | 69437.1 | 7.8 | L | 49 | 154.0 | L | 48 |
| LYM683 | 69438.2 | 6.1 | 0.19 | 17 | 130.9 | 0.10 | 26 |
| LYM646 | 68960.5 | — | — | — | 131.1 | 0.24 | 26 |
| LYM563 | 68906.3 | 8.8 | 0.08 | 67 | 166.8 | 0.13 | 61 |
| LYM563 | 68906.5 | — | — | — | 118.1 | 0.23 | 14 |
| LYM563 | 68908.4 | 7.2 | 0.10 | 37 | 135.3 | 0.12 | 30 |
| LYM543 | 68834.1 | 6.3 | 0.25 | 20 | 125.5 | 0.09 | 21 |
| LYM543 | 68836.5 | 6.9 | 0.06 | 32 | 129.1 | 0.08 | 24 |
| LYM543 | 68837.2 | — | — | — | 140.2 | 0.10 | 35 |
| CONT. | — | 5.2 | — | — | 103.8 | — | — |
| LYM749 | 70679.4 | 6.4 | 0.04 | 53 | 120.2 | 0.01 | 42 |
| LYM749 | 70681.5 | — | — | — | 99.2 | 0.30 | 17 |
| LYM749 | 70681.6 | 6.9 | 0.15 | 64 | 123.3 | 0.11 | 46 |
| LYM749 | 70681.8 | 5.5 | 0.17 | 31 | 109.5 | 0.18 | 30 |
| LYM708 | 70359.2 | 5.0 | 0.30 | 19 | 102.0 | 0.10 | 21 |
| LYM708 | 70360.1 | 5.5 | 0.10 | 31 | 114.6 | 0.02 | 36 |
| LYM708 | 70361.1 | 5.2 | 0.02 | 23 | — | — | — |
| LYM708 | 70363.4 | 6.1 | 0.05 | 46 | 117.9 | 0.05 | 40 |
| LYM688 | 68192.4 | 4.7 | 0.12 | 13 | 97.3 | 0.25 | 15 |
| LYM688 | 68192.5 | 6.5 | 0.01 | 56 | 126.9 | 0.01 | 50 |
| LYM688 | 68193.1 | 6.4 | 0.02 | 53 | 116.5 | L | 38 |
| LYM688 | 68196.2 | 5.0 | L | 19 | — | — | — |
| LYM688 | 68196.3 | 6.5 | 0.04 | 54 | 115.6 | L | 37 |
| LYM670 | 70550.6 | 6.6 | 0.05 | 57 | 123.0 | 0.02 | 46 |
| LYM670 | 70553.3 | 5.4 | 0.05 | 29 | 111.0 | 0.09 | 31 |
| LYM670 | 70553.5 | 7.0 | L | 69 | 141.3 | L | 67 |
| LYM670 | 70554.2 | 5.5 | L | 31 | 107.5 | 0.06 | 27 |
| LYM670 | 70554.3 | 5.4 | 0.02 | 29 | 101.6 | 0.17 | 20 |
| LYM667 | 70160.1 | 5.9 | 0.03 | 42 | 109.6 | 0.03 | 30 |
| LYM667 | 70161.1 | 7.1 | 0.02 | 70 | 129.6 | 0.02 | 53 |
| LYM667 | 70162.2 | 6.8 | 0.19 | 62 | 131.7 | 0.16 | 56 |
| LYM667 | 70165.1 | 5.2 | 0.03 | 25 | 96.5 | 0.19 | 14 |
| LYM642 | 69196.2 | 5.6 | 0.15 | 34 | 127.6 | 0.07 | 51 |
| LYM642 | 69196.4 | 6.3 | 0.03 | 52 | 120.8 | 0.01 | 43 |
| LYM642 | 69196.5 | 5.2 | 0.10 | 25 | 106.3 | 0.06 | 26 |
| LYM642 | 69197.1 | 6.0 | 0.17 | 43 | 126.0 | 0.06 | 49 |
| LYM642 | 69198.3 | 6.0 | 0.08 | 43 | 105.3 | 0.04 | 25 |
| LYM638 | 70078.1 | 5.2 | 0.02 | 23 | — | — | — |
| LYM638 | 70080.4 | 5.0 | 0.17 | 20 | 108.1 | 0.10 | 28 |
| LYM638 | 70081.1 | 5.5 | 0.02 | 32 | 108.9 | 0.05 | 29 |
| LYM638 | 70081.3 | 6.3 | L | 51 | 112.6 | 0.05 | 33 |
| LYM615 | 70539.1 | 5.6 | 0.27 | 35 | 109.5 | 0.23 | 30 |
| LYM615 | 70539.2 | 4.9 | 0.21 | 17 | 102.1 | 0.08 | 21 |
| LYM615 | 70539.4 | 7.2 | L | 72 | 126.9 | L | 50 |
| LYM615 | 70540.4 | 7.6 | 0.02 | 81 | 142.7 | 0.02 | 69 |
| LYM593 | 69578.2 | 5.0 | 0.23 | 19 | — | — | — |
| LYM593 | 69580.2 | 7.9 | 0.16 | 89 | 143.4 | 0.13 | 70 |
| LYM593 | 69581.1 | 7.2 | L | 72 | 140.0 | L | 66 |
| LYM593 | 69582.2 | 5.9 | L | 40 | 104.7 | 0.03 | 24 |
| LYM587 | 70347.1 | 7.0 | 0.11 | 68 | 134.6 | 0.12 | 59 |
| LYM587 | 70350.1 | — | — | — | 101.0 | 0.10 | 20 |
| LYM587 | 70350.3 | 5.5 | 0.19 | 32 | 103.7 | 0.16 | 23 |
| LYM587 | 70351.1 | 6.2 | 0.12 | 50 | — | — | — |
| LYM587 | 70351.2 | 7.3 | 0.14 | 75 | 132.9 | 0.08 | 57 |
| LYM583 | 70154.1 | 5.4 | 0.01 | 29 | 111.7 | 0.02 | 32 |
| LYM583 | 70154.2 | 5.6 | L | 35 | 105.8 | 0.26 | 25 |
| LYM583 | 70157.4 | 6.4 | 0.04 | 54 | 125.6 | 0.03 | 49 |
| LYM583 | 70158.6 | 5.9 | 0.02 | 42 | 110.4 | 0.07 | 31 |
| LYM583 | 70159.3 | 6.2 | L | 48 | 123.5 | L | 46 |
| LYM574 | 70636.1 | 7.1 | 0.04 | 71 | 113.2 | 0.04 | 34 |

TABLE 60-continued

Genes showing improved plant performance at normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYM574 | 70636.4 | 5.3 | 0.09 | 28 | 101.1 | 0.26 | 20 |
| LYM574 | 70636.5 | 6.4 | 0.11 | 53 | 132.0 | 0.07 | 56 |
| LYM574 | 70638.1 | 5.6 | 0.03 | 34 | 114.0 | 0.15 | 35 |
| LYM536 | 68590.5 | 8.0 | L | 91 | 150.8 | L | 78 |
| LYM536 | 68590.6 | 6.3 | 0.06 | 50 | 127.0 | 0.02 | 50 |
| LYM536 | 68592.7 | 5.5 | 0.11 | 32 | 106.1 | 0.13 | 26 |
| LYM536 | 68592.9 | — | — | — | 108.9 | 0.16 | 29 |
| LYM522 | 69422.1 | 5.6 | 0.05 | 35 | 119.2 | 0.03 | 41 |
| LYM522 | 69423.3 | 7.2 | 0.03 | 73 | 124.5 | 0.05 | 47 |
| LYM522 | 69427.2 | 8.1 | 0.04 | 95 | 148.3 | 0.04 | 75 |
| LYM522 | 69427.4 | 8.6 | L | 105 | 149.9 | L | 77 |
| CONT. | — | 4.2 | — | — | 84.5 | — | — |
| LYM744 | 69787.4 | 8.5 | 0.07 | 53 | 140.8 | 0.20 | 24 |
| LYM736 | 69058.2 | 10.5 | 0.04 | 87 | 187.8 | 0.04 | 65 |
| LYM736 | 69058.3 | 8.4 | L | 51 | 156.3 | L | 37 |
| LYM736 | 69060.7 | 7.7 | 0.02 | 38 | 140.2 | 0.17 | 23 |
| LYM683 | 69436.2 | 6.4 | 0.29 | 15 | — | — | — |
| LYM683 | 69438.2 | 7.3 | 0.02 | 30 | 133.2 | 0.09 | 17 |
| LYM683 | 69439.1 | — | — | — | 129.7 | 0.22 | 14 |
| LYM654 | 69608.5 | 8.0 | L | 44 | 141.9 | 0.06 | 25 |
| LYM654 | 69609.3 | 6.7 | 0.28 | 20 | — | — | — |
| LYM619 | 68933.2 | 6.5 | 0.27 | 16 | — | — | — |
| LYM619 | 68933.3 | 8.2 | 0.14 | 46 | 163.5 | 0.09 | 44 |
| LYM619 | 68933.5 | 8.0 | 0.11 | 44 | 148.4 | 0.19 | 30 |
| LYM563 | 68906.2 | 7.0 | 0.10 | 25 | 137.0 | 0.11 | 20 |
| LYM563 | 68906.3 | 8.8 | 0.20 | 58 | 169.8 | 0.20 | 49 |
| LYM563 | 68908.4 | 10.3 | 0.10 | 85 | 172.9 | 0.12 | 52 |
| LYM549 | 69560.3 | 9.2 | 0.08 | 64 | 174.3 | 0.06 | 53 |
| LYM549 | 69561.1 | 7.3 | 0.02 | 31 | 131.6 | 0.12 | 16 |
| LYM549 | 69565.1 | — | — | — | 131.2 | 0.27 | 15 |
| LYM543 | 68834.1 | 8.1 | 0.03 | 45 | 142.4 | 0.06 | 25 |
| LYM543 | 68834.2 | 9.5 | 0.19 | 70 | 162.3 | 0.21 | 43 |
| LYM538 | 69758.1 | 7.8 | 0.06 | 40 | 137.3 | 0.25 | 21 |
| LYM538 | 69759.2 | 7.3 | 0.11 | 31 | 135.5 | 0.21 | 19 |
| LYM538 | 69762.3 | 6.8 | 0.21 | 22 | — | — | — |
| LYM538 | 69763.1 | 8.5 | 0.01 | 52 | 142.2 | 0.17 | 25 |
| CONT. | — | 5.6 | — | — | 113.8 | — | — |
| LYM730 | 68253.4 | 7.3 | 0.10 | 15 | — | — | — |
| LYM728 | 68570.2 | 8.2 | L | 29 | 140.7 | 0.16 | 17 |
| LYM728 | 68571.2 | 11.5 | 0.03 | 80 | 210.9 | 0.01 | 76 |
| LYM727 | 68565.10 | 8.3 | 0.05 | 30 | — | — | — |
| LYM719 | 68546.1 | 9.9 | 0.24 | 56 | 178.5 | 0.16 | 49 |
| LYM719 | 68546.6 | 7.9 | 0.04 | 24 | 146.7 | 0.06 | 22 |
| LYM719 | 68550.1 | — | — | — | 147.3 | 0.13 | 23 |
| LYM715 | 68540.2 | 7.7 | 0.18 | 21 | 142.8 | 0.24 | 19 |
| LYM715 | 68542.1 | — | — | — | 154.9 | 0.13 | 29 |
| LYM715 | 68542.3 | 8.7 | 0.15 | 37 | 159.0 | 0.12 | 32 |
| LYM715 | 68543.1 | 8.5 | L | 34 | 149.2 | 0.01 | 24 |
| LYM715 | 68544.2 | 8.1 | 0.17 | 28 | 147.6 | 0.21 | 23 |
| LYM659 | 68505.2 | 10.0 | 0.02 | 57 | 187.2 | 0.03 | 56 |
| LYM659 | 68505.3 | 7.5 | 0.10 | 17 | — | — | — |
| LYM578 | 68394.3 | 7.5 | 0.10 | 17 | 139.5 | 0.03 | 16 |
| LYM527 | 68375.4 | 7.7 | 0.14 | 21 | 155.9 | 0.11 | 30 |
| LYM527 | 68376.3 | 9.0 | 0.23 | 41 | 168.9 | 0.14 | 41 |
| CONT. | — | 6.4 | — | — | 120.0 | — | — |
| LYM730 | 68253.4 | 6.4 | 0.22 | 44 | 128.9 | 0.27 | 24 |
| LYM730 | 68256.1 | 5.4 | 0.08 | 21 | 115.2 | 0.25 | 11 |
| LYM728 | 68572.1 | 6.2 | L | 40 | 146.0 | 0.02 | 41 |
| LYM727 | 68565.10 | 5.2 | 0.28 | 18 | — | — | — |
| LYM727 | 68565.6 | 5.7 | 0.02 | 29 | 115.2 | 0.16 | 11 |
| LYM727 | 68568.2 | 6.9 | L | 56 | 125.4 | 0.09 | 21 |
| LYM713 | 70366.1 | 5.4 | 0.06 | 22 | 116.3 | 0.19 | 12 |
| LYM713 | 70367.1 | 8.2 | 0.09 | 84 | 182.3 | 0.08 | 76 |
| LYM686 | 70652.1 | 5.7 | 0.16 | 28 | — | — | — |
| LYM636 | 69596.3 | 7.5 | 0.12 | 67 | 155.0 | 0.13 | 49 |
| LYM559 | 70069.1 | 5.5 | 0.09 | 23 | 113.0 | 0.27 | 9 |
| LYM559 | 70069.3 | 6.0 | 0.05 | 34 | 132.6 | 0.04 | 28 |
| LYM541 | 69230.2 | 10.5 | L | 137 | 217.1 | L | 109 |
| LYM541 | 69230.4 | 7.8 | 0.02 | 76 | 163.6 | 0.13 | 58 |
| LYM541 | 69233.3 | 7.8 | 0.03 | 74 | 157.5 | 0.09 | 52 |
| LYM541 | 69233.4 | 12.3 | L | 178 | 230.3 | L | 122 |
| LYM540 | 68831.2 | 5.6 | 0.05 | 27 | 122.4 | 0.30 | 18 |
| LYM539 | 70532.1 | 6.6 | 0.21 | 47 | 143.1 | 0.13 | 38 |
| LYM539 | 70533.1 | 5.5 | 0.24 | 25 | — | — | — |
| CONT. | — | 4.5 | — | — | 103.8 | — | — |
| LYM722 | 71114.4 | 13.0 | 0.04 | 88 | 239.4 | 0.03 | 70 |
| LYM700 | 70906.5 | 9.2 | 0.29 | 33 | 225.9 | 0.07 | 61 |
| LYM671 | 70148.2 | 10.9 | 0.02 | 57 | 185.8 | 0.09 | 32 |
| LYM632 | 70750.2 | 10.4 | 0.05 | 50 | 182.8 | 0.10 | 30 |
| LYM632 | 70751.2 | 9.6 | 0.19 | 38 | 175.6 | 0.27 | 25 |
| LYM622 | 70545.5 | 9.2 | 0.20 | 32 | 173.7 | 0.28 | 23 |
| LYM615 | 70540.3 | 10.0 | 0.05 | 43 | 192.9 | 0.02 | 37 |
| LYM582 | 71053.2 | 12.6 | L | 81 | 229.8 | L | 63 |
| LYM554 | 71108.6 | 9.5 | 0.12 | 37 | 170.4 | 0.30 | 21 |
| LYM537 | 70673.2 | 9.8 | 0.05 | 41 | 168.6 | 0.22 | 20 |
| CONT. | — | 6.9 | — | — | 140.7 | — | — |
| LYM749 | 70677.4 | 6.8 | 0.06 | 29 | 148.9 | 0.15 | 24 |
| LYM749 | 70679.4 | 6.5 | 0.11 | 24 | 144.2 | 0.09 | 20 |
| LYM749 | 70681.5 | 6.4 | 0.07 | 22 | — | — | — |
| LYM749 | 70681.6 | 6.5 | 0.19 | 23 | — | — | — |
| LYM749 | 70681.8 | 8.2 | 0.03 | 55 | 178.6 | L | 49 |
| LYM728 | 68571.3 | 7.5 | 0.15 | 42 | 159.3 | 0.20 | 33 |
| LYM722 | 71113.2 | 8.2 | 0.09 | 55 | 167.6 | 0.12 | 40 |
| LYM722 | 71113.4 | 7.5 | 0.03 | 41 | 169.6 | L | 41 |
| LYM722 | 71114.2 | 9.7 | 0.05 | 83 | 208.6 | L | 74 |
| LYM722 | 71114.4 | 6.9 | 0.15 | 31 | 151.2 | 0.24 | 26 |
| LYM722 | 71115.2 | 9.2 | 0.02 | 74 | 176.6 | 0.02 | 47 |
| LYM722 | 71115.4 | 6.4 | 0.16 | 21 | 138.6 | 0.19 | 16 |
| LYM697 | 69003.2 | 6.4 | 0.10 | 21 | — | — | — |
| LYM697 | 69004.1 | 6.0 | 0.29 | 14 | — | — | — |
| LYM697 | 69004.2 | 8.1 | L | 53 | 146.5 | 0.19 | 22 |
| LYM697 | 69004.3 | 7.9 | 0.28 | 50 | — | — | — |
| LYM697 | 69006.3 | 6.5 | 0.07 | 23 | 147.8 | 0.10 | 23 |
| LYM682 | 68353.3 | 8.3 | 0.07 | 57 | 180.6 | 0.05 | 51 |
| LYM682 | 68354.3 | 7.5 | 0.03 | 43 | 150.6 | 0.07 | 25 |
| LYM682 | 68356.2 | 8.3 | 0.01 | 58 | 173.1 | L | 44 |
| LYM669 | 70649.3 | 8.1 | 0.06 | 53 | 163.7 | L | 36 |
| LYM669 | 70651.1 | 6.5 | 0.12 | 23 | 132.4 | 0.25 | 10 |
| LYM635 | 70168.1 | 7.9 | L | 49 | 172.5 | 0.05 | 44 |
| LYM635 | 70169.1 | 6.7 | 0.20 | 27 | 137.8 | 0.18 | 15 |
| LYM635 | 70169.2 | 6.7 | 0.03 | 27 | — | — | — |
| LYM607 | 69362.2 | 8.6 | 0.05 | 62 | 173.5 | 0.06 | 45 |
| LYM607 | 69363.2 | 8.4 | 0.06 | 59 | 178.9 | 0.03 | 49 |
| LYM607 | 69365.3 | 6.9 | 0.07 | 30 | 140.9 | 0.25 | 17 |
| LYM607 | 69366.1 | 7.8 | 0.04 | 48 | 144.0 | 0.07 | 20 |
| LYM607 | 69366.2 | 8.2 | 0.09 | 55 | 171.6 | 0.07 | 43 |
| LYM606 | 70352.2 | 8.3 | 0.11 | 57 | 175.3 | 0.09 | 46 |
| LYM606 | 70354.1 | 8.2 | 0.11 | 56 | 169.4 | 0.11 | 41 |
| LYM606 | 70357.1 | 8.6 | 0.04 | 63 | 183.4 | 0.05 | 53 |
| LYM574 | 70636.1 | 7.2 | 0.03 | 36 | 146.2 | 0.11 | 22 |
| LYM574 | 70636.4 | 7.0 | 0.13 | 32 | 139.9 | 0.24 | 17 |
| LYM574 | 70636.5 | 7.1 | 0.11 | 35 | 152.4 | 0.14 | 27 |
| LYM574 | 70638.1 | 7.5 | 0.06 | 42 | 158.4 | 0.04 | 32 |
| LYM574 | 70639.5 | — | — | — | 136.4 | 0.16 | 14 |
| LYM731 | 69036.3 | 8.5 | 0.28 | 60 | — | — | — |
| CONT. | — | 5.3 | — | — | 120.0 | — | — |
| LYM700 | 70906.4 | 7.9 | 0.23 | 23 | 151.3 | 0.12 | 24 |
| LYM660 | 68513.5 | 10.3 | 0.04 | 61 | 195.2 | 0.01 | 60 |
| LYM660 | 68514.3 | — | — | — | 138.8 | 0.28 | 14 |
| LYM632 | 70750.3 | 10.1 | 0.02 | 58 | 173.4 | 0.09 | 42 |
| LYM582 | 71053.2 | — | — | — | 156.5 | 0.21 | 29 |
| LYM582 | 71053.4 | 8.6 | 0.23 | 34 | 170.2 | 0.17 | 40 |
| LYM582 | 71054.2 | — | — | — | 141.4 | 0.07 | 16 |
| LYM562 | 70644.3 | — | — | — | 138.7 | 0.24 | 14 |
| LYM562 | 70645.1 | 8.2 | 0.19 | 29 | 157.9 | 0.20 | 30 |
| LYM554 | 71107.2 | 10.1 | L | 57 | 184.4 | L | 51 |
| LYM554 | 71108.4 | 10.2 | L | 59 | 180.8 | L | 48 |
| LYM552 | 70746.1 | 7.9 | 0.11 | 23 | — | — | — |
| LYM552 | 70747.1 | 10.2 | 0.02 | 68 | 213.0 | 0.01 | 75 |
| LYM537 | 70671.1 | 10.2 | 0.10 | 59 | 205.6 | 0.10 | 69 |
| LYM537 | 70672.1 | 9.0 | 0.03 | 41 | 158.4 | 0.09 | 30 |
| LYM529 | 70899.2 | — | — | — | 146.6 | 0.28 | 20 |
| LYM529 | 70901.4 | 7.7 | 0.20 | 20 | 146.9 | 0.17 | 21 |
| LYM522 | 69423.2 | 9.4 | 0.02 | 46 | 168.7 | 0.06 | 39 |

TABLE 60-continued

Genes showing improved plant performance at normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYM522 | 69423.3 | 8.6 | 0.17 | 34 | 149.3 | 0.25 | 23 |
| LYM522 | 69427.2 | 8.4 | 0.14 | 31 | 146.3 | 0.29 | 20 |
| CONT. | — | 6.4 | — | — | 121.8 | — | — |
| LYM747 | 69348.3 | 8.6 | 0.02 | 25 | 191.8 | L | 52 |
| LYM747 | 69349.2 | 11.1 | L | 63 | 230.1 | L | 82 |
| LYM740 | 69188.3 | 8.0 | 0.25 | 17 | — | — | — |
| LYM740 | 69190.7 | — | — | — | 146.2 | 0.07 | 16 |
| LYM739 | 68811.2 | 10.7 | 0.23 | 57 | 206.6 | 0.15 | 63 |
| LYM739 | 68812.4 | 9.5 | 0.10 | 39 | 177.0 | 0.10 | 40 |
| LYM729 | 69183.1 | 9.4 | 0.11 | 38 | 168.8 | 0.18 | 34 |
| LYM693 | 69165.4 | 9.7 | 0.12 | 41 | 176.0 | 0.13 | 39 |
| LYM693 | 69168.1 | 8.9 | 0.16 | 30 | 159.1 | 0.12 | 26 |
| LYM656 | 69311.1 | — | — | — | 162.7 | 0.18 | 29 |
| LYM656 | 69313.1 | 8.4 | 0.28 | 22 | 159.6 | 0.25 | 26 |
| LYM579 | 69137.5 | 10.1 | 0.03 | 48 | 181.4 | 0.05 | 44 |
| LYM579 | 69139.3 | 9.1 | 0.25 | 33 | 212.1 | L | 68 |
| LYM579 | 69139.4 | 9.6 | 0.01 | 40 | 170.6 | L | 35 |
| LYM555 | 68852.8 | 8.9 | 0.13 | 30 | 179.0 | 0.08 | 42 |
| LYM553 | 69243.1 | 8.3 | L | 22 | 159.3 | L | 26 |
| LYM553 | 69244.4 | — | — | — | 164.1 | 0.14 | 30 |
| LYM541 | 69230.1 | 12.3 | L | 81 | 238.9 | 0.01 | 89 |
| LYM541 | 69230.2 | 14.9 | L | 118 | 286.5 | L | 127 |
| LYM541 | 69231.3 | 14.4 | 0.05 | 111 | 251.0 | 0.08 | 99 |
| LYM541 | 69233.3 | 11.0 | L | 61 | 218.1 | L | 73 |
| LYM540 | 68831.3 | 8.8 | 0.14 | 29 | 177.6 | 0.04 | 40 |
| LYM523 | 69128.5 | 10.5 | 0.13 | 53 | 201.3 | 0.20 | 59 |
| LYM523 | 69133.4 | 9.7 | 0.20 | 41 | 181.5 | 0.16 | 44 |
| CONT. | — | 6.8 | — | — | 126.4 | — | — |
| LYM655 | 68995.3 | 11.7 | 0.04 | 40 | 210.8 | 0.03 | 41 |
| LYM622 | 70548.4 | 10.7 | 0.28 | 29 | 198.3 | 0.12 | 33 |
| LYM559 | 70069.3 | 12.8 | 0.02 | 54 | 227.0 | 0.01 | 52 |
| LYM539 | 70536.2 | 11.9 | 0.03 | 43 | 229.2 | 0.01 | 54 |
| CONT. | — | 8.3 | — | — | 149.2 | — | — |
| LYM747 | 69344.1 | 9.5 | 0.08 | 81 | 176.0 | 0.05 | 68 |
| LYM747 | 69348.3 | 8.1 | L | 55 | 170.7 | L | 63 |
| LYM747 | 69349.2 | 9.4 | L | 80 | 167.2 | 0.01 | 59 |
| LYM693 | 69165.2 | 6.9 | 0.22 | 31 | — | — | — |
| LYM656 | 69311.1 | 7.8 | 0.20 | 49 | 147.4 | 0.17 | 40 |
| LYM579 | 69139.3 | 8.4 | 0.04 | 59 | 143.8 | 0.12 | 37 |
| LYM553 | 69242.2 | 8.0 | 0.09 | 52 | 147.8 | 0.12 | 41 |
| LYM553 | 69244.2 | 6.9 | 0.13 | 30 | — | — | — |
| LYM541 | 69230.1 | 6.8 | 0.25 | 29 | — | — | — |
| LYM541 | 69230.4 | 8.2 | 0.02 | 55 | 145.2 | 0.09 | 38 |
| LYM541 | 69233.1 | 10.6 | 0.02 | 101 | 187.0 | L | 78 |
| LYM541 | 69233.3 | 6.3 | 0.27 | 19 | — | — | — |
| LYM541 | 69233.4 | 10.9 | 0.01 | 107 | 181.7 | 0.03 | 73 |
| CONT. | — | 5.3 | — | — | 105.0 | — | — |

Table 60. "CONT."—Control; "Ave."—Average; "% Incr." = % increment; "p-val."—p-value, L—p < 0.01.

The genes presented in Tables 61-62 show a significant improvement in plant performance since they produced a larger leaf biomass (leaf area) and root biomass (root length and root coverage) (Table 61) and a higher relative growth rate of leaf area, root coverage and root length (Table 62) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 61

Genes showing improved plant performance at normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LYM709 | 69097.2 | — | — | — | — | — | — | 6.9 | 0.24 | 8 |
| LYM636 | 69596.3 | — | — | — | — | — | — | 7.0 | 0.27 | 9 |
| LYM636 | 69601.6 | — | — | — | — | — | — | 7.0 | 0.21 | 8 |
| LYM628 | 68946.1 | — | — | — | 9.5 | 0.21 | 15 | — | — | — |
| LYM628 | 68946.2 | — | — | — | — | — | — | 6.9 | 0.27 | 7 |
| LYM544 | 69236.1 | 0.7 | 0.19 | 12 | — | — | — | — | — | — |
| LYM544 | 69240.1 | 0.8 | L | 34 | 11.2 | 0.03 | 37 | 6.9 | 0.28 | 7 |
| CONT. | — | 0.6 | — | — | 8.2 | — | — | 6.4 | — | — |
| LYM741 | 69062.1 | 0.6 | 0.08 | 15 | 7.0 | 0.30 | 10 | — | — | — |
| LYM741 | 69064.2 | 0.6 | 0.04 | 17 | 7.7 | 0.20 | 22 | 6.9 | 0.06 | 17 |
| LYM736 | 69060.3 | 0.6 | 0.30 | 7 | 8.0 | 0.16 | 26 | 6.8 | 0.03 | 15 |
| LYM736 | 69060.7 | — | — | — | — | — | — | 6.5 | 0.15 | 10 |
| LYM683 | 69436.2 | 0.7 | L | 22 | 9.7 | L | 53 | 7.4 | L | 27 |
| LYM683 | 69437.1 | 0.7 | L | 23 | 8.7 | L | 37 | 6.8 | 0.02 | 16 |
| LYM683 | 69438.2 | — | — | — | 9.0 | 0.05 | 42 | 7.1 | 0.02 | 21 |
| LYM683 | 69439.1 | — | — | — | 7.4 | 0.05 | 17 | 6.8 | 0.03 | 16 |
| LYM659 | 68505.2 | — | — | — | 7.1 | 0.24 | 12 | 6.6 | 0.05 | 13 |
| LYM659 | 68505.4 | — | — | — | 8.6 | 0.07 | 36 | 6.5 | 0.08 | 11 |
| LYM659 | 68506.6 | — | — | — | 7.6 | 0.24 | 20 | — | — | — |
| LYM654 | 69611.1 | — | — | — | — | — | — | 6.6 | 0.06 | 13 |
| LYM646 | 68964.1 | — | — | — | — | — | — | 6.4 | 0.19 | 9 |
| LYM619 | 68933.2 | — | — | — | 7.4 | 0.03 | 17 | 6.4 | 0.19 | 9 |
| LYM619 | 68933.5 | — | — | — | — | — | — | 6.9 | 0.05 | 17 |
| LYM578 | 68395.2 | — | — | — | — | — | — | 6.3 | 0.25 | 8 |
| LYM578 | 68395.5 | — | — | — | — | — | — | 6.6 | 0.07 | 12 |

TABLE 61-continued

Genes showing improved plant performance at normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM563 | 68906.3 | 0.7 | 0.13 | 28 | — | — | — | — | — | — |
| LYM549 | 69562.3 | — | — | — | 7.6 | 0.17 | 21 | 6.6 | 0.15 | 12 |
| LYM549 | 69562.4 | — | — | — | 7.4 | 0.24 | 17 | 7.1 | L | 21 |
| LYM543 | 68834.1 | 0.6 | 0.25 | 10 | — | — | — | — | — | — |
| LYM543 | 68836.5 | 0.6 | 0.26 | 8 | 7.4 | 0.30 | 16 | — | — | — |
| LYM543 | 68837.2 | 0.7 | 0.04 | 19 | 8.7 | L | 37 | 6.6 | 0.06 | 13 |
| LYM543 | 68837.3 | — | — | — | — | — | — | 6.6 | 0.09 | 12 |
| LYM527 | 68374.3 | — | — | — | 7.7 | 0.03 | 22 | 6.8 | 0.02 | 16 |
| LYM527 | 68377.1 | 0.6 | 0.22 | 14 | 8.2 | 0.04 | 29 | 6.8 | 0.02 | 15 |
| CONT. | — | 0.6 | — | — | 6.3 | — | — | 5.9 | — | — |
| LYM749 | 70677.4 | 0.5 | 0.05 | 20 | — | — | — | — | — | — |
| LYM749 | 70679.4 | 0.6 | 0.03 | 33 | — | — | — | — | — | — |
| LYM749 | 70681.5 | 0.6 | 0.10 | 30 | 6.7 | 0.14 | 21 | 6.8 | 0.07 | 13 |
| LYM749 | 70681.6 | 0.6 | 0.05 | 46 | 7.6 | 0.23 | 37 | — | — | — |
| LYM749 | 70681.8 | 0.5 | 0.17 | 27 | — | — | — | — | — | — |
| LYM708 | 70359.2 | 0.5 | 0.07 | 16 | — | — | — | — | — | — |
| LYM708 | 70360.1 | 0.6 | 0.01 | 38 | 7.3 | 0.21 | 31 | 6.5 | 0.26 | 9 |
| LYM708 | 70361.1 | 0.5 | 0.15 | 17 | — | — | — | — | — | — |
| LYM708 | 70363.1 | 0.5 | 0.12 | 14 | — | — | — | — | — | — |
| LYM708 | 70363.2 | 0.5 | 0.15 | 28 | 6.7 | 0.15 | 21 | — | — | — |
| LYM708 | 70363.4 | 0.6 | 0.04 | 46 | 8.2 | L | 47 | 6.6 | 0.09 | 11 |
| LYM688 | 68192.4 | 0.5 | 0.22 | 11 | 6.7 | 0.27 | 20 | — | — | — |
| LYM688 | 68192.5 | 0.6 | L | 38 | 7.9 | L | 42 | 6.6 | 0.16 | 10 |
| LYM688 | 68193.1 | 0.6 | L | 40 | — | — | — | — | — | — |
| LYM688 | 68196.2 | 0.5 | 0.08 | 13 | — | — | — | — | — | — |
| LYM688 | 68196.3 | 0.6 | L | 37 | 6.9 | 0.08 | 24 | — | — | — |
| LYM670 | 70550.6 | 0.6 | L | 33 | 7.2 | 0.18 | 31 | — | — | — |
| LYM670 | 70553.3 | 0.6 | 0.01 | 42 | 6.9 | 0.12 | 25 | — | — | — |
| LYM670 | 70553.5 | 0.7 | L | 54 | 7.4 | 0.14 | 34 | — | — | — |
| LYM670 | 70554.2 | 0.5 | 0.02 | 28 | — | — | — | — | — | — |
| LYM670 | 70554.3 | 0.5 | 0.02 | 28 | 7.6 | 0.03 | 38 | 7.0 | 0.01 | 17 |
| LYM667 | 70160.1 | 0.6 | L | 36 | 7.2 | 0.02 | 30 | 6.6 | 0.09 | 11 |
| LYM667 | 70161.1 | 0.7 | L | 59 | 8.3 | 0.01 | 49 | 6.9 | 0.03 | 15 |
| LYM667 | 70162.2 | 0.6 | 0.09 | 43 | 8.0 | L | 44 | 6.6 | 0.13 | 10 |
| LYM667 | 70163.1 | — | — | — | 6.4 | 0.19 | 16 | 6.8 | 0.11 | 14 |
| LYM667 | 70165.1 | 0.5 | 0.12 | 21 | — | — | — | — | — | — |
| LYM642 | 69196.2 | 0.6 | 0.06 | 37 | — | — | — | — | — | — |
| LYM642 | 69196.4 | 0.6 | L | 40 | 7.1 | 0.07 | 28 | — | — | — |
| LYM642 | 69196.5 | 0.5 | 0.03 | 24 | 7.0 | 0.11 | 27 | — | — | — |
| LYM642 | 69197.1 | 0.6 | 0.11 | 40 | — | — | — | — | — | — |
| LYM642 | 69198.3 | 0.5 | 0.02 | 27 | 7.6 | 0.03 | 37 | — | — | — |
| LYM638 | 70077.1 | 0.5 | 0.19 | 17 | — | — | — | — | — | — |
| LYM638 | 70080.4 | 0.5 | 0.15 | 19 | — | — | — | — | — | — |
| LYM638 | 70081.1 | 0.6 | L | 33 | — | — | — | — | — | — |
| LYM638 | 70081.3 | 0.6 | L | 31 | 7.6 | 0.13 | 38 | — | — | — |
| LYM615 | 70539.1 | 0.6 | 0.02 | 42 | — | — | — | — | — | — |
| LYM615 | 70539.2 | 0.5 | L | 26 | — | — | — | — | — | — |
| LYM615 | 70539.4 | 0.6 | L | 31 | — | — | — | — | — | — |
| LYM615 | 70540.3 | 0.5 | 0.13 | 16 | — | — | — | — | — | — |
| LYM615 | 70540.4 | 0.7 | L | 70 | 8.3 | 0.01 | 49 | 6.4 | 0.30 | 7 |
| LYM593 | 69578.3 | 0.5 | 0.12 | 14 | — | — | — | — | — | — |
| LYM593 | 69580.2 | 0.7 | 0.09 | 55 | 7.2 | 0.28 | 31 | — | — | — |
| LYM593 | 69581.1 | 0.7 | L | 56 | 8.4 | L | 52 | 6.7 | 0.05 | 12 |
| LYM593 | 69582.2 | 0.5 | L | 28 | 7.4 | 0.01 | 33 | 6.4 | 0.20 | 8 |
| LYM587 | 70347.1 | 0.6 | 0.05 | 51 | 8.2 | 0.06 | 48 | 7.0 | 0.03 | 16 |
| LYM587 | 70350.1 | 0.5 | 0.04 | 16 | — | — | — | — | — | — |
| LYM587 | 70350.3 | 0.5 | 0.15 | 25 | — | — | — | — | — | — |
| LYM587 | 70351.1 | 0.6 | 0.03 | 37 | — | — | — | — | — | — |
| LYM587 | 70351.2 | 0.7 | 0.07 | 54 | — | — | — | — | — | — |
| LYM583 | 70154.1 | 0.6 | L | 31 | 8.0 | L | 44 | 6.9 | 0.02 | 15 |
| LYM583 | 70154.2 | 0.6 | 0.13 | 31 | — | — | — | — | — | — |
| LYM583 | 70157.4 | 0.6 | 0.03 | 35 | 7.9 | 0.02 | 42 | 6.6 | 0.08 | 11 |
| LYM583 | 70158.6 | 0.6 | 0.03 | 32 | 6.7 | 0.19 | 21 | — | — | — |
| LYM583 | 70159.3 | 0.6 | 0.02 | 42 | 6.7 | 0.22 | 21 | — | — | — |
| LYM574 | 70636.1 | 0.6 | 0.03 | 46 | 7.3 | 0.19 | 32 | 6.8 | 0.05 | 14 |
| LYM574 | 70636.4 | 0.5 | 0.03 | 29 | 7.7 | 0.02 | 39 | 7.0 | 0.02 | 17 |
| LYM574 | 70636.5 | 0.6 | 0.03 | 50 | 6.9 | 0.07 | 24 | — | — | — |
| LYM574 | 70638.1 | 0.6 | 0.03 | 30 | — | — | — | — | — | — |
| LYM574 | 70639.5 | — | — | — | — | — | — | 6.5 | 0.15 | 9 |
| LYM536 | 68590.5 | 0.7 | L | 66 | 8.5 | 0.01 | 54 | 6.5 | 0.26 | 9 |
| LYM536 | 68590.6 | 0.6 | 0.04 | 46 | 7.1 | 0.26 | 27 | — | — | — |
| LYM536 | 68592.5 | 0.5 | 0.22 | 13 | 6.7 | 0.11 | 21 | 7.2 | L | 21 |
| LYM536 | 68592.7 | 0.5 | 0.08 | 19 | — | — | — | — | — | — |

TABLE 61-continued

Genes showing improved plant performance at normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM536 | 68592.9 | 0.6 | 0.10 | 32 | 7.2 | 0.06 | 29 | 6.7 | 0.06 | 12 |
| LYM522 | 69422.1 | 0.5 | 0.21 | 13 | 7.0 | 0.06 | 26 | — | — | — |
| LYM522 | 69423.3 | 0.6 | L | 53 | 7.5 | 0.10 | 35 | — | — | — |
| LYM522 | 69427.2 | 0.6 | 0.03 | 50 | — | — | — | — | — | — |
| LYM522 | 69427.4 | 0.6 | L | 32 | — | — | — | — | — | — |
| CONT. | — | 0.4 | — | — | 5.5 | — | — | 6.0 | — | — |
| LYM736 | 69058.2 | 0.8 | 0.01 | 45 | 10.0 | 0.05 | 35 | 6.8 | 0.04 | 7 |
| LYM736 | 69058.3 | 0.7 | 0.02 | 26 | — | — | — | — | — | — |
| LYM736 | 69060.3 | — | — | — | — | — | — | 7.0 | 0.08 | 9 |
| LYM736 | 69060.7 | 0.6 | 0.20 | 15 | — | — | — | — | — | — |
| LYM683 | 69437.1 | 0.6 | 0.23 | 8 | — | — | — | — | — | — |
| LYM683 | 69438.2 | 0.6 | 0.18 | 8 | — | — | — | — | — | — |
| LYM654 | 69608.5 | 0.6 | 0.21 | 17 | — | — | — | — | — | — |
| LYM654 | 69611.1 | — | — | — | 8.4 | 0.21 | 14 | — | — | — |
| LYM654 | 69612.5 | 0.6 | 0.19 | 15 | — | — | — | 6.8 | 0.04 | 7 |
| LYM619 | 68933.3 | 0.7 | 0.16 | 25 | — | — | — | — | — | — |
| LYM619 | 68933.4 | 0.6 | 0.28 | 14 | — | — | — | — | — | — |
| LYM619 | 68933.5 | 0.6 | 0.20 | 17 | — | — | — | — | — | — |
| LYM563 | 68906.2 | 0.6 | 0.16 | 14 | — | — | — | — | — | — |
| LYM563 | 68906.3 | 0.7 | 0.16 | 28 | — | — | — | — | — | — |
| LYM563 | 68908.4 | 0.8 | 0.07 | 45 | 8.9 | 0.27 | 21 | — | — | — |
| LYM549 | 69560.3 | 0.7 | 0.06 | 29 | 9.5 | 0.05 | 30 | 6.7 | 0.28 | 4 |
| LYM549 | 69562.4 | — | — | — | — | — | — | 6.6 | 0.29 | 4 |
| LYM543 | 68834.2 | 0.7 | 0.11 | 41 | — | — | — | — | — | — |
| LYM543 | 68837.3 | 0.6 | 0.06 | 19 | 8.0 | 0.29 | 9 | 6.7 | 0.29 | 5 |
| LYM538 | 69758.1 | 0.6 | 0.15 | 16 | — | — | — | — | — | — |
| LYM538 | 69759.2 | 0.6 | 0.28 | 9 | — | — | — | — | — | — |
| LYM538 | 69763.1 | 0.7 | 0.04 | 28 | 9.7 | 0.03 | 32 | 7.0 | 0.24 | 10 |
| LYM538 | 69763.3 | 0.7 | 0.22 | 28 | — | — | — | — | — | — |
| CONT. | — | 0.5 | — | — | 7.4 | — | — | 6.4 | — | — |
| LYM730 | 68253.4 | 0.5 | 0.28 | 9 | — | — | — | — | — | — |
| LYM728 | 68570.2 | 0.7 | L | 40 | — | — | — | — | — | — |
| LYM728 | 68571.2 | 0.8 | L | 73 | — | — | — | — | — | — |
| LYM728 | 68571.4 | 0.6 | 0.08 | 24 | — | — | — | — | — | — |
| LYM727 | 68565.10 | 0.6 | L | 31 | — | — | — | — | — | — |
| LYM727 | 68568.1 | 0.6 | 0.20 | 17 | — | — | — | — | — | — |
| LYM719 | 68546.1 | 0.6 | 0.20 | 32 | — | — | — | — | — | — |
| LYM719 | 68546.6 | 0.5 | 0.07 | 15 | — | — | — | — | — | — |
| LYM715 | 68540.2 | 0.5 | 0.04 | 15 | — | — | — | — | — | — |
| LYM715 | 68542.1 | 0.6 | 0.09 | 26 | — | — | — | — | — | — |
| LYM715 | 68542.3 | 0.6 | 0.06 | 30 | — | — | — | — | — | — |
| LYM715 | 68543.1 | 0.6 | L | 24 | — | — | — | — | — | — |
| LYM715 | 68544.2 | 0.5 | 0.08 | 16 | — | — | — | — | — | — |
| LYM659 | 68505.2 | 0.7 | 0.01 | 45 | 6.0 | 0.10 | 24 | — | — | — |
| LYM659 | 68505.3 | 0.5 | 0.30 | 9 | — | — | — | — | — | — |
| LYM578 | 68394.3 | 0.6 | L | 36 | — | — | — | — | — | — |
| LYM578 | 68395.2 | 0.5 | 0.05 | 14 | — | — | — | — | — | — |
| LYM527 | 68375.4 | 0.6 | 0.05 | 30 | — | — | — | — | — | — |
| LYM527 | 68376.3 | 0.6 | 0.06 | 34 | 5.9 | 0.18 | 22 | — | — | — |
| LYM527 | 68377.1 | 0.5 | 0.28 | 12 | — | — | — | — | — | — |
| CONT. | — | 0.5 | — | — | 4.9 | — | — | — | — | — |
| LYM730 | 68256.1 | 0.5 | 0.18 | 11 | — | — | — | — | — | — |
| LYM728 | 68571.3 | 0.6 | 0.11 | 15 | — | — | — | — | — | — |
| LYM728 | 68572.1 | 0.7 | L | 36 | — | — | — | — | — | — |
| LYM727 | 68565.10 | 0.5 | 0.30 | 10 | — | — | — | — | — | — |
| LYM727 | 68565.6 | 0.5 | 0.20 | 11 | — | — | — | — | — | — |
| LYM727 | 68568.2 | 0.6 | 0.03 | 22 | 9.5 | 0.03 | 52 | 7.1 | L | 23 |
| LYM713 | 70366.1 | — | — | — | — | — | — | 6.4 | 0.20 | 10 |
| LYM713 | 70367.1 | 0.7 | 0.08 | 50 | — | — | — | 6.3 | 0.28 | 9 |
| LYM713 | 70368.1 | 0.6 | 0.24 | 27 | — | — | — | — | — | — |
| LYM686 | 70654.3 | — | — | — | 8.0 | 0.07 | 29 | 6.5 | 0.14 | 12 |
| LYM636 | 69596.3 | 0.6 | 0.19 | 16 | — | — | — | — | — | — |
| LYM559 | 70069.1 | — | — | — | 7.7 | 0.05 | 23 | 6.5 | 0.05 | 13 |
| LYM559 | 70069.3 | 0.5 | 0.25 | 11 | — | — | — | 6.3 | 0.16 | 9 |
| LYM541 | 69230.2 | 0.8 | L | 72 | 11.3 | 0.05 | 81 | 6.3 | 0.27 | 9 |
| LYM541 | 69230.4 | 0.7 | 0.01 | 41 | — | — | — | — | — | — |
| LYM541 | 69233.3 | 0.6 | 0.03 | 28 | — | — | — | — | — | — |
| LYM541 | 69233.4 | 0.7 | L | 52 | 9.6 | L | 53 | — | — | — |
| LYM540 | 68829.4 | — | — | — | — | — | — | 6.3 | 0.18 | 9 |
| LYM540 | 68831.2 | — | — | — | 9.4 | 0.04 | 50 | 6.9 | 0.04 | 20 |
| LYM539 | 70532.1 | 0.6 | 0.09 | 22 | — | — | — | — | — | — |
| CONT. | — | 0.5 | — | — | 6.3 | — | — | 5.8 | — | — |
| LYM722 | 71114.4 | 0.9 | L | 47 | 8.5 | 0.11 | 50 | — | — | — |

TABLE 61-continued

Genes showing improved plant performance at normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM700 | 70906.5 | 0.7 | 0.17 | 27 | — | — | — | — | — | — |
| LYM671 | 70148.2 | 0.7 | 0.06 | 26 | 6.8 | 0.16 | 21 | — | — | — |
| LYM635 | 70169.2 | — | — | — | 7.9 | 0.06 | 41 | 6.4 | 0.02 | 14 |
| LYM632 | 70750.2 | 0.7 | 0.13 | 22 | 7.1 | 0.15 | 26 | — | — | — |
| LYM625 | 70073.2 | 0.7 | 0.18 | 20 | — | — | — | — | — | — |
| LYM625 | 70073.4 | 0.7 | 0.19 | 24 | — | — | — | — | — | — |
| LYM625 | 70075.2 | — | — | — | — | — | — | 6.3 | 0.09 | 12 |
| LYM622 | 70545.5 | — | — | — | 9.0 | 0.09 | 61 | 6.5 | 0.01 | 17 |
| LYM622 | 70548.2 | — | — | — | 8.5 | 0.12 | 51 | 6.3 | 0.11 | 13 |
| LYM615 | 70540.3 | 0.7 | 0.11 | 21 | 7.9 | 0.03 | 40 | 6.2 | 0.03 | 12 |
| LYM582 | 71053.2 | 0.8 | 0.04 | 36 | 8.5 | 0.01 | 52 | 5.9 | 0.19 | 6 |
| LYM554 | 71108.6 | 0.7 | 0.30 | 16 | — | — | — | — | — | — |
| LYM552 | 70743.1 | — | — | — | 8.2 | 0.05 | 47 | 6.7 | L | 20 |
| LYM538 | 69762.3 | 0.7 | 0.14 | 19 | — | — | — | — | — | — |
| LYM537 | 70673.2 | 0.7 | 0.18 | 17 | 7.7 | 0.10 | 38 | 6.0 | 0.23 | 8 |
| CONT. | — | 0.6 | — | — | 5.6 | — | — | 5.6 | — | — |
| LYM749 | 70679.4 | 0.6 | L | 20 | — | — | — | — | — | — |
| LYM749 | 70681.5 | 0.6 | 0.13 | 10 | — | — | — | 6.7 | 0.24 | 7 |
| LYM749 | 70681.8 | 0.7 | 0.01 | 35 | — | — | — | — | — | — |
| LYM728 | 68570.2 | 0.7 | 0.02 | 35 | — | — | — | — | — | — |
| LYM728 | 68571.1 | 0.7 | 0.19 | 31 | — | — | — | — | — | — |
| LYM728 | 68571.3 | 0.6 | 0.04 | 26 | — | — | — | — | — | — |
| LYM728 | 68574.2 | 0.7 | 0.03 | 32 | — | — | — | — | — | — |
| LYM722 | 71113.2 | 0.7 | 0.04 | 33 | — | — | — | — | — | — |
| LYM722 | 71113.4 | 0.6 | 0.03 | 26 | — | — | — | — | — | — |
| LYM722 | 71114.2 | 0.7 | 0.01 | 37 | — | — | — | — | — | — |
| LYM722 | 71114.4 | 0.6 | 0.22 | 21 | — | — | — | — | — | — |
| LYM722 | 71115.2 | 0.7 | L | 32 | 8.4 | 0.01 | 31 | — | — | — |
| LYM697 | 69006.3 | 0.6 | 0.14 | 11 | — | — | — | — | — | — |
| LYM682 | 68353.3 | 0.7 | 0.05 | 43 | 7.7 | 0.26 | 20 | — | — | — |
| LYM682 | 68353.6 | — | — | — | — | — | — | 6.7 | 0.22 | 6 |
| LYM682 | 68354.3 | 0.7 | 0.03 | 30 | 7.5 | 0.25 | 17 | — | — | — |
| LYM682 | 68356.2 | 0.7 | L | 36 | — | — | — | — | — | — |
| LYM669 | 70649.3 | 0.7 | 0.01 | 29 | — | — | — | — | — | — |
| LYM669 | 70650.2 | 0.6 | 0.29 | 9 | — | — | — | — | — | — |
| LYM669 | 70651.1 | 0.6 | 0.05 | 13 | 7.4 | 0.25 | 15 | — | — | — |
| LYM635 | 70168.1 | 0.7 | 0.02 | 34 | — | — | — | — | — | — |
| LYM635 | 70169.1 | 0.6 | 0.01 | 19 | — | — | — | — | — | — |
| LYM635 | 70169.2 | 0.6 | 0.10 | 18 | — | — | — | — | — | — |
| LYM607 | 69362.2 | 0.7 | L | 36 | — | — | — | — | — | — |
| LYM607 | 69363.2 | 0.7 | 0.01 | 37 | — | — | — | — | — | — |
| LYM607 | 69365.3 | 0.6 | 0.12 | 25 | — | — | — | — | — | — |
| LYM607 | 69366.1 | 0.7 | 0.02 | 29 | 9.1 | 0.01 | 41 | — | — | — |
| LYM607 | 69366.2 | 0.7 | 0.11 | 36 | — | — | — | — | — | — |
| LYM606 | 70352.1 | 0.6 | 0.04 | 20 | — | — | — | — | — | — |
| LYM606 | 70352.2 | 0.7 | 0.01 | 35 | — | — | — | — | — | — |
| LYM606 | 70353.6 | 0.6 | 0.25 | 12 | — | — | — | — | — | — |
| LYM606 | 70354.1 | 0.7 | 0.02 | 35 | — | — | — | — | — | — |
| LYM606 | 70357.1 | 0.8 | L | 50 | 7.6 | 0.16 | 18 | — | — | — |
| LYM574 | 70636.1 | 0.6 | 0.01 | 19 | — | — | — | — | — | — |
| LYM574 | 70636.4 | 0.6 | 0.10 | 23 | — | — | — | — | — | — |
| LYM574 | 70636.5 | 0.6 | 0.14 | 14 | — | — | — | — | — | — |
| LYM574 | 70638.1 | 0.6 | L | 27 | — | — | — | — | — | — |
| CONT. | — | 0.5 | — | — | 6.4 | — | — | 6.3 | — | — |
| LYM709 | 69092.2 | 0.8 | 0.26 | 17 | — | — | — | — | — | — |
| LYM709 | 69096.1 | — | — | — | — | — | — | 6.5 | 0.25 | 5 |
| LYM649 | 69604.1 | — | — | — | — | — | — | 6.6 | 0.24 | 7 |
| LYM628 | 68945.1 | 0.8 | 0.20 | 18 | — | — | — | — | — | — |
| LYM628 | 68945.3 | — | — | — | — | — | — | 6.7 | 0.24 | 7 |
| LYM628 | 68946.1 | — | — | — | — | — | — | 7.0 | 0.06 | 12 |
| LYM611 | 68453.2 | — | — | — | 10.2 | 0.22 | 33 | 7.1 | 0.03 | 14 |
| LYM561 | 69352.2 | — | — | — | — | — | — | 6.8 | 0.07 | 9 |
| LYM561 | 69355.1 | — | — | — | — | — | — | 6.7 | 0.12 | 7 |
| LYM544 | 69238.4 | — | — | — | — | — | — | 6.7 | 0.28 | 7 |
| CONT. | — | 0.7 | — | — | 7.7 | — | — | 6.2 | — | — |
| LYM700 | 70906.4 | 0.7 | 0.20 | 18 | — | — | — | — | — | — |
| LYM660 | 68513.5 | 0.7 | 0.04 | 31 | 6.8 | 0.11 | 28 | — | — | — |
| LYM632 | 70750.3 | 0.6 | 0.20 | 15 | 6.8 | 0.25 | 29 | — | — | — |
| LYM582 | 71053.3 | — | — | — | 6.8 | 0.13 | 29 | — | — | — |
| LYM582 | 71053.4 | — | — | — | 7.4 | 0.25 | 40 | — | — | — |
| LYM562 | 70645.1 | — | — | — | 7.8 | 0.02 | 48 | 6.5 | 0.02 | 10 |
| LYM554 | 71107.2 | 0.6 | 0.16 | 15 | 8.5 | L | 61 | — | — | — |
| LYM554 | 71108.4 | 0.7 | 0.01 | 21 | 8.7 | L | 64 | — | — | — |

TABLE 61-continued

Genes showing improved plant performance at normal growth conditions under regulation of At6669 promoter

| Gene Name | Event # | Leaf Area [cm²] Ave. | Leaf Area [cm²] P-Val. | Leaf Area [cm²] % Incr. | Roots Coverage [cm²] Ave. | Roots Coverage [cm²] P-Val. | Roots Coverage [cm²] % Incr. | Roots Length [cm] Ave. | Roots Length [cm] P-Val. | Roots Length [cm] % Incr. |
|---|---|---|---|---|---|---|---|---|---|---|
| LYM552 | 70745.2 | — | — | — | 6.3 | 0.12 | 19 | 6.3 | 0.17 | 7 |
| LYM552 | 70746.1 | — | — | — | 7.1 | L | 33 | — | — | — |
| LYM552 | 70747.1 | 0.8 | 0.01 | 44 | 9.6 | 0.04 | 81 | 7.0 | L | 19 |
| LYM537 | 70671.1 | 0.8 | 0.09 | 39 | 9.6 | 0.07 | 81 | 6.7 | 0.06 | 13 |
| LYM537 | 70672.1 | — | — | — | 6.0 | 0.27 | 14 | — | — | — |
| CONT. | — | 0.6 | — | — | 5.3 | — | — | 5.9 | — | — |
| LYM747 | 69349.2 | 0.7 | 0.12 | 15 | 11.8 | L | 36 | 7.5 | 0.07 | 11 |
| LYM740 | 69190.7 | 0.6 | 0.12 | 10 | — | — | — | — | — | — |
| LYM739 | 68811.2 | 0.8 | 0.15 | 35 | 12.2 | 0.18 | 40 | 7.3 | 0.16 | 8 |
| LYM739 | 68812.3 | — | — | — | — | — | — | 7.2 | 0.14 | 8 |
| LYM739 | 68812.4 | 0.8 | 0.04 | 29 | 12.6 | 0.02 | 45 | 7.4 | 0.05 | 10 |
| LYM693 | 69165.4 | 0.7 | 0.11 | 19 | — | — | — | — | — | — |
| LYM693 | 69167.1 | — | — | — | — | — | — | 7.3 | 0.19 | 9 |
| LYM693 | 69168.1 | 0.7 | 0.21 | 14 | — | — | — | — | — | — |
| LYM656 | 69311.1 | 0.7 | 0.21 | 23 | — | — | — | 7.4 | 0.22 | 10 |
| LYM656 | 69313.1 | 0.7 | 0.27 | 19 | — | — | — | — | — | — |
| LYM579 | 69137.5 | 0.8 | 0.04 | 38 | — | — | — | — | — | — |
| LYM579 | 69139.3 | 0.7 | 0.21 | 24 | — | — | — | 7.2 | 0.19 | 7 |
| LYM579 | 69139.4 | 0.7 | 0.02 | 20 | 11.5 | 0.03 | 32 | — | — | — |
| LYM555 | 68852.8 | 0.8 | 0.02 | 30 | 11.2 | 0.03 | 28 | 7.3 | 0.20 | 9 |
| LYM553 | 69243.1 | 0.7 | 0.05 | 12 | — | — | — | 7.2 | 0.20 | 7 |
| LYM553 | 69244.4 | 0.6 | 0.29 | 9 | — | — | — | 7.2 | 0.18 | 7 |
| LYM541 | 69230.1 | 0.8 | L | 44 | 15.5 | L | 78 | 7.6 | 0.02 | 13 |
| LYM541 | 69230.2 | 1.0 | L | 66 | 16.5 | L | 89 | 7.6 | 0.03 | 13 |
| LYM541 | 69231.3 | 0.9 | 0.07 | 52 | — | — | — | — | — | — |
| LYM541 | 69233.3 | 0.8 | 0.01 | 40 | 11.0 | 0.04 | 26 | — | — | — |
| LYM541 | 69234.1 | 0.7 | 0.11 | 11 | — | — | — | — | — | — |
| LYM540 | 68831.2 | — | — | — | 10.6 | 0.18 | 22 | 7.2 | 0.21 | 8 |
| LYM540 | 68831.3 | — | — | — | 10.3 | 0.22 | 18 | — | — | — |
| LYM523 | 69128.5 | 0.7 | 0.17 | 26 | — | — | — | — | — | — |
| LYM523 | 69133.4 | 0.7 | 0.17 | 25 | 11.9 | L | 37 | — | — | — |
| CONT. | — | 0.6 | — | — | 8.7 | — | — | 6.7 | — | — |
| LYM669 | 70649.3 | — | — | — | — | — | — | 6.7 | 0.26 | 6 |
| LYM655 | 68994.2 | — | — | — | 11.7 | 0.01 | 53 | 7.1 | 0.03 | 13 |
| LYM655 | 68994.5 | 0.7 | 0.26 | 19 | — | — | — | — | — | — |
| LYM655 | 68995.3 | 0.8 | 0.04 | 29 | 11.3 | 0.03 | 48 | 7.2 | 0.09 | 14 |
| LYM622 | 70548.4 | 0.8 | 0.03 | 31 | 11.4 | 0.02 | 48 | 7.2 | 0.06 | 14 |
| LYM559 | 70069.3 | 0.8 | 0.02 | 33 | 11.4 | 0.01 | 49 | 7.2 | 0.03 | 13 |
| LYM539 | 70535.1 | — | — | — | 10.7 | 0.08 | 39 | 7.5 | 0.03 | 18 |
| LYM539 | 70536.2 | 0.9 | L | 42 | 13.1 | L | 71 | 7.7 | L | 21 |
| LYM533 | 70059.4 | — | — | — | — | — | — | 6.7 | 0.26 | 7 |
| LYM524 | 68261.4 | — | — | — | — | — | — | 7.0 | 0.08 | 10 |
| LYM560 | 69072.1 | — | — | — | — | — | — | 6.4 | 0.6 | 2.7 |
| CONT. | — | 0.6 | — | — | 7.7 | — | — | 6.3 | — | — |
| LYM729 | 69186.2 | — | — | — | 6.7 | 0.23 | 33 | 6.7 | 0.29 | 9 |
| LYM579 | 69139.3 | — | — | — | 6.0 | 0.19 | 20 | — | — | — |
| LYM553 | 69242.2 | 0.6 | 0.29 | 15 | — | — | — | — | — | — |
| LYM541 | 69230.4 | 0.7 | 0.11 | 25 | — | — | — | — | — | — |
| LYM541 | 69233.1 | 0.7 | 0.02 | 36 | 7.1 | 0.01 | 42 | — | — | — |
| LYM541 | 69233.4 | 0.7 | 0.02 | 31 | — | — | — | — | — | — |
| CONT. | — | 0.5 | — | — | 5.0 | — | — | 6.1 | — | — |

Table 61. "CONT."—Control; "Ave."—Average; "% Incr." = % increment; "p-val."—p-value, L—p < 0.01.

TABLE 62

Genes showing improved plant performance at normal growth conditions under regulation of At6669 promoter

| Gene Name | Event # | RGR Of Leaf Area Ave. | RGR Of Leaf Area P-Val. | RGR Of Leaf Area % Incr. | RGR Of Roots Coverage Ave. | RGR Of Roots Coverage P-Val. | RGR Of Roots Coverage % Incr. | RGR Of Root Length Ave. | RGR Of Root Length P-Val. | RGR Of Root Length % Incr. |
|---|---|---|---|---|---|---|---|---|---|---|
| LYM741 | 69062.2 | — | — | — | — | — | — | 0.6 | 0.12 | 22 |
| LYM709 | 69097.2 | 0.1 | 0.28 | 18 | — | — | — | — | — | — |
| LYM636 | 69601.6 | — | — | — | — | — | — | 0.6 | 0.22 | 17 |
| LYM628 | 68946.1 | — | — | — | 1.1 | 0.24 | 18 | — | — | — |
| LYM544 | 69236.1 | 0.1 | 0.20 | 19 | — | — | — | — | — | — |
| LYM544 | 69240.1 | 0.1 | L | 44 | 1.3 | 0.02 | 39 | — | — | — |
| LYM526 | 69228.4 | 0.1 | 0.29 | 17 | — | — | — | — | — | — |
| CONT. | — | 0.1 | — | — | 1.0 | — | — | 0.5 | — | — |

TABLE 62-continued

Genes showing improved plant performance at normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM741 | 69062.1 | 0.1 | 0.01 | 28 | — | — | — | — | — | — |
| LYM741 | 69064.2 | 0.1 | 0.07 | 20 | 0.9 | 0.12 | 21 | 0.6 | 0.12 | 22 |
| LYM736 | 69058.3 | 0.1 | 0.12 | 18 | — | — | — | — | — | — |
| LYM736 | 69060.3 | 0.1 | 0.19 | 13 | 0.9 | 0.08 | 25 | 0.5 | 0.29 | 14 |
| LYM736 | 69060.7 | — | — | — | — | — | — | 0.6 | 0.08 | 23 |
| LYM683 | 69436.2 | 0.1 | L | 36 | 1.2 | L | 58 | 0.7 | L | 46 |
| LYM683 | 69437.1 | 0.1 | 0.01 | 28 | 1.0 | L | 38 | 0.6 | 0.06 | 26 |
| LYM683 | 69438.2 | 0.1 | 0.04 | 30 | 1.1 | L | 44 | 0.6 | 0.04 | 30 |
| LYM683 | 69439.1 | — | — | — | 0.9 | 0.12 | 17 | 0.5 | 0.18 | 18 |
| LYM659 | 68505.2 | — | — | — | 0.8 | 0.25 | 14 | 0.5 | 0.23 | 16 |
| LYM659 | 68505.4 | — | — | — | 1.0 | L | 38 | — | — | — |
| LYM659 | 68506.6 | 0.1 | 0.27 | 12 | 0.9 | 0.12 | 21 | — | — | — |
| LYM654 | 69611.1 | — | — | — | — | — | — | 0.5 | 0.26 | 15 |
| LYM646 | 68964.1 | — | — | — | — | — | — | 0.5 | 0.16 | 19 |
| LYM619 | 68933.2 | — | — | — | 0.9 | 0.12 | 18 | — | — | — |
| LYM619 | 68933.5 | — | — | — | 1.0 | 0.09 | 30 | — | — | — |
| LYM578 | 68395.5 | — | — | — | — | — | — | 0.6 | 0.06 | 24 |
| LYM563 | 68906.3 | 0.1 | L | 43 | — | — | — | — | — | — |
| LYM563 | 68906.5 | 0.1 | 0.06 | 22 | — | — | — | — | — | — |
| LYM563 | 68908.4 | 0.1 | 0.28 | 14 | — | — | — | — | — | — |
| LYM549 | 69562.3 | — | — | — | 0.9 | 0.11 | 21 | — | — | — |
| LYM549 | 69562.4 | — | — | — | 0.9 | 0.15 | 18 | 0.6 | 0.03 | 31 |
| LYM543 | 68834.1 | 0.1 | 0.08 | 19 | 0.9 | 0.15 | 19 | — | — | — |
| LYM543 | 68836.5 | 0.1 | 0.16 | 15 | 0.9 | 0.20 | 17 | — | — | — |
| LYM543 | 68837.2 | 0.1 | 0.03 | 27 | 1.0 | L | 40 | 0.6 | 0.08 | 23 |
| LYM543 | 68837.3 | — | — | — | — | — | — | 0.6 | 0.11 | 21 |
| LYM527 | 68374.3 | — | — | — | 0.9 | 0.08 | 22 | 0.5 | 0.19 | 17 |
| LYM527 | 68377.1 | 0.1 | 0.12 | 19 | 0.9 | 0.02 | 29 | 0.5 | 0.22 | 15 |
| CONT. | — | 0.1 | — | — | 0.7 | — | — | 0.5 | — | — |
| LYM749 | 70679.4 | 0.1 | 0.01 | 35 | — | — | — | — | — | — |
| LYM749 | 70681.5 | 0.1 | 0.13 | 22 | 0.8 | 0.19 | 21 | 0.6 | 0.13 | 21 |
| LYM749 | 70681.6 | 0.1 | L | 43 | 0.9 | 0.07 | 40 | — | — | — |
| LYM749 | 70681.8 | 0.1 | 0.11 | 24 | — | — | — | — | — | — |
| LYM708 | 70359.2 | 0.1 | 0.14 | 16 | — | — | — | — | — | — |
| LYM708 | 70360.1 | 0.1 | 0.02 | 32 | 0.8 | 0.10 | 32 | 0.6 | 0.18 | 19 |
| LYM708 | 70361.1 | 0.1 | 0.22 | 15 | — | — | — | — | — | — |
| LYM708 | 70363.2 | 0.1 | 0.13 | 23 | 0.8 | 0.20 | 20 | — | — | — |
| LYM708 | 70363.4 | 0.1 | 0.01 | 40 | 0.9 | L | 48 | — | — | — |
| LYM688 | 68192.4 | — | — | — | 0.8 | 0.29 | 18 | — | — | — |
| LYM688 | 68192.5 | 0.1 | 0.01 | 32 | 0.9 | 0.02 | 37 | — | — | — |
| LYM688 | 68193.1 | 0.1 | L | 36 | — | — | — | — | — | — |
| LYM688 | 68196.3 | 0.1 | 0.02 | 28 | 0.8 | 0.13 | 23 | — | — | — |
| LYM670 | 70550.6 | 0.1 | 0.02 | 31 | 0.8 | 0.16 | 27 | — | — | — |
| LYM670 | 70553.3 | 0.1 | L | 36 | 0.8 | 0.18 | 22 | — | — | — |
| LYM670 | 70553.5 | 0.1 | L | 46 | 0.8 | 0.09 | 31 | — | — | — |
| LYM670 | 70554.2 | 0.1 | 0.05 | 24 | — | — | — | — | — | — |
| LYM670 | 70554.3 | 0.1 | 0.04 | 25 | 0.9 | 0.04 | 35 | — | — | — |
| LYM667 | 70160.1 | 0.1 | 0.01 | 33 | 0.8 | 0.05 | 30 | 0.6 | 0.21 | 16 |
| LYM667 | 70161.1 | 0.1 | L | 53 | 1.0 | L | 50 | 0.6 | 0.16 | 18 |
| LYM667 | 70162.2 | 0.1 | 0.02 | 41 | 0.9 | L | 43 | — | — | — |
| LYM667 | 70165.1 | 0.1 | 0.28 | 14 | — | — | — | — | — | — |
| LYM642 | 69196.2 | 0.1 | 0.08 | 25 | — | — | — | — | — | — |
| LYM642 | 69196.4 | 0.1 | 0.02 | 29 | 0.8 | 0.10 | 26 | — | — | — |
| LYM642 | 69196.5 | 0.1 | 0.23 | 14 | 0.8 | 0.11 | 27 | — | — | — |
| LYM642 | 69197.1 | 0.1 | 0.11 | 27 | — | — | — | — | — | — |
| LYM642 | 69198.3 | 0.1 | 0.11 | 20 | 0.9 | 0.03 | 35 | — | — | — |
| LYM638 | 70080.4 | 0.1 | 0.22 | 16 | — | — | — | — | — | — |
| LYM638 | 70081.1 | 0.1 | 0.04 | 25 | — | — | — | — | — | — |
| LYM638 | 70081.3 | 0.1 | 0.02 | 30 | 0.9 | 0.05 | 39 | — | — | — |
| LYM615 | 70539.1 | 0.1 | 0.11 | 23 | — | — | — | — | — | — |
| LYM615 | 70539.2 | 0.1 | 0.02 | 26 | — | — | — | — | — | — |
| LYM615 | 70539.4 | 0.1 | 0.05 | 22 | — | — | — | — | — | — |
| LYM615 | 70540.4 | 0.1 | L | 59 | 0.9 | L | 45 | — | — | — |
| LYM593 | 69580.2 | 0.1 | 0.01 | 54 | 0.8 | 0.13 | 32 | 0.5 | 0.28 | 15 |
| LYM593 | 69581.1 | 0.1 | L | 47 | 1.0 | L | 50 | — | — | — |
| LYM593 | 69582.2 | 0.1 | 0.01 | 29 | 0.8 | 0.05 | 31 | — | — | — |
| LYM587 | 70347.1 | 0.1 | 0.02 | 42 | 0.9 | 0.02 | 46 | 0.5 | 0.29 | 15 |
| LYM587 | 70350.1 | 0.1 | 0.17 | 16 | — | — | — | — | — | — |
| LYM587 | 70350.3 | 0.1 | 0.13 | 22 | — | — | — | — | — | — |
| LYM587 | 70351.1 | 0.1 | 0.02 | 30 | — | — | — | — | — | — |
| LYM587 | 70351.2 | 0.1 | L | 54 | — | — | — | — | — | — |
| LYM583 | 70154.1 | 0.1 | 0.02 | 25 | 0.9 | 0.01 | 42 | 0.6 | 0.16 | 18 |
| LYM583 | 70154.2 | 0.1 | 0.15 | 22 | — | — | — | — | — | — |

TABLE 62-continued

Genes showing improved plant performance at normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM583 | 70157.4 | 0.1 | 0.01 | 33 | 0.9 | 0.02 | 39 | — | — | — |
| LYM583 | 70158.6 | 0.1 | 0.04 | 27 | 0.8 | 0.26 | 18 | — | — | — |
| LYM583 | 70159.3 | 0.1 | L | 37 | 0.8 | 0.20 | 21 | — | — | — |
| LYM574 | 70636.1 | 0.1 | L | 47 | 0.8 | 0.11 | 30 | 0.6 | 0.17 | 19 |
| LYM574 | 70636.4 | 0.1 | 0.03 | 28 | 0.9 | 0.02 | 39 | 0.6 | 0.15 | 18 |
| LYM574 | 70636.5 | 0.1 | L | 47 | 0.8 | 0.12 | 24 | — | — | — |
| LYM574 | 70638.1 | 0.1 | 0.05 | 26 | 0.8 | 0.27 | 19 | — | — | — |
| LYM536 | 68590.5 | 0.1 | L | 60 | 1.0 | L | 54 | — | — | — |
| LYM536 | 68590.6 | 0.1 | L | 46 | 0.8 | 0.19 | 25 | — | — | — |
| LYM536 | 68592.5 | — | — | — | 0.8 | 0.23 | 18 | 0.6 | 0.05 | 26 |
| LYM536 | 68592.7 | 0.1 | 0.16 | 18 | — | — | — | — | — | — |
| LYM536 | 68592.9 | 0.1 | 0.06 | 30 | 0.8 | 0.08 | 28 | — | — | — |
| LYM522 | 69422.1 | 0.1 | 0.23 | 15 | 0.8 | 0.07 | 30 | 0.6 | 0.09 | 23 |
| LYM522 | 69423.3 | 0.1 | L | 47 | 0.9 | 0.05 | 35 | — | — | — |
| LYM522 | 69427.2 | 0.1 | 0.01 | 38 | — | — | — | — | — | — |
| LYM522 | 69427.4 | 0.1 | L | 34 | — | — | — | — | — | — |
| CONT. | — | 0.0 | — | — | 0.6 | — | — | 0.5 | — | — |
| LYM736 | 69058.2 | 0.1 | L | 49 | 1.2 | L | 36 | — | — | — |
| LYM736 | 69058.3 | 0.1 | 0.01 | 25 | — | — | — | — | — | — |
| LYM736 | 69060.3 | — | — | — | 1.0 | 0.21 | 17 | — | — | — |
| LYM736 | 69060.7 | 0.1 | 0.06 | 20 | — | — | — | — | — | — |
| LYM683 | 69438.2 | 0.1 | 0.26 | 9 | — | — | — | — | — | — |
| LYM654 | 69608.5 | 0.1 | 0.02 | 27 | — | — | — | — | — | — |
| LYM654 | 69611.1 | 0.1 | 0.11 | 19 | 1.0 | 0.17 | 16 | — | — | — |
| LYM654 | 69612.5 | 0.1 | 0.02 | 24 | — | — | — | — | — | — |
| LYM619 | 68933.3 | 0.1 | 0.02 | 30 | — | — | — | — | — | — |
| LYM619 | 68933.4 | 0.1 | 0.15 | 16 | — | — | — | — | — | — |
| LYM619 | 68933.5 | 0.1 | 0.09 | 18 | — | — | — | — | — | — |
| LYM563 | 68906.2 | 0.1 | 0.07 | 18 | — | — | — | — | — | — |
| LYM563 | 68906.3 | 0.1 | 0.04 | 31 | — | — | — | — | — | — |
| LYM563 | 68908.4 | 0.1 | L | 52 | 1.0 | 0.12 | 22 | — | — | — |
| LYM549 | 69560.3 | 0.1 | L | 39 | 1.1 | 0.01 | 33 | — | — | — |
| LYM549 | 69561.1 | 0.1 | 0.28 | 10 | — | — | — | — | — | — |
| LYM549 | 69562.4 | — | — | — | 1.0 | 0.25 | 16 | — | — | — |
| LYM543 | 68834.2 | 0.1 | 0.02 | 41 | — | — | — | — | — | — |
| LYM543 | 68837.3 | 0.1 | 0.09 | 17 | — | — | — | — | — | — |
| LYM538 | 69758.1 | 0.1 | 0.11 | 17 | — | — | — | — | — | — |
| LYM538 | 69759.2 | 0.1 | 0.17 | 13 | — | — | — | — | — | — |
| LYM538 | 69763.1 | 0.1 | L | 34 | 1.2 | L | 34 | 0.6 | 0.20 | 14 |
| LYM538 | 69763.3 | 0.1 | 0.05 | 34 | — | — | — | — | — | — |
| CONT. | — | 0.1 | — | — | 0.9 | — | — | 0.5 | — | — |
| LYM730 | 68253.4 | 0.1 | 0.27 | 13 | — | — | — | — | — | — |
| LYM728 | 68570.2 | 0.1 | L | 46 | — | — | — | — | — | — |
| LYM728 | 68571.2 | 0.1 | L | 75 | — | — | — | — | — | — |
| LYM728 | 68571.4 | 0.1 | 0.13 | 21 | — | — | — | — | — | — |
| LYM727 | 68565.10 | 0.1 | 0.02 | 31 | — | — | — | — | — | — |
| LYM727 | 68568.1 | 0.1 | 0.26 | 15 | — | — | — | — | — | — |
| LYM719 | 68546.1 | 0.1 | 0.04 | 39 | — | — | — | — | — | — |
| LYM719 | 68546.6 | 0.1 | 0.15 | 17 | — | — | — | — | — | — |
| LYM719 | 68550.1 | 0.1 | 0.28 | 14 | — | — | — | — | — | — |
| LYM719 | 68550.4 | — | — | — | 0.7 | 0.29 | 15 | — | — | — |
| LYM715 | 68540.2 | 0.1 | 0.22 | 14 | — | — | — | — | — | — |
| LYM715 | 68542.1 | 0.1 | 0.04 | 28 | 0.7 | 0.18 | 21 | — | — | — |
| LYM715 | 68542.3 | 0.1 | 0.01 | 36 | — | — | — | — | — | — |
| LYM715 | 68543.1 | 0.1 | 0.04 | 23 | — | — | — | — | — | — |
| LYM715 | 68544.2 | 0.1 | 0.13 | 19 | — | — | — | — | — | — |
| LYM659 | 68505.2 | 0.1 | L | 42 | 0.7 | 0.06 | 25 | — | — | — |
| LYM578 | 68394.3 | 0.1 | L | 34 | — | — | — | — | — | — |
| LYM527 | 68375.4 | 0.1 | 0.02 | 32 | — | — | — | — | — | — |
| LYM527 | 68376.3 | 0.1 | 0.01 | 38 | 0.7 | 0.11 | 23 | — | — | — |
| CONT. | — | 0.0 | — | — | 0.6 | — | — | — | — | — |
| LYM743 | 69342.2 | — | — | — | — | — | — | 0.5 | 0.18 | 14 |
| LYM743 | 69343.2 | — | — | — | — | — | — | 0.6 | 0.12 | 15 |
| LYM730 | 68253.4 | 0.1 | 0.05 | 33 | — | — | — | — | — | — |
| LYM730 | 68256.1 | 0.1 | 0.28 | 14 | — | — | — | — | — | — |
| LYM728 | 68570.2 | 0.1 | 0.18 | 21 | — | — | — | — | — | — |
| LYM728 | 68571.3 | 0.1 | 0.15 | 20 | — | — | — | — | — | — |
| LYM728 | 68572.1 | 0.1 | L | 40 | — | — | — | — | — | — |
| LYM727 | 68565.6 | 0.1 | 0.22 | 16 | — | — | — | — | — | — |
| LYM727 | 68568.2 | 0.1 | L | 38 | 1.1 | L | 55 | 0.6 | L | 30 |
| LYM713 | 70366.1 | 0.1 | 0.30 | 13 | — | — | — | 0.6 | 0.11 | 18 |
| LYM713 | 70367.1 | 0.1 | L | 68 | 1.0 | 0.17 | 34 | 0.6 | 0.16 | 15 |
| LYM713 | 70368.1 | 0.1 | 0.10 | 32 | — | — | — | 0.5 | 0.22 | 13 |

TABLE 62-continued

Genes showing improved plant performance at normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM686 | 70654.3 | 0.1 | 0.16 | 21 | 0.9 | 0.04 | 28 | 0.6 | 0.08 | 19 |
| LYM636 | 69596.3 | 0.1 | 0.04 | 32 | — | — | — | — | — | — |
| LYM636 | 69597.1 | 0.1 | 0.25 | 16 | — | — | — | — | — | — |
| LYM636 | 69601.5 | — | — | — | — | — | — | 0.6 | 0.11 | 17 |
| LYM559 | 70069.1 | 0.1 | 0.21 | 17 | 0.9 | 0.06 | 24 | 0.6 | 0.06 | 19 |
| LYM559 | 70069.3 | 0.1 | 0.12 | 21 | 0.9 | 0.25 | 16 | 0.6 | 0.09 | 19 |
| LYM541 | 69230.2 | 0.1 | L | 93 | 1.4 | L | 86 | 0.6 | 0.10 | 19 |
| LYM541 | 69230.4 | 0.1 | L | 60 | — | — | — | — | — | — |
| LYM541 | 69233.3 | 0.1 | L | 43 | 0.9 | 0.22 | 18 | 0.5 | 0.30 | 12 |
| LYM541 | 69233.4 | 0.1 | L | 79 | 1.2 | L | 55 | 0.6 | 0.13 | 16 |
| LYM540 | 68829.1 | — | — | — | — | — | — | 0.6 | 0.12 | 17 |
| LYM540 | 68829.4 | — | — | — | — | — | — | 0.5 | 0.19 | 14 |
| LYM540 | 68831.2 | — | — | — | 1.1 | L | 49 | 0.6 | 0.10 | 21 |
| LYM539 | 70532.1 | 0.1 | 0.01 | 36 | — | — | — | — | — | — |
| LYM523 | 69128.1 | 0.1 | 0.29 | 17 | 0.9 | 0.27 | 17 | — | — | — |
| LYM523 | 69128.5 | — | — | — | — | — | — | 0.5 | 0.14 | 14 |
| LYM523 | 69133.3 | — | — | — | — | — | — | 0.5 | 0.29 | 11 |
| LYM523 | 69133.4 | — | — | — | — | — | — | 0.6 | 0.24 | 16 |
| CONT. | — | 0.0 | — | — | 0.7 | — | — | 0.5 | — | — |
| LYM722 | 71114.4 | 0.1 | 0.01 | 53 | 1.0 | 0.03 | 55 | 0.5 | 0.14 | 22 |
| LYM700 | 70904.4 | — | — | — | — | — | — | 0.5 | 0.19 | 19 |
| LYM700 | 70906.5 | 0.1 | 0.19 | 29 | — | — | — | — | — | — |
| LYM671 | 70148.2 | 0.1 | 0.10 | 32 | 0.8 | 0.20 | 25 | — | — | — |
| LYM671 | 70150.4 | — | — | — | — | — | — | 0.5 | 0.16 | 20 |
| LYM635 | 70169.2 | — | — | — | 0.9 | 0.04 | 43 | — | — | — |
| LYM632 | 70750.2 | 0.1 | 0.23 | 24 | 0.8 | 0.15 | 29 | — | — | — |
| LYM625 | 70073.2 | 0.1 | 0.26 | 22 | — | — | — | — | — | — |
| LYM625 | 70073.4 | 0.1 | 0.26 | 24 | — | — | — | — | — | — |
| LYM625 | 70075.2 | — | — | — | 0.9 | 0.16 | 39 | — | — | — |
| LYM622 | 70545.5 | 0.1 | 0.21 | 25 | 1.1 | L | 66 | 0.5 | 0.19 | 19 |
| LYM622 | 70548.2 | — | — | — | 1.0 | 0.03 | 55 | 0.5 | 0.27 | 18 |
| LYM615 | 70540.3 | 0.1 | 0.12 | 30 | 0.9 | 0.03 | 43 | — | — | — |
| LYM615 | 70540.4 | — | — | — | — | — | — | 0.5 | 0.30 | 15 |
| LYM582 | 71053.2 | 0.1 | 0.06 | 40 | 1.0 | L | 57 | 0.5 | 0.28 | 14 |
| LYM582 | 71055.5 | — | — | — | — | — | — | 0.5 | 0.24 | 17 |
| LYM554 | 71108.6 | 0.1 | 0.30 | 21 | — | — | — | — | — | — |
| LYM552 | 70743.1 | — | — | — | 0.9 | 0.03 | 48 | — | — | — |
| LYM538 | 69762.3 | — | — | — | — | — | — | 0.5 | 0.29 | 17 |
| LYM537 | 70673.2 | 0.1 | 0.23 | 23 | 0.9 | 0.07 | 39 | — | — | — |
| LYM529 | 70899.2 | — | — | — | — | — | — | 0.5 | 0.19 | 18 |
| LYM529 | 70901.4 | — | — | — | — | — | — | 0.5 | 0.23 | 16 |
| CONT. | — | 0.1 | — | — | 0.6 | — | — | 0.4 | — | — |
| LYM749 | 70677.4 | 0.1 | 0.20 | 17 | — | — | — | — | — | — |
| LYM749 | 70679.4 | 0.1 | 0.05 | 23 | — | — | — | — | — | — |
| LYM749 | 70681.5 | — | — | — | — | — | — | 0.7 | 0.18 | 13 |
| LYM749 | 70681.8 | 0.1 | L | 38 | — | — | — | — | — | — |
| LYM728 | 68570.2 | 0.1 | 0.01 | 33 | — | — | — | — | — | — |
| LYM728 | 68571.1 | 0.1 | 0.08 | 30 | — | — | — | — | — | — |
| LYM728 | 68571.3 | 0.1 | 0.04 | 27 | — | — | — | — | — | — |
| LYM728 | 68574.2 | 0.1 | 0.03 | 29 | — | — | — | — | — | — |
| LYM722 | 71113.2 | 0.1 | L | 36 | — | — | — | — | — | — |
| LYM722 | 71113.4 | 0.1 | 0.02 | 30 | — | — | — | — | — | — |
| LYM722 | 71114.2 | 0.1 | L | 42 | — | — | — | — | — | — |
| LYM722 | 71114.4 | 0.1 | 0.07 | 27 | — | — | — | — | — | — |
| LYM722 | 71115.2 | 0.1 | L | 36 | 1.0 | 0.03 | 33 | — | — | — |
| LYM697 | 69006.3 | 0.1 | 0.20 | 16 | — | — | — | — | — | — |
| LYM682 | 68353.3 | 0.1 | L | 43 | 0.9 | 0.20 | 20 | — | — | — |
| LYM682 | 68354.3 | 0.1 | 0.02 | 31 | 0.9 | 0.27 | 17 | — | — | — |
| LYM682 | 68356.2 | 0.1 | L | 32 | — | — | — | — | — | — |
| LYM669 | 70649.3 | 0.1 | 0.01 | 32 | — | — | — | — | — | — |
| LYM669 | 70650.2 | 0.1 | 0.25 | 13 | — | — | — | — | — | — |
| LYM669 | 70651.1 | 0.1 | 0.25 | 13 | 0.9 | 0.29 | 16 | — | — | — |
| LYM635 | 70168.1 | 0.1 | L | 36 | — | — | — | — | — | — |
| LYM635 | 70169.1 | 0.1 | 0.19 | 15 | — | — | — | — | — | — |
| LYM635 | 70169.2 | 0.1 | 0.21 | 15 | — | — | — | — | — | — |
| LYM607 | 69362.2 | 0.1 | L | 36 | — | — | — | — | — | — |
| LYM607 | 69363.2 | 0.1 | L | 41 | — | — | — | — | — | — |
| LYM607 | 69365.3 | 0.1 | 0.06 | 26 | — | — | — | — | — | — |
| LYM607 | 69366.1 | 0.1 | 0.03 | 27 | 1.1 | L | 41 | — | — | — |
| LYM607 | 69366.2 | 0.1 | 0.04 | 33 | — | — | — | — | — | — |
| LYM606 | 70352.1 | 0.1 | 0.12 | 18 | — | — | — | — | — | — |

TABLE 62-continued

Genes showing improved plant performance at normal growth conditions under regulation of At6669 promoter

| Gene Name | Event # | RGR Of Leaf Area Ave. | P-Val. | % Incr. | RGR Of Roots Coverage Ave. | P-Val. | % Incr. | RGR Of Root Length Ave. | P-Val. | % Incr. |
|---|---|---|---|---|---|---|---|---|---|---|
| LYM606 | 70352.2 | 0.1 | L | 34 | — | — | — | — | — | — |
| LYM606 | 70353.6 | 0.1 | 0.26 | 13 | — | — | — | — | — | — |
| LYM606 | 70354.1 | 0.1 | L | 38 | — | — | — | — | — | — |
| LYM606 | 70357.1 | 0.1 | L | 50 | 0.9 | 0.21 | 19 | — | — | — |
| LYM574 | 70636.1 | 0.1 | 0.07 | 21 | — | — | — | — | — | — |
| LYM574 | 70636.4 | 0.1 | 0.15 | 19 | — | — | — | — | — | — |
| LYM574 | 70636.5 | 0.1 | 0.16 | 17 | — | — | — | — | — | — |
| LYM574 | 70638.1 | 0.1 | 0.04 | 26 | — | — | — | — | — | — |
| CONT. | — | 0.1 | — | — | 0.8 | — | — | 0.6 | — | — |
| LYM649 | 69604.1 | — | — | — | — | — | — | 0.6 | 0.13 | 25 |
| LYM628 | 68944.1 | — | — | — | — | — | — | 0.5 | 0.20 | 19 |
| LYM628 | 68946.1 | — | — | — | — | — | — | 0.5 | 0.24 | 19 |
| LYM611 | 68453.2 | — | — | — | 1.2 | 0.15 | 35 | — | — | — |
| LYM561 | 69350.1 | — | — | — | — | — | — | 0.5 | 0.24 | 18 |
| LYM544 | 69238.4 | — | — | — | — | — | — | 0.5 | 0.16 | 22 |
| LYM526 | 69228.3 | — | — | — | — | — | — | 0.5 | 0.30 | 16 |
| LYM526 | 69228.4 | — | — | — | — | — | — | 0.5 | 0.25 | 20 |
| LYM521 | 69218.1 | — | — | — | — | — | — | 0.5 | 0.29 | 15 |
| CONT. | — | — | — | — | 0.9 | — | — | 0.4 | — | — |
| LYM700 | 70906.4 | 0.1 | 0.06 | 27 | — | — | — | — | — | — |
| LYM660 | 68513.5 | 0.1 | L | 40 | 0.8 | 0.03 | 26 | — | — | — |
| LYM632 | 70750.3 | 0.1 | 0.06 | 24 | 0.8 | 0.09 | 27 | — | — | — |
| LYM582 | 71053.2 | 0.1 | — | — | 0.7 | 0.23 | 18 | — | — | — |
| LYM582 | 71053.3 | — | — | — | 0.8 | 0.02 | 31 | — | — | — |
| LYM582 | 71053.4 | 0.1 | 0.23 | 18 | 0.9 | 0.03 | 42 | — | — | — |
| LYM562 | 70645.1 | 0.1 | 0.15 | 18 | 0.9 | L | 48 | 0.6 | 0.17 | 13 |
| LYM554 | 71107.2 | 0.1 | 0.03 | 27 | 1.0 | L | 64 | — | — | — |
| LYM554 | 71108.4 | 0.1 | L | 32 | 1.1 | L | 70 | — | — | — |
| LYM554 | 71108.5 | — | — | — | — | — | — | 0.6 | 0.18 | 13 |
| LYM554 | 71109.5 | 0.1 | 0.18 | 17 | — | — | — | — | — | — |
| LYM552 | 70745.2 | 0.1 | 0.18 | 16 | 0.7 | 0.04 | 20 | — | — | — |
| LYM552 | 70746.1 | — | — | — | 0.8 | L | 30 | — | — | — |
| LYM552 | 70747.1 | 0.1 | L | 54 | 1.1 | L | 79 | 0.6 | 0.27 | 13 |
| LYM537 | 70671.1 | 0.1 | L | 49 | 1.1 | L | 79 | — | — | — |
| LYM537 | 70672.1 | 0.1 | 0.18 | 17 | 0.7 | 0.14 | 15 | — | — | — |
| LYM537 | 70674.3 | 0.1 | 0.16 | 22 | 0.8 | 0.27 | 22 | — | — | — |
| LYM529 | 70899.2 | 0.1 | 0.23 | 16 | 0.7 | 0.26 | 13 | — | — | — |
| LYM529 | 70901.4 | 0.1 | 0.23 | 15 | 0.7 | 0.25 | 13 | — | — | — |
| LYM522 | 69423.2 | 0.1 | 0.15 | 21 | — | — | — | — | — | — |
| LYM522 | 69423.3 | 0.1 | 0.29 | 15 | — | — | — | — | — | — |
| CONT. | — | 0.1 | — | — | 0.6 | — | — | 0.5 | — | — |
| LYM747 | 69349.2 | 0.1 | 0.02 | 21 | 1.4 | L | 36 | — | — | — |
| LYM740 | 69190.4 | 0.1 | 0.28 | 11 | — | — | — | — | — | — |
| LYM740 | 69190.7 | 0.1 | 0.09 | 12 | — | — | — | — | — | — |
| LYM739 | 68811.2 | 0.1 | 0.02 | 36 | 1.5 | 0.04 | 39 | — | — | — |
| LYM739 | 68812.4 | 0.1 | L | 39 | 1.5 | L | 45 | — | — | — |
| LYM729 | 69183.1 | — | — | — | 1.3 | 0.18 | 22 | — | — | — |
| LYM693 | 69165.4 | 0.1 | 0.04 | 20 | — | — | — | — | — | — |
| LYM693 | 69168.1 | 0.1 | 0.13 | 14 | — | — | — | — | — | — |
| LYM656 | 69309.2 | 0.1 | 0.25 | 13 | — | — | — | — | — | — |
| LYM656 | 69311.1 | 0.1 | 0.02 | 27 | — | — | — | — | — | — |
| LYM656 | 69313.1 | 0.1 | 0.06 | 24 | 1.3 | 0.18 | 21 | — | — | — |
| LYM579 | 69137.5 | 0.1 | L | 40 | — | — | — | — | — | — |
| LYM579 | 69139.3 | 0.1 | 0.06 | 24 | 1.3 | 0.18 | 24 | — | — | — |
| LYM579 | 69139.4 | 0.1 | L | 24 | 1.4 | 0.03 | 32 | — | — | — |
| LYM555 | 68852.8 | 0.1 | L | 30 | 1.3 | 0.03 | 29 | — | — | — |
| LYM555 | 68855.5 | 0.1 | 0.28 | 11 | — | — | — | — | — | — |
| LYM553 | 69243.1 | 0.1 | 0.03 | 15 | — | — | — | — | — | — |
| LYM553 | 69244.4 | 0.1 | 0.22 | 10 | — | — | — | — | — | — |
| LYM541 | 69230.1 | 0.1 | L | 57 | 1.9 | L | 78 | — | — | — |
| LYM541 | 69230.2 | 0.1 | L | 82 | 2.0 | L | 90 | — | — | — |
| LYM541 | 69231.3 | 0.1 | L | 57 | 1.5 | 0.10 | 44 | — | — | — |
| LYM541 | 69233.3 | 0.1 | L | 46 | 1.3 | 0.05 | 27 | — | — | — |
| LYM541 | 69234.1 | 0.1 | 0.05 | 15 | — | — | — | 0.7 | 0.18 | 16 |
| LYM540 | 68831.2 | — | — | — | 1.3 | 0.12 | 21 | — | — | — |
| LYM540 | 68831.3 | — | — | — | 1.2 | 0.18 | 19 | — | — | — |
| LYM523 | 69128.5 | 0.1 | 0.02 | 31 | — | — | — | — | — | — |
| LYM523 | 69133.4 | 0.1 | 0.05 | 26 | 1.4 | 0.01 | 36 | — | — | — |
| CONT. | — | 0.1 | — | — | 1.0 | — | — | 0.6 | — | — |
| LYM669 | 70650.4 | — | — | — | — | — | — | 0.6 | 0.09 | 28 |
| LYM655 | 68994.2 | — | — | — | 1.4 | 0.01 | 57 | 0.6 | 0.26 | 18 |
| LYM655 | 68994.5 | — | — | — | 1.1 | 0.30 | 26 | 0.6 | 0.26 | 19 |
| LYM655 | 68995.3 | 0.1 | 0.12 | 30 | 1.4 | 0.03 | 51 | 0.6 | 0.23 | 20 |

TABLE 62-continued

Genes showing improved plant performance at normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM622 | 70548.4 | 0.1 | 0.07 | 36 | 1.4 | 0.02 | 53 | 0.7 | 0.04 | 33 |
| LYM559 | 70069.3 | 0.1 | 0.06 | 35 | 1.4 | 0.02 | 53 | 0.6 | 0.09 | 25 |
| LYM539 | 70532.1 | — | — | — | — | — | — | 0.6 | 0.18 | 21 |
| LYM539 | 70535.1 | — | — | — | 1.3 | 0.06 | 43 | 0.7 | 0.04 | 34 |
| LYM539 | 70535.2 | — | — | — | — | — | — | 0.6 | 0.27 | 18 |
| LYM539 | 70536.2 | 0.1 | 0.02 | 48 | 1.6 | L | 77 | 0.7 | 0.04 | 33 |
| LYM533 | 70059.4 | — | — | — | — | — | — | 0.6 | 0.23 | 18 |
| LYM524 | 68261.4 | — | — | — | — | — | — | 0.6 | 0.13 | 23 |
| CONT. | — | 0.1 | — | — | 0.9 | — | — | 0.5 | — | — |
| LYM739 | 68812.4 | — | — | — | 0.8 | 0.24 | 28 | — | — | — |
| LYM729 | 69186.2 | — | — | — | 0.8 | 0.16 | 34 | — | — | — |
| LYM553 | 69242.2 | 0.1 | 0.24 | 22 | — | — | — | — | — | — |
| LYM541 | 69230.4 | 0.1 | 0.14 | 28 | 0.8 | 0.21 | 36 | — | — | — |
| LYM541 | 69233.1 | 0.1 | 0.04 | 38 | 0.9 | 0.03 | 45 | — | — | — |
| LYM541 | 69233.4 | 0.1 | 0.06 | 36 | — | — | — | — | — | — |
| CONT. | — | 0.1 | — | — | 0.6 | — | — | — | — | — |

Table 62. "CONT."—Control; "Ave."—Average; "% Incr." = % increment; "p-val."—p-value, L—$p < 0.01$.

Results from T1 Plants

The genes presented in Tables 63-64 showed a significant improvement in plant biomass and root development since they produced a larger leaf and root biomass (leaf area, root length and root coverage) (Table 63), and a higher relative growth rate of leaf area, root coverage and root length (Table 64) when grown under normal growth conditions, compared to control plants. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO:8529). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

Tables 63-64 summarize the observed phenotypes of transgenic plants expressing the gene constructs using the TC-T1 Assays.

TABLE 63

Genes showing improved plant performance at normal growth conditions under regulation of At6669 promoter

| Gene Name | Leaf Area [cm2] | | | Roots Coverage [cm2] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYM701_H1 | — | — | — | — | — | — | 2.9 | 0.28 | 10 |
| CONT. | — | — | — | — | — | — | 2.7 | — | — |
| LYM668 | — | — | — | — | — | — | 4.1 | 0.20 | 54 |
| CONT. | — | — | — | — | — | — | 2.7 | — | — |

Table 63. "CONT."—Control; "Ave."—Average; "% Incr." = % increment; "p-val."—p-value, L—$p < 0.01$.

TABLE 64

Genes showing improved plant performance at normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LYM701_H1 | — | — | — | — | — | — | 0.3 | 0.06 | 17 |
| CONT. | — | — | — | — | — | — | 0.3 | — | — |
| LYM722 | 0.1 | 0.13 | 30 | 0.3 | 0.11 | 40 | — | — | — |
| LYM554 | 0.1 | 0.28 | 13 | — | — | — | — | — | — |
| CONT. | 0.0 | — | — | 0.2 | — | — | — | — | — |
| LYM668 | — | — | — | 0.4 | 0.07 | 68 | 0.4 | L | 71 |
| CONT. | — | — | — | 0.2 | — | — | 0.3 | — | — |

Table 64. "CONT."—Control; "Ave."—Average; "% Incr." = % increment; "p-val."—p-value, L—$p < 0.01$ These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (9179 sequences)

SEQ ID NO: 1 - DNA, 1143 bp, Hordeum vulgare
gcgaccctatatacggacggcgcacaccacgcgagccgcggcaaaggcacagagaagagaggggacaacagtcaaaagcgagcgaggcggaagaaatcccttgagatggacgcgcgaccgcgacgggcatcgtcctcgccggcggcggcgacggcggccttctccctgctgctcctgttccccatgctccaagggagccaggcgtcggcgcacggcaacgattcggtcgcctgcggcatgacggcgctgcagaagcacgcggcgttcttcgacggcgacaaggacggcgtcgtcaccttctccgagacatacgcagcgtttcgggccctcggattcggatacgccgcctccaccttgagcgctaccttcatcaatggcgtccttggcccccagaccagaccggaaaatgagacggcgcgctattctatctacatcgagaacatccacaagggtatccatggaagcgattcaggcgcatatgactcccaaggaaggttcgtcccggacaagttcgaggcggcgttcgccaagcacgccaagacggtgcccgacgccctgacgtccgccgaggtggacgagctgatcaccgcgaaccggcagcccagcgactacgcaggatgggcgggcgcgtcggcggagtggaagatgctgtacagcatcggcaaggacaaggacgggctcctccgcaaggacgccgccaggggcgtctacgatggcagcctcttcgccagggtggtgcaggagcggaggacgtcgtcgcaagaagaaacccaggcatgatgggttgttcggttcatcggagggcgtcactgtcccaagcgatggaggccagtctgaacactcgagtccgtccgaactgatgcgtcgctggctaggtacagagcattacgtacgagtaataattacttatccggtgtgattggttcgtcgcgtcacgccgtcacggtctgtcgccacatatagctatcggacagtagtagtactactgctaaattaatgttaaaataggcctgtgtgaacgggtgtgaacgcatgtgaacggaatcttgggatggggccgatgttcctcttgtttgtatcctgtggatgcggattcattatgcgtgcacgactgacctgctgggcagtgcagttgcagtggta

SEQ ID NO: 2 - DNA, 3292 bp, Hordeum vulgare
atggccgcccggttcgtcgtccccttcctctagatctctccccgccgtctcgctgcccctcctgagctcgccgaactttgcatcacgcagcgcaactccttccagagacgagccacagggggagggatcggagctgtaagcatatatatatatagacacatacggttctcgtcctagatctctctctctgccaagctcctccgggcctccttctgctagatctgctgctgctcgtgctgttgcgtggcaagcaagatatatatacccctctctccatatataggactgctgtactacaccatctttgttggaggggaaggagagagatgcagatgtgtgtgtgaagaaatggaaggcgcgggaagcaggagccgagcgctagggtttcggtgttagctatattggctagcagcaaggtagagagtacgtacgtaccatgatgatcccggcgaggcacatgccgtcgtcgatgatcggccggagcagcggcggcgcgccctacggatcctcatcagcactgtcgctcggccagccaaacctgctggacggcagcaaccagcacctcctgcagcaccacctcctggagcagatcccggtgcgcgcggcggagagcggcgacaacaacatcggcagcggcggcggcggcgtgggcatgatccgcgggcgggagtcgatggacccgctgggggacgagttcgagagccggtccggcagcgagaacgtggacggcgacgccgtggacaacgccgagcaggaccaggaccccaaccagcggccgcgcaagaagcggtatcaccgccacacccagcaccagatccaggagatggaagcgttcttcaaggagtgcccgcaccctgacgacaagcagcgcaaggagctgagccgggagctggggctggagccgctgcaggtcaagttctggttccagaacaagaggacccaaatgaagaaccagcacgagaggcacgagaactcgcagctgagggcggacaacgacaagctgcgggccgagaacatgcgctacaaggaggcgctcagcagcgcgtcatgccccaactgcggcggcccggcggcgctcggcgagatgtcgttcgacgagcaccacctccgcgtcgagaacgcgcgcctgcgcgacgagatcgaccgcatctccgccatcgccgccaagtacgtcggcaagcccatggtgcccttcccggtgctctccagccccctcgccgccgccccgggcgcctccgcctacgacgtcttcgccggggctgcctccgtgctgcaggcgccgcctgacgacaagcagcagggcgtcgtggtcgagctggccgtcgccgccatggaggagctgctccgcatggcgcgcctcgacgacccgctctgggccaccacggtggaccagacgctggcgctggacgaggaggagtatgcaaggatgttcatcgacccacgcggcggccttggacctaagcagtatggcctcgtctctgaggcctcccgcgacgccaccgttgtcatcatgaccccggccagcctcgtcgagatcctcatggacgtcaaccagtacgcggcagtgttctcgagcatcgtgtcaagggcggcaacgctggaggtgctgtccaccggcgtggctgggtgctacgacggcgcgctgcaggtcatgtcggtggagttccaggtgccgtcgccgctggtgccgacaagggagagctacttcgtgcgctactgcaagcgcaacgctgatggagcctgggccgtcgtcgatgtgtcgctggacggcctgcaaggggtcaagtgccggcgcaggccctccggttgcctcatccaggaggcgcccaacggctactccaaggtgacgtgggtggagcatgtggaggtggacgacaggtccgtgcacaacatctacaagccgctggtcggctccggcctggccttcggcgcccgccggtgggtcggcgtcctcggccgccagtgcgagcgcctcgctagcgccatggccagcaacatccccaccagcgacatcggagtgatcacgagctcagaggggaggaagagcatgctgaagctggcggagaggatggtggcaagcttctgcggcggcgtgacggcctctgttgcgcaccaatggacaacactgtcggggagcggcgccgaagacgtcagggtcatgaccaggaagagcgtcgacgacccagggaggccgccgggcatcgtcctcaacgccgctacctccttctggctccctgtcccgcccaagcgcgtctttgacttcctccgtgacgaaacctctcgcagcgagtgggacatcctttccaatggcggcatcgttcaagaaatggctcacatcgccaatggccgtgaccatggcaactgcgtctcactccttcgcgtgaatagcaccaactcgaaccaaagcaacatgctgatcctgcaagagagctgcacggacgcatcaggctcctacgtcatctacgcgccggtggatgtggtggcaatgaacgtggttctcaacggcggcgaccctgattacgtcgcgctcctgccctcgggcttcgccatcctgcccgacggtcctgcagggacaatgcacgccgcggcaggggcaaccggcaccggtgggtcgctcctgacggtggcgttccagatcctggtcgactccgtccccactgccaagctctccctagggtcggtggccaccgtcaacagcctcatcgcctgcaccgtggagcgcatcaagaccgccgtcatctccaatggcggcgcctctcccccgcagtagcttcgttcaattcatcaatcttcctatgttctgtatcagaggagcagcaaaattttggagccttcatcagtgggaagtcaagaacgcacctcagactctccttgccatgtggtgctcatagccatagattgttccctgtgaattcgaccggggaaactccgcgacttcttcgttccatgcaagaaaacatttgccaaaacaagatgcggtcaccactacgcaagggcggttggttcgggtattgacttcatcttcgtgtcggcctctcggatgctgctacctctgagtttcttttctagggttcttcgtcgagtacaaaaaaaccgtaattttcttcagtcagtctgtctgtaattccttcgacttgtcgttgttcatgctgctgtttcagacttccagtgctttgtaggtgcagcagaatagagatttgtgcccatctgtctgtctgttgctttggattgtgggtttataattttgtagcgctcctggtgatccgtcgccatttcaatcccaaaatgtgtg

SEQ ID NO: 3 - DNA, 1326 bp, Hordeum vulgare
gcccggtcgatcgatcgcgggaacacgaacaacacacagatcatcgtcctgcacgttgatgcgtgcaagcgatctggttgctcgagataaagatgaagaacagcagcaatctcgaggccttcctccaggccgccacgccccggctcccatggcgctccgccaccatggaacgattccagggagcgcccagcagcgtgtggcaacacccagaaggcaagaacaaggacgcggtggagtacttcgccctgtccgacctgtgggagcactacgccgagagcagcgcctacgggctcgccgtgcccgtccgggacgccggtgaccgcgccgtggtcaccacccagcacttcgtcccctacctctccgccgtccagctctacaccgccacgaagcccacctcccacaccctcggcgccacctccaggagcacggggagcgagacggattcatggagcgacgacagcgtgggcggcgacaggttcgccggctccggatcctcctcctgggacgcggcgtcggacgaagacgacgcttcctccacctacgacggcaccggctccaccggcgtctcacccaagcagaacgggtacctgaattttcagtacagggaatgggactcgccctacgagagggtgccgctggctcacaaggtggaggagctggcccgggactacccatgcctcatgtcgctcagcagcgccgagctctcgccgtccagttggatgtccgtggcatggtacccaatctatcacatccctgctcatgtcaacctcaagggtacctctgcctgcttcctcacttaccattccatctcatcagtcttccaagacaacatagatagcgggccggagcacgacgacggcgagatggcggcgctatcgccgttcgggctggcgacgtacaagatgcaaggggatttgtggaggaggccagggtcatcggaccccaggaggctgtctgagctccattgggcggcgtcctcctggctgaagcaagtcggcgcgcaccatcctgacttcaccttcttcacgacgtctcaccgtcgatgacacgacaccctgttgattccgcgtgtgtttcggttagattttgcatgtgcaccggacaacgtcaagatatgacaccaagaacttcatgtaggatttgatagaacagcatgcaccggagttttcttctttctgaatttgcaggaagatacagttacttgttgcatcgatcggattaggtgtcagattgcatgctctgtttttcgttcatcgacgggcatgatgtagctgcgacacaccattttcaaagaattgcagctcgtgaaatgcgacctcaaaatca

SEQ ID NO: 4 - DNA, 871 bp, Hordeum vulgare
cggcacgaggcattagttggtgcatcctctctctgcatctcctcttctggttccagcttccttcaacaccttcgtccagaaactctcgcagacatggcgcgcaccatcggcctggccatggactactcgccgtccagcaaggccgcgacgaggtgggtggtcgagaacctggtgaaggccggcgaccggatcatcctcatccacgtcctccccaagggagcagacgccagccacaaggggctctggaagagcaccggttcaccgctgatccctctgctggagttcatggagatgaacgtgcaggcgaggtacggggtcaaccccgacaaggacgtgctggagatcctgcaagctgagtccaagtccaagcaggtggaaatactggcaaaaatatattggggtgatgcaagggagaaactttgtgaggcagtagatgatctcaaggtggactctgttgtgcttggctgcaggggcttagggccgttgaaaagggcactccttggaagcgtcagcaattatgtcgtcaacaatgcaacctgccccgtcacagtggtgcgcggaccaaatggatcacttgcttgaagatgtcacttatggattgatgggctagtttgtgtgttcattggtccgtcagcataggtgcaaatcgtgctatttaagactatagtgatatttttcctttttggattcctggctatccttgtagtgcaaattcagtgtgttttcctcagttatctctttagttatactatatttctgttgtttcttacatgctatttgtaaaaaagaagtgcctacagacttgttcagtggtgcattttcgtttatgtgcatgactaggcaggcctgctaaagctgaatggttactcaa

SEQ ID NO: 5 - DNA, 2194 bp, Hordeum vulgare
ccgcctcctcccgtccagtatccccttctctccctccacccgccgccgccgccgcccacaaaccctagcatcccctcgcccgagacagccatggcggagcacgacctgacggcgagcgtggcggcgtggatggacccccatctggtcctgcccgtgctggagttcctccaggagcgcggggtctacgccgacgaggagatcctgcggggcaagatccgcctcctcggcggcaccaacatggtcgactacgccatggacatccacaagtcgctccacggcaccgacgaagtccccgccgacatggtcgcccgccgctccgaggtcgtcgagcggctcagggccctccaggaggcggtcgcgcccatcgtcgccttcctctccagcccgcagctcgtgcaggagctccacgccgacaagcagtacaacctccacatgctccaggagcgccaccacatcggcccggaccagatcgaggcgctctaccagtacgccaagttccagtatgagtgcgggatgtactccgatgccgctgatttcctgtcccagtaccgtgctctctgcaccaacagcgagaggagcctcagcgccctctggggcaagcttgcggcggagatactgatgcagaactgggatgtcgcgcaggaggagctcaacaggctcaaggagatgattgactccagcagcttcacctcgtcgcctgtcaaccagctccacagcaggatatggctgatgcactggagcctcttcatcttcttcaaccatgagaatggaaggaacgggatcatcgacctcttcttccaggacaggtacctgaatgctatccagaccaacgctccccatcttctgaggtaccttgctgctgcagttgttgtcaataagaggagaaggaacatgcttaaggagctcatcaaggtcatccagcaggagcagaacatctacaaggatcccatcatcgaattcctggagtgcctgtatgtcaagtatgattttgatggcgctcagcagaagctcgtcgagtgtgagcaggttatactgaatgatcctttcctgggcaagcgtgtcgaagagaggaatggcatcgctgttcctctgagagacgagttccttgaaaatgctcgcctgttcatctttgagacttactgccgtatacatcgctgcattgatattggtgtgcttgcggagaagatgaacatgacctatgatgaagctgagttgtggataatgaacatggtcaagagttccaagctagatgccaagattgattcagtgacgggaactctcatcatgacgaccaaccgtgttgatgtccatgagcagattattgagagcatgaagaacctcaacgccaggacctacatgctagcaaagagtgtcgtggatccagggcatgcagcagcacagcaggctgctcggtgagaccaacagatgatctgcagctttgaggcggtaaaaaatattttgggaacttcgttgttaggcagtgacttcgttgctagtatttgaattacattgctacagcttatgctgatgttttaaatgctttgtactccttttactcaagtttattctcaattctcaatctccaaacaccaaccagagcgcagcagcagccggatccttctccccccagctccgatggcccgcacgaagcagacggcgcgcaagtccaccggcggcaaggcgccgaggaagcagctggcgaccaaggctgctcgcaagtcggcgccggcgaccggcggggtcaagaagccgcaccgtttccgtcccggcaccgtcgccctccgcgagatccgcaagtaccagaagagcacggagctgctcatccgcaagctgcccttccagcgcctcgtccgggagatcgcgcaggacttcaagaccgacctccgcttccagtcctccgccgtctctgcgctccaggaggccgccgaggcctacctcgtcggcctcttcgaggacaccaacctctgcgccatccacgccaagcgcgtcaccatcatgcccaaggacatccagctcgcccgccgcatccgcggggagcgcgcctaggtttttggtcgccgctggctagtagcagttcttgtcctgtggtccggatgtgtgtcgggtgcttctgttcgtttgtgttgatatgatacgatgtgtcgtctgatcctttgcgtcgtgatgcttgaatgaaattgcaatggaaaagttc

SEQ ID NO: 6 - DNA, 742 bp, Hordeum vulgare
aagagaaagaagatagaacacagaccaccacctacgtgctcccacgctctaccatcaaacttcaaaaatgtcgggttggttcgggggcaagacgacggacgccaaggccgacgaggccgccaagacggggccgtccgtccaggaccgcgccatcgaggcgaaagaccagaccatcagcttcatcggcgagaaaagcgaggccgtcacgaaggcggcctccgacaccgccgatgcggccatgaagatggggggagacgccatggggaaggtctccgagacggggcaggccatcacggaccgcgccatcgagagcaaagaccagacgttcggcttcatcggcgagaaggccgaggctgccaagaagatggccgtcgacaccggcgacgccgccaagcagaagtccgccgaggccgcgaagtgtgtcgaggagaccgcggcgcagttcaccggggaacccgccgcccccaaggagcccgccggcaacatgttccagcaggctggcgggcaggtgatgggcgccgctacgggcgccagggacgccgtcatgaacacgctcgggatgggaggagacaaagccgacgccggcagcgccaaatgaagaccggagccctcatttcgtttcgttattcgtgttgctttattttccgttccaagaaactgatttctaggcatgcgtcggtgttacttcctccattgtatgcaaagatgctttgaatatacggatttgcaattctcatctgat

SEQ ID NO: 7 - DNA, 475 bp, Hordeum vulgare
caagaaacacacaggaagctcctagccaacaccaatcaaagcctccatccaatcccaaagaaacctcaaagatgtcttgctgcggaggaaactgcggttgtggcagtgcctgcaagtgcggcaacggctgcggcggctgcaacatgtaccccgaggtagaggccgccggcgccaccctcctcgtcgccgtcaccgccacccacaaggcgagctgcggcgcgatggagatggcggcggagaacggcggctgcggctgcacccagtgcaagtgcggcaccagctgcggctgctcctgctgcagctgctagatcatcaatcatggattcactacctgcatcatatctataatctacctatccgtctaccaccatgaaacgctacctgatcaagggtctttgtatgtaagcacctgcctgcatgagcacagcaggtgccatgccatgccatgcatgtaaacccctaaataaaatctctt

SEQ ID NO: 8 - DNA, 1292 bp, Hordeum vulgare
aacccccgctcgcctttccacggcgaaaggcatcccggcggcgatggcggcggccgcggcaaggtccggatcccggcgcttgttctccatatccgccctggtgcctccgaagccgccaacccctcccccgaaggcagaccccttcgccagcctcttcatccccgggttaagcaagcgaacaacaactgatggacttagggaagcttttgcaaagtctggtgaagttgtgcatgcatcatctgtaaaaagttcaaggtggtatatgatcagtgcaaaccgttcaggtcctttgacagtgcgtaaagaataccgcaaagtgcttccttctttcataaggccatctgcatcttactccacaaaagcctcagaaaaaagaccaaaacaggagagaacagacttgacgactgttgaagatccctttaatgcccctacctacaatatacctgagaagccagtgacatttgtcgagggggcctcttacagtgttgtaatactcgcggggcttggagttgcagcattagctggatatgctgttttcaaggagcttatctttgaaccaaaagagtacaagatttttgggaaagctctagcaagagttcagagtgatagtcaggttacagccaaaattggttaccctataactggttatggtacggaatccagaaaccgtgcagctcggcagcgcatccaaaacagggtttggacagatgaggatggtgttgaacatgtggaggttgcctttcatatccgggggccacatggagctggaaaggtgtttgcagagatgttcaaagataacgccgacaggacatggaagttcacgtttcttctcgtcgagattacgtcaccgcgacccgcacaaatcatgttagaatcttacctaccagcataaggatgcaagagacaacatcagctagcagtggcacatccattcggcaacttctttttacgtcatatatctccaatggctgcatctcatgttaaatacccgtcctcgggttaaagaagttgtgaattttgaacttccccgaaagcataagtaggaggaagatgaaccatcagagctgctgaccatgtctagcatcttagatatgctgttgctttgtttagctgaaaggcgtgcaggcacatgtatacaacccatctttccctcaaacatgggacggaggagggagtgatccttcatctatcgagttttagtcccatttcaggcagtttttttaatgatgcctatggatttcgtgcaaaccttcatttttgatatccaaatagcaataatatctggttacact

SEQ ID NO: 9 - DNA, 1958 bp, Hordeum vulgare
gccgtccacccccccttgcacctccttcctcacctcactaggtggtgagagcgagaggcggcacacaccagccctgctttctttgaccgggctgctcccttccctttccctccgccgtcagtccactccaccgtctcctccccgcctcccgcctttgagggcaccgcgaacgcgcgcgcgtgcgcctctcatcgccatcctctccccccctttccccctcgcttcccttcctctccttcctgcccggatcggacccacggccccgaggactcgtgctgccgctcctgctcctgctgccggggcctccctcccctcgtcgccggccgccggctttgtcgaccaaccgcgccgcgccgcacccgagcggcggcgatgaggtgcctgccgttcctgcacggggacgccaaggcgggggacgacgacgaccagcgcacggggcccagcaccgccgccatgtcggcctccgtgcgctccttcagcaccaccacctccacggagcgcgacaacccgcgctccggctccgacctcaactccatcaacgtctccgacatgagcgccgagtccatacgccggacgcagtaccccagcttcaccgaccgccctgccaacctccgggtcttctcattctccgagctcaaggccgccacccgcaacttcagccgctccctcatggtcggcgagggcggcttcggctgcgtctacagaggggtcatcaagggctccgacgaccccacccagcgtgtcgagatcgccgtcaagcagctcaatcgcaagggggttcaggggcagaaggaatggttaacagaaatgaacgtgcttgggattgttgagcacccaaaccttgtcaaactaataggttactgtgcggacgacgatgagcgagggatgcagcggcttctggtatacgaatacatgcccaacggaagcgtggatgaccacttggcaagtaggtcaacttcaactctgtcatggccaatgagattgaaagtggctctcgatgctgcccgcgggctcaagtatctgcacgaagagatggactttcaggttattttccgggacttgaaaacatctaacattctattagatgagaactggaatgcaaaattatcggacttcggattggctaggcatggaccacaggaagggctatcccatgtctccacagcggttgttggaactctaggatacgccgcgccggagtacatgcaaaccggacgcctgactgcaaaaagcgacatatggggctatggtgtgctcctctacgagctcatcaccggccggcgtcccattgacaggaaccgcccaaagagcgagcagaagctcctggactgggtgaaaccgtacatctccgatgtcaaacggttccccatcatcgtcgacccgcggctcgagggccactacaacctcaagtccatgacaaagctggccggtgtggcgaaccgctgcctcctccggatgcccaagtcgcgcccaaagatgagcgaggtgtatgagatggtgcagaagatcgtcgacagcgtcgagatcggcccgccggagcctcccctgcactaccacggctcggtctccgggccgggcgcgaagcggaccaagaaagggtcattgaagaggaggctccaggagttcaagttcgggtgccgccagatcgtgtggcggggctggaaaccagagatcataaagacctgctgaaatggatgccaccaccctcctgcctgtgactgtaagtatggctagctgttcatagagatatgaagttcgtaaccggtgcacggtttgcgctgcagcgtgtaacttttttggtcctgtagatttctgtttaaacagtcttttgtttgtgtattaccctggtctgagctgcaagattgtgaatcagtaggttgcttgtgattttggtccagtttcagctcttccatcttgtgcacgctactaatctagtttgtgcacaacttaaaactttc

SEQ ID NO: 10 - DNA, 808 bp, Hordeum vulgare
ttcccctggaaccgatgaaaaaaagtggatcgttcctacgcactcgcccagaatgattcttccctatccatagttcatggcctattagaagtagaaggtgctctggtgcaatccttaccgacagaaaaagattgcagtcaggttgataatagtcgagtgcacattacttcgtcggtccgaactaaggaatctgttataaatgttttgaaatggatattgttctctctttgatcagggattgctatatgaaaagaagtggagtttgaaaaagggaacggaatgctcaaaccggaactgctagaggaacgaattttcaatagcataacttgggctcctagaatatggcgcccttgggacaatctatttgattgcagggttttgttccgaagcaaagatatccgcggaggccggttcgttcgtcctattctgatattcaggaccaagaggtactggattctctttcggataggccctgaaaggagaagaaaggctgaaatgccaacggacctctgtctattctctaattcacccgatccgatagtacccgtttttggaacgtccagtgccaaagtcactgaatgggtaagtcaccaatccaatccctttgacaaatcggatgtcatattagatatcatattctatatatatagaaatatcatagatagaatagacatatagaatttttggtcggcaaattcgaaggaatcattgagtgaaaaaggagcaaagaatgacaaaagacgagactctactagtcttcactcttgtggtttcctcttcctcggtttctgttttcttattcgggatc

SEQ ID NO: 11 - DNA, 2268 bp, Hordeum vulgare
gcgctgcgtgcgcccgccgctgcgccgcgtgccagagtgggactgggcgtgcccgtaccgcaaggccgagcatgaggggagggcgatggacaggcccaagccgccggtcgggaagaagatcaagaggacagccaaagagaagcttctcgccagcgatttatgggctgcgcgcattgaaagtttacggagggagccagatggagcattctgggcaaaggtgaggtggtacactattcctgaagagactgcagcaggaaggcagccacacaatttgcggagagagctgtatcgtaccaatgatgttggagacattgagatggaaactatccttagacattgttttgtcatgagccccaaagagtttagggatgccgctaatgacggagatgatgtattttattgcgaatatgagtatgatatacattggcataattttaagcgtctggcagatattgatgatgaacctgagacaaaagaagatcccagtgacgagccttacaatgctgctgatgattataacagtgataccgatgtagattcagaatacgatgaggaggatgaaccggctgcacgttgctcagccagaaagaaccaatctaatgagaaaattttgcctgctaattcatggaaagggaggatatatggcctgcaaaagattggaatccgtaaaatacctgagcatgttcggtgtcatcaaaagactgctctggagaaggcgaaagctaccttgttattggctactcttcccaagtcattgccttgcagggataaagaaatggaggagatctcgacatttgtgaaggatgcaatttgcaatgaccattgtctaggacgctgcctttatattcatggtgtgcctggtactggcaagactatgagtgtacttgcagtcatgaggaggttgagatctgaatttgattctggagctctgaggccctattgttttatagaaatcaatggtctcaaattagcttctccagagaatatctacaaggttatatatgaacagttgagtgggcatagggtgggatggaaaaaagctcttcattatttgacacagcacttttcagatggcaagaaaattggaaagcaagcaaaccagccaattgttttgctcatcgacgagcttgatctccttttgacaagaaatcagtcggtgctgtataacattcttgattggccgaccaagccaaattcaaacctagttattataggtatagcaaacacaatggatcttccagaaaaactattgccgcgtatctcaagtaggatgggtattcagcggctgtgttttggcccctataattatcggcaactgcaggaaatcataacaagccgtcttaagggtatcaatgcctttgaagatcaagctattgagtttgcttctagaaaggtagctgctatgtctggcgatgctaggcgggccttagaaatttgtagacgcgcagcagagtttgcagactaccgtgttaaacaatttcaacaggttgaacagactccctcttctgcaaatataggaaatggttttgtttgcatgggtgacatagaagacgctattcaagaagtctttcaggcaccacatattcaagtaatgaagaattgtccaaaatttgggaaagttatactggctgctatggtccacgaactatacaggagtggcctaggtgaagtattgtttgataagctggcagcgactgttttctcttggtgccacgtcaacagagaaatattgcccggatacgatactctcctgaaaatctgttgcaagcttggtgagagcaagatcgttctctgtgaggaaggcaccaagcataagttgcagaagctgcagcttaattacccaagcgacgatgtgacctttgccctcaaggagtccccagatcttccttggctgtccaagtacctctaaatctcatacctgcagcggctaaatttcccagcactccattgcatttctgcttctcttggggagcagcagccctgcctacatgtataaaacttagaaaagaaaaccctgcaccgattgcatatcggttgccatgtaaaccaagaactcagccgtacatcggctttctatagttgccatctcagaaaaaaaaaggagtctcagttgtgcgtcggatttgtaagatgtgaaaaaacttgtacttcttttttcaccacatttgtggaacttgtgtgggaccgtgttgtaatgttgtcgcgctctcatttgagctagtactgttacctttaacatgacttatctataacactaaattgttattt

SEQ ID NO: 12 - DNA, 1332 bp, Hordeum vulgare
cacccgccgcccgcccgcccgcccgccatgtcgtccgccgcgccggcgccggcgccggaagagcagccgccgcgcccggtgcgcttcggcatcatgggctgcgcatccatcgcgcgcaagctcgcgcgggcgatgctgctggccgcgcccgccgccgccgtggccgcggtcggcagccgctcggaggccaaggcgcggctcttcgccgccgacaacggcctccccgcggacactcgtcttcacggctcctacgaggcgctcctcgacgacccggccgtcgacgccgtctacctgccgctccccaccagcctccacgtgcagtgggccaccgccgccgccgcgcggggcaagcacgtgctcctcgagaagcccaccgcgctctgcgccgccgacctcgacgccatcctcgccgcctgcgacgccagcggcgtccagttcatggactccaccatgtggatgcaccacccccgcaccgccaagatgcgcgacctcctccccgccgacgtcggcgacgtcagactcataaacagtctgttcagcttccgagcaaacgaagatttcctccagaatgacatcagggtaaagccagacctcgacgccctgggcgcactcggcgatgccgggtggtactgcatccgcgcgatcctgtgggccgtcgactacgagctcccgaagaacgtgatcgcgctccctgaccccgtcaagaaccaagctggcgtgctcatcgcctgtggggcgacgctctactgggccgacgggaagatggccaccttccactgctctttcctcaccaacctcaccatggacctgaccgtggtcggcacggacggcacgctccacgtcaccgacttcgtgatcccgtacgaggagaagtccggcccgttcagcgtggcgtccaaatcaaactttgccgagctccacaccggatgggctccgcagccgagcaagcacgttgtcatgacagacctgccgcaggaggccctgatggtcaaggagttctgcaggctggtgcagggcatcagagacgccggcgccaagcctgagaacaagtggccggccatcaccaggaagacgcaggttgtgatggacgccgtgaaggcttccattgacaatggattcaaatcggtcgacgtcgccagctgaataaaacacatcaccggtcattccggtattatgttcttccagaacatggcgtaatttgctcagactgtacttctacgcggcatgaaactacttatatatcggaataactcaaatgattctcgtcgtgccaaggacggcattgcggttatcaagttaaaaatatcggcattgcaattgtcaagttacaaa

SEQ ID NO: 13 - DNA, 989 bp, Hordeum vulgare
cttcgactcccgtcgccgccggttctcctccttcgaccccggccgccgccacggaagccagggttggccgaggtctgtctgagccacggtatccgcactgcatctcagctgctgaccaagaaccccatcccgccccaaatcccagcggaagatgcaggccaagaagctgacgctgctgcagacggtggctgccgcgggagtcttctcagccgtctcctgctggtacggcttcatgttcgggagggagtctgcgcggcgcgagctcggtggcatcatcgacgacctccgcagcggctccacgacaggctctgccgcgtcctcctccgactcccacgctcaccccaaaccatagtgtgatcctgctctacagtgtcaagaccaagaatgtccatcataaatgacgaggtgggtattagaagagttaccaagcagttctggtaaaaaagaaacattttcagatgaagatctaagcaattagtagacttatgtttagcaggtttccttttgtgcttttcttacgcaaacaaattatgctacagtatgattgggtcatcaatacctttccttccactgtataacaatggtgtaacattcgttctccagcggccgctggacgttcggaggatggtcgagcaggaggaatgaatgattccaacgcagcgatggttcccgtgacaatacttgcctttcaccgcggtaatgttttatttaacaagataagaagcggaatggagaaaacaagatcgagactgagctatatatgtccagttttgtataatcattcatcgtgcacggacgcctagggctcttgcagaaaggaaggctatcacctgttggggtcctccctaggatttggagcattgttcgcggtggctgcattcttgtgaatgatgcccttgatgtatctactattttcagttttggggatcgaaaggctttccattattagtcatcatgtagcaataaaatatccagtcaatgaccttgca

SEQ ID NO: 14 - DNA, 1746 bp, Brachypodium distachyon
tccacagtctccggggagaccgagcgagctcaggaacaacacactcttcgacacgctcgctctcgctctcccccccggcccctgctgcccgcccccgtagacagccggcggatctaagcaaatggatttcaaggggttctgggagtccagattcgggggaaagaaggaggcggagcagaatgggcacgccaacggggaggccaacgggagcgtcaagaagaggaccgccgatttggccatctacgagcagttcgagcagcaggccaggcagccggagatgcgcgccgcggcgatccgtgatgggaatgctgatgtcatccagaagcctctcctaccttcatttgagtcagctgaaatgcgtaatctagcagagacactgttgcgggatattattcgagggaatccggatgtgaaatgggaaagtattaaaggactagagaatgcaaaacgacttctaaaagaggcagttgtcatgcccataaagtacccaaaatacttcactggtcttctgtcaccgtggaaagggatcttactctttggccccccaggaacagggaagacaatgctggcaaaagcagtcgctactgagtgcaacactacattcttcaacatttcagcttcatcaattgtcagcaaatggcgtggagattctgagaagttagtcaaagttctttttgagcttgccagacaccatgctccatccacgatatttcttgatgaaattgatgctattattagtcaacgcggcgaagctcgtagtgagcatgaagctagtcgacgcttgaagactgagctacttattcagatggatggcttgacaaagacaaatgacttagtatttgtacttgcggcaacaaatctaccatgggaactggatgcagctatgctccgtcgacttgagaagcggattcttgtgccgcttcctgaagctgaagcaaggcatgccatgtttgaggaacttttgccggcgatgacctcaaatctagaggtcccatacgatcttttagtagaaaagactgaagggtactccggttcagatattcgtcttgtgtgcaaagaagctgctatgcagccattaagacgtatcatgtcagttcttgaagccagtgatgagttggtgccagaggaagaactacctgaggttggccctctcagacctgatgacgttgaacttgctttgaggaatacaagaccatcagctcatctccaagcacaccgttacgaaaagtttaaccaggactatgggagccaaattcttcgttgagagcaagttcaggtcatgtttacatgaaaatctgcctggcgaaacatgtgctttacaggaaacaactgagaattttcatcttcgaagaatgtagaagattttttccctttatttctgtaggtttgcaagtggattcatctggatggtgcatttgaacatgctactggaacagagatatcttgacccagaacaatcaagttggctgtgtttatgccttttttttttatcattctaccgagaaggcccccaagcagaatgcaaacattgttactgcagtttatatcaagtttatatctgtaactacattaaattgactgaaggtgtgaagcaagtcaccacgcatggtgatgttgctgctgtagctcttggccagattgaatactaccaccttgtaatgatcgtcctcacaaataagactgattcactgactaggatcttcataataaattctgggcatattggatggaacattacagagccat

SEQ ID NO: 15 - DNA, 895 bp, Brachypodium distachyon
gtctgggcggtatcagctcatccattcatttctcatccctagaggttaatccggtgcacttcattcaccggctccagtatggctatggcaatctactaccaggtcccaactcaagtctgaaccttcatcctgcctcctccagcaggacgaaagaatggcagctgcaaccgcaaggcagctgctggtccacaggatcctttgctcctgctcttcagggacgcttccaaagcgcaccttcaacagccatggcagctctgcttcgagctgcttcaaagcaggaaagaccgagaagctccccgccagtttcaggttaagggtggccctgaatcctccgcgtgccgtgctggggaagggcggcattgtgcctgacgacggggtcagcctcggcaccgtcaagctgcctgccaacatcgatttggctcggttcgaggccttgctatttcagtggggaaacagcctgtgccaaggcgcaaccttgccactaccggtgcctctcaaggtggacaaagtcgacggtgggatcaggttagcatttgttgaaatcgacgacggcgcggtgcagctgctggcctacatcgattgcctggtgtctccagcgaccgatggctccgggtttgtgttccgggcgatcaggaacggtcccatgaaggacatggaaccacctggggaaccgaggatcatgagaagcctccttgaggcgcttcaaaaatctattcaaattgctcgagtttgacaagtttgctcaacttcctccaagttgacaaacctgttcaagttgcacaagtttgacagtcaagaagatgatgcagcagggttaacatacgctattgttacttgtaattcctgtttttcaagttctttcatgtcctctcacaaaatgaagatataaattcca

SEQ ID NO: 16 - DNA, 6276 bp, Brachypodium distachyon
cccgttacacctcctacccccacacttcactccattccttcctgctgccaccacctactagcagcctagcgctcctgccatccgccgcctcgattcgccgccggccgggtctagggtttcccagccaggcaccagcggaccaggggcgggggggtttgatttggaggcggggcggtgaggatggcggcgcctgggaggagggcggacttctcctcctcgtcggcgcagtcgcccgggccctcgccggcgggggcgtcgggcgggggcggaggagggaggaggctgctcaggacgcagacggtggggggaaacatgggggagtccatctttgacagcgaggtggtcccgtcctcgctcgtcgagatcgcgcccatcctccgtgtcgccaacgaggtcgaggccggcaacccgcgcgtcgcctacctctgtcgtttctacgctttcgagaaggctcaccggctcgaccccaactccagcggccgtggtgtccgccagttcaagaccgcgctcctccagaggctcgaaagggagaacgatcccacattgaaggggagggtgcaccagagcgatgcgcgagagatgcagcgcttctaccgcgagtactacaagaagtacatccacgctcttcagagtgccgccgacaaggctgaccgcgctctgctcacgaaagcgtatcagactgcagctgtcttgttcgaggtcttgaaagcggtcaatgtgtcgcagtctgttgaagtcgatcaagcgattctggacacacacaacaagattgaggagaagaaaaagctctatgttccttacaatattctgccactcgatcctgaaagtacagatgaagctattatgcaatatccagagattcgagcttctgtttacgctctccggaatactagaggccttccatggcccaaggagaacgaaaagaagcctgacgagaagaagactgataaagatcttcttgattggcttcaggcaatgtttgggtttcagaaagataatgtatccaatcaaagggaacatctgatactgttacttgcaaatgtacatataaggcagataccaaagcctgaccaacaatctaagttggatgaccgggcactggatgctgtaatgaagaggctgtttaagaattataagatgtggtgcaagtacctcggccgcaaaagcagtttatggttgccaactatccaacaggaagtacagcagcgcaagcttctctatatgggtctctaccttctaatttggggtgaggcggctaacttgagattcatgccagagtgtctttgctacatctaccatcatatggcttttgaactctatggcatgttggctggaaatgtgagcccaatgactggtgaaaatgttaaaccagcttatggtggtgatgaagaagcattcttgatgaaaattgtgactcctatatacaaagttatagaggaggaagctcacaggagcaagactatgaaatcaaaacactcacactggaggaactatgatgatctaaatgagtacttctggaaagttgactgttttcggctaggatggcccatgagagctgatgcagattttttcaaaacacccaaattggcttatcctaatcgtctgaatggagaggaaagatctgctggcagtgtccattggatgggaaagattaattttgttgagatacgttcattttggcacatattccgtagcttcgatagaatgtggatcttcttgatactatccttgcaggctatggttattattgcttggaatggtggcacaccgagtgatatctttgatagtggagtacttcagcaggttttgagcatatttataactgctgctgttttgaagttgggtcaagcaaccctggacattgtatttggctggaaagcaagaacaaacatgtcatttgcaagaaaactgagatacgtcttgaagttagtgtcagctgctgcttgggttgtgattttacctgtgacttatgcatatacctggacgaaccctacgggtcttgcaagaacaatcaaagattggcttggcaatggtcatcagccatcattgtacattttggctgtggttgtatatttggcaccaaacatgctcgcgtctgggttatttcttttcccgtgtatccgaaggtatctcgagagttcaaattttaaggtcataacattcatgatgtggtggtctcagcctcgagtatttgttggcagaggaatgcatgaaggcccattttccctcttcaagtataccatgttctgggttctccttttagcaatgaaattgacagtgagcttctatattgagatcaagcctctggtacaaccaactaaagatataatgggaacaccaattcggacattccagtggcatgagtttttccctcatgcaaataataacattggtgttgtcattgcactttgggctccaataattcttgtctatttcatggacacccaaatttggtatgcagttttttctacgttggttggtggtatctatggggcttgtcgtcggcttggtgagatacggacattaggaatgttgagatatcgctttgaatctttgcctgatgccttcaataaatggttgattccttctgatgcacacaagaggaaaggtttccgtgctgccttttccactaaaccttcgaagtcacctagtgatgaacaagagatagagaaaagagctgcaagatttgctcaaatgtggaacctaattatcacaagttttcgtgaagaagacctcatagataacagagagatggacttgctacttgttccatactgcaaagatcgtgaattgaatatattccaatggccacctttcctacttgctagcaagattccaatagcgctggatatggcagctgacagtggaggaaaagatcgcgatctgaacaagagaatggggtcggatccttatttttcctatgctatcagagaatgctatgcttccttcaaaaacatcataaataccttagtgtctggacaacgtgagaaagttgttatgcaagagatttttacagttgttgagaaacatataaacgagggaactctgataaaggatttgcacatgagaaatcttccagccttgagcaagaagctcattgaactacttgagttactgcaaacaaataaggaagaagacaagggtcaagtcgttattttgttccaagatatgcttgaggtggtcacaagggatataatggaggatcaagagctcggcggagtactggattcaatacacggtggaaattctagaaaacacgaaggaatgacaccgcttgatcagcaagatcaattgtttactaaagctattaagttccccgtggtggaatcaaatgcatggactgaaaagataaagaggcttcagcttctgctcactgtgaaagagtctgctatggatgtccctacgaacctcgatgctagaaggagaatttctttctttgcaaattctcttttcatggagatgccaaatgctccagaagtgcggaatatgttgcccttctcggttttgactccttattacaaggaagatgttttgttttcattgcataatctagaagagccaaatgaggatggagtttccatacttttctacctgcaaaaaatttacccagatgagtggaaaaatttcctcgaaagggtggatcgcaagactgaggaggaggtccgcgaggatgaaacattggaagacgagcttcgtctttgggcatcatataggggacaaacattgacaagaactgtaagagggatgatgtactaccggaaagctttggagcttcagggttttcttgatatggccaaagatgatgatcttatgaaaggctaccgagcaactgagctgatgtctgaggagtctccactaatgacacaatgcaaagcgatagctgacatgaagtttacttatgttgtctcatgccagcagtacggtatccaaaaacgttctaatgatccttgtgcgcatgacattttgagactaatgacaacatatccatctttgcgggttgcctacattgatgaagttgaagcacctagccaagacagaatcaaaaagattgacaaagtttactactcagttttagtgaaggcttctgttacgaaacccaatgatcctggacagagtcttgatcaggtcatctacaagataaaacttcccggaaatgctattctaggtgaaggaaagccagaaaatcagaaccacgcaataattttcactcgaggagaatgtctccaaactatagatatgaatcaggagcattatatggaggaggctttgaaaatgagaaatctattgcaagagtttctggagaaacatgatggtgtgagatatccatcgatacttggagtaagagagcatatatttactggcagtgtttcatcccttgcatggttcatgtcaaatcaggagaccagttttgtcactattggacagcgtgtgctggccaatccattgagggttcggttccactatggtcatcctgatatatttgatcgtcttttccaccttacaaggggtggtataagtaaagcatctaagattatcaatcttagtgaggacatatttgcaggattcaattctacattacgtggaggcaatgtcacccatcatgaatacatgcaagttggcaaaggaagagatgtgggtcttaatcaaatttcactatttgaggcaaagatagcaaatggtaatggtgaacagactctgagccgtgacatatatcgattggggcaccgttttgattttttcagaatgttgtcatgttactatacaacaattgggttctatttcagtacaatgattacagtttggactgtgtatgttttcctttatgggcgtttgtatcttgtcctcagtggacttgacgaagcacttgctactggaaagaggtttgtgcataattcgcctctccaagttgctcttgcatcagagtcttttgttcaacttggatttttgatggcattgcccatgatgatggaaattggtctagagagaggattcagaacggcattaagtgattttgtacttatgcaacttcagttggcatctgttttctttacattttcacttgggaccaaaactcactattatggaaggacgctactccatggaggagctgaatatagagcaactggacgtggatttgtggtgttccatgccaaattcgctgagaactaccgactctattctcgcagccattttgtgaagggtattgagctgatgattctgctcgttgtatatgaaatctttggacagtcgtacagaggagctatcacttacattttcatcactgtttccatgtggtttatggtgggcacgtggctctttgcaccgttcttgttcaatccttctggatttgagtggcagaagattgtggatgactggactgattggaataagtggatccataaccgtggaggtattggtgtggcaccagagaagagctgggaatcatggtgggacaaagagcagggccctcttcggcactctgggaagcgtggcactgttgttgaaatactgcttgcattacgcttctttatctaccaatatgggcttgtgtatcatttgaatataaccaaacagtataacaaaagtgtgctggtttatggcatctcatgggttgtgattttctccatgttgcttgttatgaagaccgtgtcagtcggcaggaggagattcagcgcggagttccagctcgtcttccggttgatgaagggcctcatattcatatcattcatctccacaatcgtaatcttaatagcactcgctcacatgacagttcttgacatcttcgtctgcatcctggctttcatgccaacaggatggggtttgcttctgattgcccaagcgatcaaacctgttgttgagatggtcgggctctggggatcagtgaaggccctcgcacggggctatgagatcctgatggggctcctcctgttcacacccattgcattcctcgcatggttcccgttcgtctccgagttccaaaccaggatgctcttcaaccaggccttcagcagaggtctgcagatctcccgtatccttggtggccacaagaaggaccgagccacccggaacaaggagtagattcattggtcccctgccgactctgaatctgatgttaacagattcgtagactgggaggttgtatgatagactagttagtattctccattgtaggtgtagattgagaaccattgcgccctccctttgtgtgtaaagcactactgctccgtagcaaggtggatgaaccctatgcagtaatgtttaaagtgttctgcgaag

SEQ ID NO: 17 - DNA, 1694 bp, Brachypodium distachyon
accccaatcctccttttgcctttcccaccactgcccccgtccctcctccataaatggaagcgctcgctatcggatccgtgccttcccggccaggcctaccacctccgacccgccactcccatcttcggcgccccaaaaccctactcgcctccgcgcccccttgccgcatcatcgccgccgttcccatggacggcgccgccagccggagccccgcgcctctccgctgcactcccgccgagacggatgctgtggcgacgagctcggacgagacggcggccacggctgaagccacccagcagggcgacggaatcccagtggaagatgccgccgcaagcatcgagggggtcgacgggataaagattcggaggcgcccggtgacggggccgtcggtgcactacgttggcccgtttcagttccgcctcgagaacgaggggaacacgcctcgcaacatcctcgagaagattgtgtggaataaggacgttgaggtttggcagatgaaggagagaaggcccttgtacatgctgaaaggtccgctggacaatgcgcctccagcgagggactttgtagcggccctgaaagcatcatatgatcggactgctctgcctgctctgattgcagaggtcaagaaggcttcaccaagccggggggttctgagggagaattttgatccggtcgtgatcgctcaaacatacgagataaatggagcagcatgcttaagtgttcttacagatgcaaaatacttccagggaagttttgacaacttggaggctatacgcaatgctggagtacagtgtcctcttctgtgtaaagagttcatcattgatgcctggcaactttactatgcacgttccaagggagcagatgctgttcttctgattgctgctgtcttaccagatcgtgatatcaagtatatgctgaaaatatgtaaaatacttggcatggctgctttagttgaggtgcatgatgaaagggaaatggaccgtgttctagggatagatggtattcagctcatcggcatcaataaccgtaatcttgagacttttgaagttgatatctcgaataccaaaaatcttctggagggtgaacgaggacaacttatagcccagaagggaataattgttgtaggggaatctggactgttcacacctgaccatatttcatttgttcagaatgctggggtcaaagcagttctcgttggggagtccctcatcaagcaggaggatccagggaaagcaatagctgggctttttggtaaagatatctcacatgcgagtgctgtgtaaataacgaaatgccggatcgctcatattttgtataggaaaatggagcgtttcactttttttggagagtttcggccggcaattttgtttacttggccattatctgccttcttctttcgctgccttttcttgcaccttttttttttaaaacaaactagtaatacagtacaagagatgcaacacaaaagatgtgatccaataagttggatgtagcttttaggagctcgagttcatttaccttcatagatctgctcttggcacttgttagccagaatactattgttatactttgtactctgtattagctttgtatttccttcccacgatctccactcggtttccctcagcagttattctataactcatatatatgtactctgcacacgatcagtcaatcaacaacgattctgtatc

SEQ ID NO: 18 - DNA, 2546 bp, Brachypodium distachyon
acacgtctccatgactcgatctcctctcgtctcatctccctcgtcctgttcccgtcggtaggttgctctcccgttcggtacacccgcgcacgagttccctcctctccccgcatctagcgggaagcagcaaagcagcagctcgctcgcgcgcgcttgagcccaccccagcccacgcgcaaggcatggccgcagcggcgtcgcacaagcccctggccgcgatcaccgccgacgacctcgccgcggcgggggccgcggaggccgccgcgctccactcggcggtaagtcgagcgctcggtgccaaaggcagcggcgggcccgccgcggtgtgggcggagctctcgcgggccgcgctccgcccggacgtcccgttcgccgtccaccggatgctctactacggctgctacgccgggttcccgtcccccgcaccgcccgcctggatgcccgaccccgaggaggcggccctgaccaatgttggccgcgtcctggaggcgcgggggagggagctcatcggcgaagcgtacaaggacccgatcactagcttccgtgacttccacaaattctccaacgagaaccccgaggcatattggaagatgatctttgaagagatgggtattacattcagcgtggagccatcttgtatcttgcgtgacaacgatgcgtacccaggtggcgaatggttgccgggggctgtgctgaatgcggctgcaaattgcctgaatgctaaacctggaaggcgttccagcgatgttgccattgtgtggagggatgaggggaaggattccgagcccctcaacgttgtgactcttgaggaattgaggaaaaaagtctgccttgtggcaaatgcgctcgattcactggatctgacaaagggatctgctattgcaattgacatgcctatgaatgtgaatgccgttattatctaccttgcgatcgtgttagcaggctatgttgttgtctctattgcagacagctttgctgcacctgcaatatcgacgaggctaaagatatcggaagcaaaagcaattttcacccaggattgtatccttcgtgatgacaaggaactgccattgtatagtagagttctggaggccaaggcccctatggctattgtgatccctgcaaggggatccacaccgataaaaggactccgtactgatgacctttcatggcaagatttccttggaagggctgatcgtaccaaggctgatatttataccacagttgagcaacctgtctatgaatttagcaatatactattttcatcagggaccacaggggagccaaaggcgattccatggacacatttgacccctcttaaggcagctgctgatggatggtgtcacatggatattcggaaaggtgatgttgttgcttggcctacaaaccttggttggatgatgggtccctggcttgtctatgcttcgctactgaatggagcttccatggcactgtataatggttccccgaatagttcaggttttgcgaagtttgtacaggatgctaaggtgacaatgcttggagtggtacccagcattgttcgtacgtggaaaaatacagattgtactgcaggatttgattggtcaaccatcagatgctttagctcaactggggaggcatctagtgtggatgattatttgtggctgatgggaagagcttgttacaagccggtaattgagtactgtggtggcacagaaattggtggcggatttattactggatgcctgctgcaacctcaagcattgtctgcattcagtacacctgccatgggttgtaacctgtttattcttgacagtaacgggaaacccttaccacaggattctgctggcattggagaacttgcgcttgatccaacattatttggatcatcaacgatgctgctaaatgctgatcatcatgaggtgtacttcagcgggatgccagaatggaatgcgaaagtcctccggaggcatggggatgaatttgagcgtactgcagacggatattatagggctcatggacgtgcagatgacacaatgaaccttggtggtattaaggttagttccatcgaaattgagaggatctgcaacagggtgaatgatgacattctggaaacagcagctattggggttccacctgtagggggtggccccgaacaattaaccatagccgttgtattcaaagaccaaagaccacaagctgaagatttgaatcaactgaaactaatgttcaactctgctctgaagaaattgaaccctcttttcaaggtttcatcagtcatcgtggtgtcatcacttcctcgaaccgcctcgaataaggtcatgaggagagtcctacgaaaagagctcaccctggcaaaacattctaaaatctagatagttaggaagaattttccgcaccttttaaagtttcacggagttaccaatttaactgtgaatatatacacatacgagctcatgtctttcaaacttcggttgtattattacacgtccaatgtacagcatggatagtttactttgatctttgatgtgacatggaagatgaggtactaataaagcatggttacttcc

SEQ ID NO: 19 - DNA, 685 bp, Setaria italica
ggacttgttcttgttcattcacgaggcgcagagagattcttcgatcccactccaatcccattgcggagcaagaggagattcgatcggttgttgcttcgcctcgtgttcggttggagatttgattgtctcttctgctgcaatggctgccgctgctccgtctctggcgccggccccgtcccctgccccggcggcgaaggtcgcatcgcccaaggccggcgacaggaaggtggtgccggtgacggcggccgacgtggtggaactggcggagaagcacgtgctggcggtcgacgacagctccgtcgaccgggccgtcatcgccaagatcctccgcagctccaaatacagagtgaccactgttgaatcggcgacgagggcgctggagctgctcgcgctcggcttgctgcccgacgtgaacatgatcatcacggactactggatgcccgggatgaccgggtacgagctcctcaagcacgtcaaggagtcgtccaagctcaaggagatcccggtggtgatcatgtcgtcggagaacgtgcccaaccggatcacccggtgcctggaggagggcgccgaggacttcctcctcaagcccgtccgcccctccgacgtgtcccggctctgcagccggatcagataatcgcccggcatctgcagggactgattactcttagggaagaaaccatttttt

SEQ ID NO: 20 - DNA, 1049 bp, Setaria italica
aaatcgcatcccttccttgcaaataaaatccccaacgctaccagattaagcccggccggctggcactcccctcgattcgccgctacctgcgtcgtacggcagatccatcacccttccatggtgaccacggcggcggcgcccgacggagacgtcgaccagcggcagcagatcctgccggcggaagccagcaaaaagaagggccgccgcggccgacgcgagatgcgccggatcgaggacaccaccagccgccaggtcaccttctccaagcgccggagcggcctcctcaagaaggcgtacgagctctccgtcctgtgcgacgccgaggtcgcgctcatcgtcttctccccgcgcggccgcctctaccagttcgcctccgccaccgacttgcagaatacaattgatcgctacctgaaccacaccaagggcacacctacaaatgaaaaagttcacgaaccaggtgtagagaagtggaaatatgaggttacaacgttgggacagaagatagacgcaattgaggcatacaggaggaagctgcttggggagagccttggatcttgttcaattcaggagctacaggaactggagttgcagttggagaagagcctaagcagcatcaggcaaaggaagcaaaagaagctgatggatcagattttggagttgagggagaaggagcagaaactctcgaaggagaatgcgatgctccgcgatcagtgtaaagccctgcctctgctggagctgaatgataagggccgtgtggatgctgctgctggtggcggcgaagaagaagaggatgatgtgcgcatggaggacgtggagacggagttggccatcggaatcggaaggagacggccgagtaatactagtgttggcgacgatgcatgagagctagcgcatgatgatgactagcaatcaatcaactgatcgatgatgatgtatttatatatgcatgtatgcccccgtgctcttggattaagatatacatacgtgttgataaagaagaggacacggtctctggtcgatgaataacatattttgcatgctggggatgc

SEQ ID NO: 21 - DNA, 1111 bp, Setaria italica
cacgccctctcttctcgcgccggcgccgcacttgccgtctctcctcgtctgatctgcccaccaggtggatcggtgatcgacggacagcagccatgagtaagttgcaaacggaggtcctcaaggatgccatctcccaggtcgtctcagaggccagggagaagaacaggaagttcacagagaccgtcgagctccagatcggcctcaagaactacgacccgcaaaaggacaagcgtttcagtggctccgtgaagctgccccacatccctcgccccaagatgaaggtctgcatgcttggcgatgcgcagcacgtggaggaggctgagaagatcggtcttgattacatggatgttgaagctcttaaaaagatgaacaagaacaagaagcttgtcaagaagcttgccaagaagtaccatgctttcttagcctccgaggctattatcaagcagattcctcgtctccttggtcctggtctcaacaaggcaggcaagttcccaactttggttactcaccaggagtctctggaatcaaaagtgaatgagacgaaagctacagtcaagttccagctgaagaaggttctttgcatgggtgtggctgtgggcaacctgtcgatggaggagaagcagatccagcaaaacatccagatgagcgtcaacttcctggtttcgttgctgaagaagaattggcagaacgtgaggtgcctgtacatcaagagcaccatggggaagccaaacagagtgttctaagtcgctgtgtccattgcgtctaaaaccagtgccgtagacagtattgaagtttgttatgggatatatgtttatgcagtaatctgtcgtactgttatgcaaattttgtgtctgaagtgaacaagagtggttttgtgagcactaatgtttttcaccttgcacttgagctgacgggacaattgtgcatctggtgacgcggctgctagtggcgtaggtcttgtgaatggccgtgtacgctatgctgggttcatgctgctcggtgcatgtctgaatgttgatcggttgcgtgctaactatgccgtgatgctattcagaacgatagatcatggtgctgtcaacttaggtgcaaaaagattgtcagcttaaatggg

SEQ ID NO: 22 - DNA, 998 bp, Setaria italica
gttgcatcatgcagtactgcatgcaagggttcatggcgccgacataggtagcagcagtggcgcttgcacaaagagcaagaagacacgactgcagctctgtacgtgcgctagctagctgttttacaagcaacgccagcgcgctccacaccccagcgaccgaccgagacgatgtatccggcgaagcccagcgtggcggcggcgtcggcgccggtgaccggcgtccccatgggcggcccgcctgtcgccgccggcaacgccaccagccagtggtcctcggggctcttcgactgcttcgacgactgcgggctgtgctgcctgacgtgctggtgcccgtgcatcacgttcgggcgcgtcgccgagatcgtggaccggggcgcgacgtcgtgcgggatgagcggggcgatgtacacgctgctggccttagtggcctacctcacggggttcaggtgccagtggatctactcctgcacctaccgctccaagatgcgcgcccagttcggcctccccgagaccccatgctgcgactgctgcgtccacttcttctgcgagcgttgcgcactctgccagcagtacaaggagctcaaggcccgcgacttcgaccccgacatcggatgggacctcaacgcccagcgcggcgccggcgccggacaagccatgtacgcgccggcggcacaggggatggggcgctgatggccgccgcatcccgttcgcaattgtgtttgcagggtaaattacatgtgcaactgcgtttgtttaatttcgtatggtgacggacaagggttattgtgattgtaatgtaataatgtcaggattggtacgacggagagatgtgtactatgtgactgtgtgtgtttaatttctttcggtcaaaaagaaatgtgcatgtaaacatcatcaattcatcagtacggagtgtacgttccaatttttgttactactgtattccatcagtccatggtttggaataaaaagaatggcaagcaattggttcggaagtc

SEQ ID NO: 23 - DNA, 1912 bp, Setaria italica
cggcgctgcaaagttactggtggtggtggtagcgctgcgcggctggggaggaggaggaggaggaggaggaggatcggcggcggaggagggcggagatgaggatgaagacgctggcgtgctgccggcggcggccgcaggacttcagcatcgacatggaccaggagcccgacagggtgatgacatataatggcctcgagacctgcattatcaatagttccgcctatgacgatgatagtggcattagtgcaacaacaggtggagatggctgtgttaccactgattcccttgatgatgaagtctcaagttgctctagtaaagatgcctctggttcttccttctcttcccactgccttagcaagcaggaggagcatttatttgatgagttgggtacacccgttgcagttcatctacttcctttcaaagggaagaagccaatcacatataccttgagtgcttcagatattgaaaacatgaaggaaaaatttgcaaagctattgctcggtgatgatacttcaggaggagctaggggcgtttgcaccgctctggccttgtccaatggcataatcaatctctcggcaactgtttttggggaactttggaagctggaaccattgtgtgaagagaaaaaaatcaggtggaaaaaagaaatggactggttgctgtctcctacaacttatatggtggagctggttccgacgaagcaaagtggggctgatggatgcacatttgagattatgactccaaaggcccgttcagatgttcatgtgaaccttcctgctcttcagaagcttgatgcgatgctcattgaagtgatggactcaatgatagatacagagttctggtatgaggagagcggtagcagagctgatgggcgggggaaacttactggtccaaggaagagtaaaaagtggtggctcccatctcctcgtgtccctgagcaagggctatctcaatttcagcgaaaaaggcttgtttttcaggctaagcttgttcatcagatcctcaaagctgcaaaatccatcaatgaacaagtcctattccatatgcctattcctgcagctgttatggatgccctcccaaagtctgggagagctagcttgggcgaagatttgtatcaagctataaccacggagtatattcctatagaggaaatctttgtttctctcagtttgaaaactgagcatagtgtgctcgagactataaaccggttggagggtgcagtgtttgcttggaaccaaaggattttagaggaaaagagcaagaaatccccagcacggcattcctggaacttcataaaggatagttcgtcagaacttgacaagatgtcggtgtgcatcgaaagggtcgacactcttgtgcagctcctgaaatccagattccccaacctgcctccaacctttatagatgttctaaaggtccagtacaacgtggacgtggggcacgccatcgtagaggcctactctagggctcttgttggggtagcattcagcatactgtcccgggtggcggagatactgctggaggacgacctgatcaagaagcccaacacccccatggcgacgctcaagttcgacctctcctccgacgtgtaccttgcgggcatcacggagacgccgccgggccacatccggcggtccctcatggaccagatcagcatggtcgacgggcgcttcgacgccgtcgccaagaagaaaggggtgaagcagctgaggtggtgaggaccgagagtcggctgttgtgaatcttttggcgatgtgtacagggtgatgcagggcccagttgtccgctccacaaggtttacctttactaatagcgtactgatgtaatgtgttttgcaaccgagtttatagcgcactgttaagagcagcgttggtcgaatggatccctgcccgtcgcggtctccgggtgttgc

SEQ ID NO: 24 - DNA, 1172 bp, Setaria italica
caacaattcgctagtccccggccacatctttcttgctcccatattaagcccagccgagccgagcagagcccccggccagatgcgaacatccccacaaacatcttatctcccggggccagaccagagaattggaattgcttctctcctcctccaccgttcttgttcttcttcttcttcttcgccagcgtgccgcggccatggctaggaagtgctctagctgtggcaataatggccacaactccaggacctgcggcgggaacggcagggtcatgatggagaacggcggcggcggagtgaggctgttcggggtgcagctgcatgtggggtcgtcttctcccatgaagaagtgcttcagcatggagtgcctgtcgtccgcggcgccggcggtgtactacgcggccgctctcgccgccagcagctcctcgccgtccgtgtcgtcgtcgtcgtcgcttgtctcggtggaggagaccgccgagaaggtcaccaacgggtacctttcggacgggctcatgggcagggcgcaggagaggaagaagggggttccatggaccgaggatgagcaccggagattcctggcaggcctggagaagctcgggaagggcgactggcgaggcatctcccggcacttcgtcacgacgcggacgccgacgcaggtggccagccacgcccagaagtacttcctccggcagagcagcctcacgcacaagaagcggaggtccagcctcttcgacgtcgtcgagaacgcagacagggcggcgacgagcgcgaacgagcgtctgagacagagacgcggcggcgggctcggcgccggacacggagctcccggctctgtctctcggcatcatcagccggccggcgaagcccgagcgcatcctgcctccgagcctttcgtccctgctgccacagtgctcatcggcgatgagcagcagcagcgggagcacgtcgccgagcgggccgcaccgaggcagaagcacccttcgtccctgacgctgtccaagcctcatcatgcgagcctccagcaggcggcgccggacctggagctgaagatctcgacgaccgccgactaccaggccggttcgtcgccgaggacgccgttcttcgggaccatcagggtcacgtaaccggaaaggcgatcgacgatgatccgttgctcgaagagcttttgctcatct

SEQ ID NO: 25 - DNA, 832 bp, Setaria italica
gcatttgttacttcacatgaaggtaccggagtcgaattaaagatccaaacacctagtctctcccctcttgcattcacaggcgatttggcctatgtactgctcgattccggcgatttggaggaggggaagcgccaatccgaggtggagagccggggttgggtctggatccttccgcgagttgggactgtaaattggaggcgaggagtacgagaggtggatgggtgcgcacgaaggtgcttattgctgattcagaagccttggcacatcttttggttgatccgtgagccgagctactctattctgttcagcagaaaaatggggctactctcatgttatagcttccttgacgtcatttgggaagaatttgcttccacgtgcggcagctgatgtatcccgtgttactgatgtcactgcaaaagaaggagccacaagtctctgtaaggtcaggaagtggtcaggaaggggaagcaaatgtgtagtcatcatttgtttgcagtcattgttaatgaacatcatttttccttgtgatgtaatgcaaacacacatcataccattgtatgcagattagaattaattgtctgcaaaggcccaacttagttatgatcattgcattggcaggtcatatggttgtgcacggagaatgcaaatacttgaacttgtaatgggtattatttaagaaaatcagatcaggttgcttttgtacgaagaactaaaagcaaaatagtttgaagtatacatagggctgccaaagaatttgctgagatgttgcatgatcagaatgatgtgcagatttgcttgcgtgcagtttcagaaaatttctgggcaaattatg

SEQ ID NO: 26 - DNA, 1675 bp, Setaria italica
ccagccaccatggctgcggccatggcgtcgctcccgctgcacctgctcctcctcctcccactccttgccgtcgtctcattcctgtggctccaccgtgcggtgtcgcgccggcgagggcgaggcggcggcgcgcggctgcccccgtcgccgtgggcgctcccggtgatcggccacctgcaccacctcgcgggcgcgcttccgcaccgcgccatgcgcaacctcgcggcgcgccacggcgagctcatgctgctccgcctcggcggtctccccgtcgtcgtcgcctcctccgcggacgccgcccgggaggtgatgcgggcgcgcgacctcgacttcgcgacgcgccccgtgacgcggatggtgcggctggtcatccccgacggcgccgagggcatcatcttcgcgccctacggcggcgggtggaggcagacccgcaggatctgcaccgtcgagctgctcagcgcccgccgcgtccagtccttcaggcccgtccgcgaggaggaggccggccggctcctccgcgccgtggcgtcggcggcgccgccggcgtgggcggtgaacctgagcgagctgctgtccgtgtacgcggccgactcctcggtgcgcgccatcatcgggagccggttcaaggaccgggacacgttcctggccatgctggagcgcgggctcaagctgttcgccaagttgagcttgccggacctcttcccgtcgtcacgcctcgccatgctcgtcagccgatgcccgcgccggatgaagcagcaccggcaggagacggttgtgttcatggacgccttggtccgggaccacgaggagagcagagcagctgacgacggcgacggcaaggaggacctgctcgacgtgctcctgaggatccagacggaaggcgatctgccggtgccactcaccactgacaacatcaagtcagtggtcggagacatgttcgccggacgcagcgagacggcggcgacggcgctgcaatggatcatggccgagctcatgaggaacccgagagtgatgcagaaggcgcaagacgaggtccgacgagcacttgccggacggcaaacagtaacagaggatgaccttggcgatctccattacatgcgcctagtgatcaaggaggctcttcggctgcatccacccctgccacttctacttccacgagagtgccggaactcatgccaggtgctaggattcgacgtgccagcaggcaccatagtgttcgtgaacgcgtgggccatcgccagggaccccaaatactgggacaagccggaggaatttgtgcccgaaagatttgaggatggcaagattgatttcaaggggacggacttcgagttcataccgttcggggcgggacggaggatgtgcccgggaatggcgtttgggctcgtgcatctggagcttgcactcgctggcctcctttaccattttgattgggagctcccgcttgggatggaggctgcagatctggacatgacggaggaaatgggagtcacggcccggcggcttcaagacctccggcttgttccagtagttcgagtgcctgtgccggtggaatagatgtaggagtgttttatttgtgttctttggtgcagccgtagtgttgggaacatgagcttctaatatactacctcgttcataaatatataatgcttagataaagctagttaattaaaaaatg

SEQ ID NO: 27 - DNA, 1329 bp, Setaria italica
ctggtcttgtagctagctaataacaatggcctctgcctcttgccttagcctgttggtgctggtggctctggcctcgtcggcgtcggcgcagctgtcgtcgacgttctacgacaggtcgtgccccagggctctggccaccatcaagagcgcggtgaatgccgcggtgtcgcaggaggcgcgcatgggcgcctccctgctcaggctgcacttccacgactgctttgtccaaggttgtgacgcatccgttctgctggcggggaacgagcagaacgatcctccgaatctaactctgagaggcttcaacgtcatcgccaacatcaaggcgcaggtggaggccatctgcaagcagaccgtctcctgcgccgacatcctcgccgtcgccgcccgcgactccgtcgtagcgctgggagggccgtcttggacagttccgctggggagaagggactcgctgaaagctgcaagcacgagcatggtgttgcagaacctcatcccgcctacatctagcctcactcaactgattcaagggtacgggaacttgggcctcaacccaaccgacttggttgctctctcaggtgcgcacacgatcggccaggcgcactgcccgagctaccaagaccacatctacaacgacaccaacatcaaccaggcgttcgcggcgtcgctcaaggccaactgccccgcgacaggcggctccaacgtcatggcaccgctggacacgacgacgcccaacgcgttcgacaacgcctacttcaagaacctgcagtcgcagaaggggctcctgcactccgaccaggagctcttcaacggcggcagcaccgacaacacggtccgcaacttcgcgtccaacccgtcggcgttcagcagcgccttcgtgactgccatgatcaagatgggcaacatcagccctctgacggggacgcaaggccagatcaggaccacatgctccgcggcgaacccgtaataacgtacaagctaggatacacatatacgtgtgtacgaataaacgatgacatgaacgaataaggtctcattacagccatcacaaaatagcaagcatcagctgaaatagcatgccagctcgcttttcttgttccatcaagtcttgtacggaacagagagcatatggacattgttgtatgcatgtaacattctctttgctaaagcatggaggattattgctaagcaaagagaatgttaaactatgtttttgctaaacatgttgtgccttctttaccgtagtttccttatctgtctaaccgtttttttcatgttgaaaggatggcaagagccgcaagctttattagacaatattccctccgctcaaattac

SEQ ID NO: 28 - DNA, 997 bp, Setaria italica
cggccttcttctcctgatctcctccactcgtcgtccatccctcgagctctcctcctgcagctccggatctggaaggccgggggagtcgcacgctggcagaagactagaagagaaacagcagaattgagccgtaggcagaggagaaacagggcagggctgttgactcgcatgcctctgagaattcggggcagaggcatcgcgtagctgctatcggaaaagctcgaggtgaagacatggattggttgcctggagagctgtgcctcaagatcttccagctcctggatcaccagtccctcgcctccgctccccaagtttgcaggaaatggagggcgttgacctccgacgatgagctgtggcgcaagctgttcagcgacaggtggggagcggacgccggggcgttctacgcgccggagggctccaagtcctggaaggacgtcttcgtcgtgcaggaccggtgcgaccgatacggactgggtgtcaggatcatcagggaagggaaagactactacctgatctaccagggcgagatccagaggtacctgggctcgcgccaggacacggacggtgacggcggcggcaaggacgcgccgcggcaggacgctgaggacgagcagcggcagatatccaaccggatcctgttcttcctgggggatctagaggcagcctgtgcggacgccaaacgtgtcaaggcgtgaacgtgacctcctctgcggctgcgcccctgtccaggattccaggagcacattgccgcctgtatgatgcatagctcgtgcatagtgttgttcctatactaaatgtatagtgcttcacccacaatttatttcagttcataatcatgttaacattcacagttcattttgactctagtatggtcatttagattgtaagttgacttgatcgtatatgctttgtttgtatgaaactttcatctatcaatggttcaatgaacacccagaaccgtggcgcctgccaaacaaagcaacaaataacataacag

SEQ ID NO: 29 - DNA, 4326 bp, Setaria italica
gccccggcgggcgccggcgagggttcgccgccctcgccgccgcggcgatcgctctggtgcagatcagtcttctagcatttccaatcagcgcacagcaatccaatggctcaagggttgtacccgcagaaggttactgttccatgtacggcatttgtgcacaacgaagtgatgggaaggtcttaaactgtgcgaatgcaaccaaagctgttaagccagacacattgttttcgtcaaggatccaaagtttgtgcccaacaatcactggcaatgtctgttgcaccgcagatcagtttgatacgttacaccaacaagttcaacaggctgtgccatttcttgttggatgcccagcatgcttgaggaatttcctgaatctcttctgtgagatgtcttgttctccaaaccaaagcctattcattaatgtgacttcagtaaagcaggtctttcttttcttaatctactttataaatagcactatgactgttgatggcatagattactatgtaactactaactatggtgaagagctatacaactcatgcaaggatgttaagtttggaactctgaacacacgtgcaatggattttctcggtggaggtgcgaaaacttacaaagagtggttggcatttattgggcggcaagcgaaccctaatgagcctgggtcaccttatttgataacattccgatcagattttagtgattcatctggtgtgaagcctctaaattctacaatttattcttgtggagacccatctttgggttgttcatgcggtgattgcccttcttcttctgtttgcacgggatccttgctgccacagctgaacactgatacctcctgttcagttaaaatgggttctttaaaggccaaatgcttagacttctcactagtggttatctaccttgcgttattatgcgcttttctgctgtggggtttgttacacagagcacgaggaagaactgcctcctccttgcagacaaaaccattgaagaattcagatgataagtcagactcaaaccaaaatggcaagagtcctcataactcggttcaggtgtctgaagctgcatcctctactgtcaaaccatcatatccctctattgttcaaacttacatgtcaattttctttaggaagcatggaatttttgttgctagacaccctctccttgtgttatgtgtatcattgcttatccctctcctcttatgtattggtctccttcgcttcaaggttgaaacccaaccagaaaagctttgggttagccctggaagtcgagccgctgatgagaagaactattttgacagccatcttgcaccattttataggattgagcagcttgtgttagccacttctgcatccagtgggtctgcagctccttcaatagtaaatgacaacaatatgaaattactattccagattcagaaaaaggttgatgatctgcgtgcaagttattccgggtcaacagtagcccttgctgacatttgcttaaagccactcagtacagactgtgctactcaaagtgttttgcagtatttccagctggatcctaaaaagtatgatgattcaggaatagaccatgctaaattttgttttcagcattacacttctgaagagacatgtttgagcacttttcagtcacctattgatccaagtacaattttaggtggtttttcaggaaacaattttactgaggcttctgcatttgtaataacttatcctgtgaacaacaaagttgagacaacaggacaagagaacgggaaggccgtggcttgggaacgggcatttattaatcttgttaaggaggaaatacttccgatggtattagcacagaacctgacattgtccttttcgtccgagagctctatccaagatgaattaaacagagaaagtacagctgatgctattacaatagtgattagctatattgtgatgtttgcatatatatcattcacacttggagaccggccttctcgttggttgtcattatttgtttcatcaaaggtactgcttggcttgtctggggtcgtcctggtgatgctttcagttttaggttcaatgggattctttagtgctattggagtgaagtctacccttattattatggaagtgattccttttcttgtgctggctgtcggtgtcgataacatgtgtatccttgtgcatgctgtcaaacgccaaccagatcagtcaaacttggaagagcggataagtgaagcactggtggaagttggaccatccattacattagccagttttgctgaagtactagcctttgctgtgagtgcaattaatccaatgcctgcgaccagagtgttttccatgtttgccgcactggcggtctttatggatttccttctccaagtgacagcttttgtagcccttattgtatttgactttaggagagcacaggatggcaggattgattgtgtcccttgtgcgagaatcgcgtcaagtccagctgccggtgatggtggtgatggacagaggctccacttgcttgctagatatatgagggatatccatggaccaattctcagttaccgggcagtgaagttcgttgtaatcactgtgtttgtaggattggcattttcaagcatagctttgtctactagactgcaaccaggattggagcagcaaattgttctgccacgaaattcctatttacaggactattttgatgaccttgcaaagtacatgaaagttggtccaccattatactttgttgtgaaagacttcaattacagctctgcatcggtgcatacgaatcagatatgttcgatcaaccagtgtaattcaaattctcttttgaatgagatagcaagacaatcgttatcccctgagactagttacattgctaaacctgctgcttcatggcttgatgacttcctaatttggatgtctcctgaagcattcggatgctgtaggaaatttgtgaatggaagttactgccctccagatgatcagcctccatgctgccaactcgatcaggattcaggcacttgcagcgcaagcagaacctgcagtaactgcacaacgtgcttcctacactcagacttggataatggacgtccatccacaacccaattcaaagataaactcccatggtttcttgatgcacttccatcgagtgattgttctaaagggggaaaaggagcttattcaacaagtttggacctcaatggttatgaaagtggcatcatacaagcatcagcattccgaacataccatactccccttaataagcagacggactatgttaactcaatgagagctgctcgggacttcagttctaaaatgtccaaagatttacagatggaaattttcccatattctgtgttctatatattctttgagcaatatctgggtgtgtggaagacagctatcatgaacatatgtgtttgccttggtactatatttgtcgtttgcttcctagtcaccagcagtttatgggcttcagcaatcattttaattgtgctggcaatgatagtcttggatttgatgggagtgatggccatccttggtattcagctcaatgcgatttctgttgtaaaccttgttatgtcaataggaattgctgttgagttctgtgttcatatcacgcatgcctttatgattggcactggggacagagaaactcgtgcaaggcaggctctatccacgatgggtgcttctgtattcagtggaatcactttgaccaagcttgtgggagttattgtcctgcgttttgcaaaatctgaagtttttgtggtctattacttccaaatgtacttggctcttgtcctcattgggttcctgcatgggcttatcttcctaccggtcgttctgagcttatgtggccctcctccaaaatcggtgaagccagttgaacaaaatcaaccaccttcagcttcaaccgagcggacttgatgggattttattcgagttaatagtgaaatcattgaaaattgaaatgggccagtttgggatcctctgtgcgtccatgtacataacatccatctctcccggtgcaggagtaccatcgagttgtacagtatttgttgaaggtgaaagcagtgctatagatccatagaaaaagactgtacatatccatctcttattgtttgcataactaggttagttggtgcttacatggtggaaaaggaaactaagaggcgtattgggtctagattgtgcggcatagctagatggtgtttggatccaaagttgatgggctaaagtttagtccctaaattttagcccctaaaatttagtccttgtggggtgtttggatgcaagagctaaaaggtagtcttccttgagctaatgattgatttgcccttatttattgattcaaaca

SEQ ID NO: 30 - DNA, 3105 bp, Setaria italica
gtggagtggttggtgctcagggtggcctgccaataggggcaacatcgagagatggggggcggaggaggagtgttccgtttctcctccatggcctcctcctctcctcggctcctcgtcctgctgctcgcgtggctttgctgcgcggcggcgcaggcgcagacgacgacggacacgctgcggcagggggcgtcgctgtcggggtcggcgacgctggtgtccttgccggatagggtgttcgaggtgggcttcttcccgccggaccccaagcagccctcccgcctctacctcggcgtctggtaccgcggcatcacgccgcggaccgtcgtctgggtcgccaaccgcgccgcgccggccgtctcgggggcgccgtcgctcgcgctcacggacgccggcgagctccaggtcctcgacggggcggcggcggtgaacgggacggccgcgccgcggctgctctggtcctccaacacctcgcgcgccgcgccgcgcgggggatactacgccaccatccaggactccggcagcctccaggtgcgcagcgacgacgggccgctgtgggacagcttctggcacccgacggacaccatcctgtccgggatgcagatcgccgtgcaggcgccggggccgcccgggagggccggcaatgagcggatgctgttcacgtcgtgggccagcgagacggaccccgcgccggggcgctacgcgctcggcctcgacccgaacggctccggccaggcatacatctggagagacggcaatgacatctactggagatcaggacaatggactggggtgaactttattggcattccatggaggccactctatctgagtgggtggacactgtcaaatgatcgagacttaggcctacactacacatacactgcaacaaacacatctttacagaggtttgttgttctgccaaatggcacagacatctgctatatggttaaaaagtcgtcacaagagtgggagactgtctggttacaaccatcaaacgcgtgcgaatactatgctgcttgtggtccaaatgctaaatgtaccgtggggcaagatggcaaggctcaatgcacctgcctgaaaggttttcaaccgaagttgtgggaccagtggaatgcaggaaattggactgaaggttgcacgaggaacccacttctcggttgccaggtcaaccaatctggagatggatttcttcctatgggaaacataaaatggcctgatttctcatattggatgtctacggtggcggatgagaaagggtgcaaaagttcctgcctgaacaactgctcatgtggtgcctatgtttacacaactacaacagggtgtctagtctggggtgacaaactaattgacatccatgagttgcagactgggtcatataccctaaacctgaagcttcctgcttctgagttacgggtacatcacgcagtttggcacatagccatgataatatctgccgtggttcttgttgttttggtagcttgccttgttctgtggtggtggcgtggcagaaatattaaagatgcagtgcacagaagttggaggtcaaggcattcatctacctggtcccagcagaatagttcaatgctggatatctcacagtccattcgttttgatgatgatgtggaggatggaaaaagccatgaactcaaagtatattccctggaccgcatgaaagctgctacatgtaattttagtgactccaacaagcttggagaaggaggatttggtcctgtctatatgggaacattacctgggggagaagaagtagctgtgaagaggctctgtaggaattcaggtcaaggccttgaagaattcaagaatgaggtcatacttattgcaaagttgcagcaccgtaatcttgtaagactactaggatgctgcatacagagagaagagaagatcctggtgtacgagtacatgcctaacaaaagtctagatgcattcctgttcaatcctgaaaagcaagagcttctagattggagtaaacggtttgatataattgaaggcattgctagagggcttctatatctccaccgggactcaaggctacgtgttgttcaccgtgatctcaaagccagcaacatcctcctggatgcagatatgaaccccaagatatcagattttgggatggcaaggatatttggcggggaccaaaaccaattcaatacgaaccgtgtcgtcggcacatttggctacatgtctcctgaatacgcgatggaaggcattttctcagtgaagtccgacgtctacagcttcggagtcctgatcttggagatcatcacaggaaagagggctgtgagcttccactatcatcaggactccttgaatatcgcaggatacgcatggcgacaatggaacgaagacaaggctgcggagctgatcgatccactgataagagcatcgtgctcacttcggcaagtcttgagatgcgtccacattgcgctgctatgcgtgcaagatcacgccgatgagcgtcccgacatccctactgtaattatcatgttgagcagtgactcgagcctcccgaacccaaggccgcccaccctgatgctccgtggccgtgagattgagtcgaccaagtcaagcgaaaacgaacagagccactccattggcactgtgtcaatgacacagctgcatggaagatagaatagcaacaaatactgaagtcatgacacctctgttttttcaccttttctgctgtcgataatatgccatttggtgtagattagcttttctccctccccccctccccccatggtggctgttatacggtgactcaaattctaattggattggattaggactcaatagggtgcaatattggaacttctatttctactaggatttgaacgttgaatcctactaggtgtaggactcctacttgcatgtatggattatataaacaagagggtggagcctctaggaataaatcaagtcaaagcaaatactaagatccccatccaaggcttgtgaaaggcaattaggagcgttcaagagggagggtggagcctctaggaataaatcaagccaaagcaaatactaaggtccccatccaaggcttgtgaaaggcaattaggagcgttcaagagggataggttagatagt

SEQ ID NO: 31 - DNA, 6686 bp, Setaria italica
acttttcacctctcgtcctccgcccctcctcttcctcgctcgctctgcgctgcggttgcctgccacttagccactagacaaccaccaccgactggaacccgaaccgcgcctcgctgccgcggggaggccgcgcgatggacggcgcgtcgtggcccgcgcggtggcctccgccggcgccccccgctgcgccggtgccgccgctgccgaaccagatggacggcgtcactctgcgccacctgctccgccccttcgccgcgcaggaggccgcggcgggtggccgagcgacggcagcgccagagcagctgatcacaaatccgtcgacctcgcagtccggccagcctgcgagagctgggccgagcaacgagttgcttgctcaagttccggggagctattccactttcagccttgcgccggaccttaaggcattgttcgataagccaaacgcgagcaatgctgctgatgtcattgatcttactcggacacccccgctctgtagtgctgccactctgcccaagtattcaagacatggattgacagctagcagtagcaatgagcagtcctctgctggagcactttttctgaataaaagtgctaatggaatgggtacttttactggggaagtttcaactaatgaaggaatggcaaatggtggcatacagttacaggattcaagtctgcatgcactgcagaaattgccattcagatcgacgactcatcatcatcctacgctgcttggtgatcgtatccatgtcacctgtctgaacgtcggtggagagttctttgtgggtgaagctgggctctttggaatcatttgcctgtgtcatcggttgagaatgtctgtagctaaattctgcgagcatgcgggtggaactccagaaaaagctggtgaaattgtccacgtggagaatggcatgactattgcgcaatggttcaaattctgcataggagtggcgggatctattgctaataccaggtgggattggccagactgggcatgtatgaaaagttctccagaagaatacatgttgaaaagtcttgcttcaagaaacagtggtacaggaaaagtaaggttgttaggtggatatggaaaaatcaatggacttataaacaacccagcttattccagcgatctgtacatcgaaggtggaggatgcactaatgttgataagcaaatgaatgggtcagttggaacaaattacaaaaagagcgttgatgtgcacgaaggtttaacaaaggactctgctttactacagaattccacaacaatgaatgtagggctcgctagaaaccatacggttcatgcattaaacctgaaccctcttagcacacctagtggaagcctacactctgaagcaagcatgggaagacattacaaaggaaatcacttggcacataattatggaatctgtttggagaaaaaccttgatgcctcttttcgtaatcctgagccacgttcctcaagagttgtgaaccatgatagtagggcgtgcagacctgatttcccccacaaaatattgcaggacactttgtgcaacacttcaaacactgaattaaagcttggacaatcttcttatcatcaatctatgaccactctatttccattggtacagtcggcggtcattgaatttcagaaacctcaatcacacaggccattgataaatcagaatccttgcccaaagcaagcaacaaaggtcaacaacaatctagctgaacctgaacataatggaccatccattagtactggaaataagcaaccacttctagttactaatggaacaaaacattctgaagttggtgagcttacggatgatacatccaagaattcatttatctcattatttctttcacaccttgagagaaatagtacacctgaacccattgacgatattctcaacagtaacgagcattatcatcctaaggccctggatgtcgcatgtggttctgatcatccaaaaaatgccagtagacatattgagacaagggttaatgataatcatccaaagttggccccaaccattattcatatgaaaaggagatcagaaggcatttctctttcagcatcttacagtggatataatcctcaagatgcatcccatggtaatagtcaggaacatttgattcatggggattgcccatcacatttgctgcctaatcaacctaatgctggaatctcaaattgtgcaagagtttcatgtcctgcaaattgcatgtgctgcactcacatgggtaataaatcccatcaggttgcacatggtgagattggggttccctgtttctatgataaaatggccaggggccatggtacttttgagcgagttgatgacttatgcacacatagaagtttgagagcttttgccaaaatcagttgtgagaatgggaaatcttgctgttcttctcaggagtttctacctagcttttgccaaaatgatccgtcaacactcggaaaatcgatttgtggatgctgttgcaaaattcaggaaggtgtttccaagcttggttttatacctggtcacttgtgcagaactcgtttttctagtgatcttggtccagttgtatcaagtaagcctacccttgaagggcaagatgaactttgtgcctgctccagttttatgcaaagatcgtcattatgttctcgagaacacatcttgcagtcttgttatgcatgccccattgatggattgcactacagaaattccatgggacatgcaacagacagcttgacaaaacactctctgtttgatggacgtagcacaaaagaacaaggtccttgttgcaatggaagatgttgctattctgtagtcccaaaatgtttgtctagttgtgcctttacaaagcactgtgatgtcagagttgatcaaattggtcatactgcacctataagcaaacaccagatgcaaatgcctaccagatgctgcacattagaggagaatgagaaattaacatgccaatgcttaagcaatagaattgcaggaagaagcttatctcaagcttctcgttgtaaagatgtctctgataaagtaatgaaccagccttctattgcaataacggagaggctgaagaatatatccgaagcttcagtggctgatgatagttcgtccaaagccgtaacagagagaaagggcccttctaaagattctgtagtatctaaaggacaaccaaagtttggtttctcttctggatcatcaagcattgtggttacaaagtttcagatgtcacctgaagttcacaaagtgtcatctactgctaaacataggaaacataaaaatgtatgtgatgaaggatcaagaattgagaaatgttcagcatccagctatgtgcctgccagtagtacaggatgtgaggaagccctaaatagttttaccagatctcagttggctccatctcgagtgaagcgcaagggtaatcagatttctgtgggaagtagactagaggaaaaggacaatgaggagctttgttttgggctgccaaaaagaatgagaacattgaggtgctctagtaaaaattctgaatcagaagattgtactaggactagttcccagtcgtcccagaaggggggttgtcaaccacaaaatgaggttaactcattttcttgcagggtgttgagaaccaagcgaaaacatcctaccatgcaactgaataagcctgtgaaacagcttcatagccagaacaaggttttcaaaggtgatggcaagctaccagataccaagggaaatttttttggtggattagattcctttgatagaaaaaaacaagtagaggatacgactccgggtagaacaaaacatcaccaggaagggagtcgagcatttgtccgcaaactacctaaatatgtgtctctaaactgcattgttaatgaacctaacagtgaagatgcttgcagtgggagtgctggaattgattcaagtttaattgccacgggaatggcaaatgataaccgaaaatctcccaaaatcgttccactcagtctggttcttaaaaaggctaagagatgtcattctgttaaactctgtaagaccgaaagcacccacttgtatgaaaaaaagggctcagattgttctgtgaacagctcatcagattgttctgtagataagtgccccattgatgatgaaggttgcagtccacaagctgaatatgaaatgcagggttccaaaaggagtaggtattcatctaatggtttgaggtcacattttatggctcactgcaaaagaccatctggtgttcttggagaagatgatcctcttggtctaaaagatatggaaacaaatcgcctgtcaataacatcatcaagaagtaatgggaccaagaatcgaagagcaagtgtatcccttactaggattaagaggcataagaaatttgcaaacaaatcagcatgctattccagcagtggcaaagaaaatgctgtgctaacccatgaagaaaatgttaggagagacagtggaagactcagcttagatgctccatgctgcgtttgtggaatctcagacccagagccttgcaatcaatttatagagtgctgcaagtgctatatcaaagtgcaccaagcttgttatggtgttctaaaagttcctagaggtcaatggttctgtagaccctgcaagactaataccctgaacacagcctgtgtgttgtgtggttatggaggtggagctatgacaagggcactgaaaaccaagaatattctgaaaagtttgctcaaaagtttgatgactacagcaagatcagaaaaaaatgttgattcattaagaaacggaaggagtgagtgtacaagcctgcgaaatccagtagacagtgcacgtggggatagcattgcgaatggggagaacattaccagcaattcctggacctctattaatcacaattccagtttacttggaccacgaacaatgcagtgggttcacatggtctgtggactttggacacctggcacaaaatgcccaaatgccaccacgatgagtgcttttgatgtatcgggtgcttcacctgccaagagaaatactgcatgttcaatatgtggcagaactgggggctcatttattaagtgccgagatgtaaattgtttggtgctctttcatccttggtgtgcacatcagaggggtttgctgcaaagtgagcctgaaggtgagcgcaatgaaaatgttggcttttatgggcgatgcatcgatcatgctaatgatttttctagtcgcattaatcctaaggaatgcttgagaagcagcagctggacatgcgcacgtacagagggttttaaaggtcgaaagggagaaggctttcatggtagtagtcacaagaaatctgaagagtacagtggtgagttcagtgtttcccaagaacagataaatgcttggttacgcataaatggttcgaagcctagcgggagaggacagaaggaatacatccattataagcagttaaaaggatggaagcatttggtagtgtacaaatctggcatacatggacttggtctctacacatcagtgtttattccgcgtggctctatggttgtagagtatgtgggtgaaattgttgggcagcgggttgccgacaaaagagagatcgaataccagtctgggaaacgactacaatataagagtgcctgttatttctttaagattgacagggagcatattattgatgccacccgcaaaggtgggattgcaagatttgtaaaccattcatgccagccaaactgcgttgcgaaaataatctcggtcaggaatgagaagaaggtaatgttctttgcagaacgtcacataaacccaggggaggaaattacttacgattaccactttaaccgtgaagatgaaggccagaggatcccttgcttctgtagatcaagatactgcaggcgttacctcaattagtttactattgtgccatcttactgtgtaacatgtctatatatcctttatttttcatcctttagaacacttcattgcatgtctgggagaacaataaactgcttgatgtatataaactctagggacttgcatctggcagtgccagtttatcttttgtgaagccaaatgaactatcagctcagctgtatgtggtcaatacgcaaaatttagtgttaaagaggaaaagatgggagtgccctcatagatatcaagcgtaattgattaaccaagggagcatactctcccatcatacaacttttgacaccataaacagcaaccctggtcaatatataaacgaaatgatacatcccaatgcaagagacccaaacaccattcacttgtatgattctatcagtcgtagtttgtgttcaagaacgggttcttgtcgttgtagaatgggttcgtgaaactgctggtcaggctctcattgactttgttccccttcgcctccgagtctgactgatgttgagcgaaggccctggggttgaagttgtcatcaaggttgatgtcgtcaaatgtagcccagccctcactgtcactgatgtccctctgcttctccatctcttcgacatgttccttgaactctttctttgcagcagtgatcacgccgtccccatgctgatcacaccatgcctttgggaaaaagggcttgagctctgacttgtccactggaagctttgtagagatggcctcaatttgctgatccgagaagttcaagttccgatttgtagatgatagctcagcctgaatccttgagagctccttctttgtgttctccaccagaacctt

SEQ ID NO: 32 - DNA, 1391 bp, Setaria italica
aaagattgggttcggcgggcgattaacgcccgatcactgtgcaggattctattccaccttatcttctgatctccatttccgtgctgtttaatgcaagtggtggggaggcaaagtagagattgtgttgccggttttggggaaatattcttgggacattccgccctgtacagagatataccctgctccgagtttagtttcatgttcatagtggtggtggtggggagcgcacgtattactcatcctgattatcccgggcagttggggagatgggttcctcgcaggagtccaccttctcgtcggcctcgggggctgcgcaagtgaatgcttccactctggacttgctcccagtctatgccaaggagcttactgctggcggcgctgctggtgcatttgcaaagactgcggtggcgccactggagagggtcaagatcttattacagacaagaactgaaggtttccagtcccttgggatcctccagtccttgaggaagctgtggcagtatgagggagtccgaggcttctacaaagggaacggtgcaagtgtgcttcggattgttccttacgcggcattgcattacatgacatacgagcagtataggtgctggatattgaacaattttgctccatcagtaggtacagggcccgtcgttgatcttttagctggctcagctgctggtgggactgcagttttgtgtacatacccattagacttggctaggaccaagctggcataccaggtttcaaatgtgggccaatctggcaatgctttgggaaattctggtcgacaacaaacatataacggtataaaagatgtcttcaagactgtttacaaggaaggaggtgcacgatctttatatcgtggagtaggcccaactctgattggtattcttccatacgctggcttaaaattttacatatatgaagatctgaaatctcgagttccagaagattacaagaaatctgttatactgaagctctcttgtggagctttagctggtctatttgggcaaaccctcacttatccgttggatgttgtccggaggcaaatgcaggttcaaagcaagctgcctcaaaattcaagtgatgggttccgtataagaggaactttccagggtctcttgctcatcattaggtgccaagggtggagacagctctttgctggcttgagccttaactatgtcaaggttgttccttccgtagcaatcggtttcacaacatatgacatgatgaagacattgctaggagttcctccccgagagagagtccatgcatcatcaggtgctaacaaatgaagcaatgtttgcctccttatgttagggccaatgaaattgagaaactctagtctgtggcattgtggttcttgttaagaatcctatccttgtgttgaacag

SEQ ID NO: 33 - DNA, 3907 bp, Setaria italica
ctcccgcccccttcttcccgccccccgcggccccggggttctcccgcgcggtccgctgcaacgcgccgtcctcgttcccggccgacgggggcggattcgggggcgcggggcagcagcagcatgcggcggcgtacccggggaacgcgatctcgaccaccaagtacaccgcggcgagcttcgtgcccaagtcgctcttcgagcagttccgccgcgccgccaactgcttcttcctcgtcgtcgcctgcgtctccttcagcccgctcgcgccctaccgcgccgtctccgtcctgctcccgctcctcgtcgtcgtcagcgcagccatggccaaggaggccgtcgaggactggaggcggaagcagcaggacatagaagtgaacaataggaaggttgaggtgtatgatgggacccagtcatttcatgagacagaatggaagaagcttcgagttggtgatatagttaaagttaaaaaggatgagttcttccctgcagatcttctttttctctcatctagctacgacgatggaatatgctatgttgagacaatgaatcttgatggagagacaaacttgaagcgaaaacaggcgctagatgtgactatgggcttgaatgatgagcagtttttccatagcttcaaagctttcattcgatgcgaggatccaaatgagaaactgtattctttcttagggacgttgtactacaatgaacaacaatatcctctgtctccacaacagatccttctaagggactcaaaacttcgcaatacaagctatatatatggcactgtaatattcacagggcatgatacaaaggtgatgcaaaatgcaatggagccaccatcaaagagaagctcagttgaacgaagaatggataaaataatatatctgctttttgctattctctttgctattgcaacgttcgggtcaattgtgtttgggatgaaaacaaagcatgagataagtccaggaaactatgcatggtacctcagaccagatcaagcaaatatattctttgatccaaacagagcatcatttgcagccttttgccattttctcacaagccttatgctgtatgtgaccttggtgcctatttcattgtatatatcgatagaaattgtcaaggtgttacagagcacattcataaatcaagaccagaatatgtattgtgcagagtctgataaacctgcaagagctcgcacttccaatttgaatgaagaacttggtcaagttcatactattttgtctgacaaaacaggaacattaacatgcaactcgatggagttcttgaaatgttctattgctggggttgcttatgggaatagtcctacagaaatggagacgtcttatggagaaatagctgaaactactgccaattatgggcacaagaacactactgaattcaagagattagtcaagggattcaacttcactgatggccgtttgatgaatggaagatgggccaaagaatgttctagggattctatagagatgtttttccgagtattagctgtttgtcatactgcaattcctgtggcagatagaaattctgctggtatgccttatgaagcagagtcacctgatgaaggagctcttgttacagctgctagagagtttggttttgaattttatcacaggacacagacaaccatatcagtgcatgaatatgatcctgtctttggtggaaaggtggatagaacctataaactactcaacatcttagagttcagcagtgctcgtaagcgtatgtctgttattgtgaggacagaagtgggtcggttattcctgttctgcaaaggagctgacagtgtaatattcgaaaggctctccaaagataatggaaaagcttgtctgagcaaaacgaagtgtcacatcaatgagtattctgaggcaggtctccggaccctagtacttgcataccgtgaacttactgaggagcaatatgttctatggaatcagaagtactcagctgccaagaattctgtacataccgatcatgatgaagctgtggagaaggcatcagaagatatcgagaaggatttggttctcttaggtgctactgcagtggaggacagattgcaaagtggggttcctgagtgtattcacaaacttgcacaagctggaattaagatctggattttaactggagacaagctggagacagctgtcaacataggttactcatgtaacttattgaggaaagagatggaggaaatttttatcacgctggataactcaagtacaagtgcttcagagggatgtagtggagaaggaaacagaatggccccatatgaagaaattgatagaaaattactagatgctagaacaaaggttttcatgagaggaacctcaactttatttgctcttattattgacggcaatgctctgacacatgctctcacgagcagcctcaagaactcatttctggatctagcagtcaactgtgcatctgtgttatgttgtcggatttctccaaaacagaaagcactggtcaccaggttggttaaaattaggacaggtaaaactactctagctattggagatggagcaaatgatgtcggtatgctacaagaggctgacattggggttggaataagtggcgctgaaggaatgcaggctgtgatggcaagtgactttgcaatagctcagtttcgtttcttagagcggttacttcttgtgcatggtcattggtgttatcgtcggattgcagctatgatatgctattttttcttcaagaacatcacattcggcattacacttttctggttcgaggcccatgctatgttctcagcccaacctgcgtacaatgactggttcatttctttctataatgttgccttcacatctctccctgtcattgcccttggtgtttttgacaaggatgtctcttcccgtgtttgtcttgaggtcccttcattacatcaagatggcgtgaataatgtattctttagttggtcccgaatactcagctggatgttaaatgggctgtgctgttcaataatcatatactttggttccctcaatgccatcctgattcaggctgtccggcaggatggtcgtgttgctgggtttgacatcctaggagtgaccatgtacacttgcgtagtgtggactgtgaactgccagctggctctctacatcagctatttcacctggatacaacattttgttatctggggcagtatactaatctggtacgcgtttctagtcatctatggactatttcccccggcaatatcaaccactgcatatcatgttttcttggaagcttgtgcgtcgagccctttgtactggttatcaaccctaatgattgtggtcacagccttgatcccattcttcgtctacaaaatatcgaggacactgtattacccacagtaccacgataaagttcagagaactaactcaaagaattggtgatgccagtcgtataagaagctactgaatgaatatatgtacagtcagtattctatttaacgtgcagtgtgcttaactttctagatcatgatgtcagcggcagtgtatataagcagaggtgttgtttattaggttctgtacatacttgggcttatgcccacaaatttgtagattcaggtcagcagtgcatctgccaaacatcagaatggaagtggtggctctttgctcggttggatggaacttgaatcaacaaattgatcttaggatcatgttaaaggtctacaacactacaccctctaggagcctggggttgcccaggaattgatgtagaaatgctaaaacgacaatttgggacggaggaagtagtatggttcctgtgctaacaagttcatatgatatcctacaatgtctttctgatttgtatctacttaggcatgcccagttcaaagtcattttctttggataatgcctaacgtcatcccgtgttttagttttgtaaa

SEQ ID NO: 34 - DNA, 967 bp, Setaria italica
cccaccacaacctagtctccctccacaagcgtctgccacccacgatcaaaaacaaaaccatcgccgacccactctccttgctgccaaccaagcacgcacagccacagccataccacaccaagtcaaggagaaggtcatggccggcgtgagctcatccagcgtcgtcgggctcaagcccgccgcggcggtgccgcaggccgcctcggcggcgaagcgggtgcaggtcgcgcccaaggagcgggccgccgagggccggcgcgccgcgctgctcggcctggcggccgtcttcgccgtcaccgccaccaccgggtcggccaaggccgggatcatcgacgagtacctcgagaagagcaaggccaacaaggagctgaacgacaagaagaggcttgccaccagcggcgctaacttcgcgcgcgcctacaccgtggagttcggcagctgccagttcccctacaacttcaccggctgccaggacctcgccaagcagaagaaagtgccgttcatcagcgacgacctcgagatcgagtgcgagggcaaggagaagtacaagtgcggctccaacgttttctggaagtggtgattggccgcgaactggagggactgcttgcggtgtgacgtgatgcccaaactgcagggaaatttggatgtgtgtaatttaccgtcattatatttgtatcatctcatttatctgatcatgcacgaacctcttgcaccggggagagtgaaactgtagcatcctttcttgcttggttgacgactcttttcatcggctttatttaatgacttcttccaaacaaaacgaggatgagaagattaaggaagcttcagtctattatgaaactctacgacaaaccggtacatgagaaaaggaataaaaaacaagcccaagccagcatgtaaacaaaaaggctgagtacatgagaaaaaggaaataaaaaaacacgggcatctgtcatctgtgttcttc

SEQ ID NO: 35 - DNA, 1736 bp, Setaria italica
cctgcctcgtcgcctctccctgactccctcgcccaccgcctcccccttcccggtctccgcctctcaccttctcgctacacaaacacacctcctgattggatcaattcggctttccgtctccggctgatccacggagccgcgctgccgagcggaatcgtcacctgatttggcgagactagcagatatttgtaaagtaatggctcatgatgaagctgtggctacccagaagactggaaacacagcatcgtctccaaaggatcaaccagctccttctccatatcctgattggtcaaccatgcaggcatactatggccacggtgtcttgccaccaacatattttgctccagcaatagctccaggtcatccaccgccatatatgtggggtcctcagcctctaatgccacacccttttgggacaccatatgctgcaatgtacccacatggtgcagcttacccacacccccttgtacccatggtatcaaatccattgagcgtggagcaaaccaagtctgcaaacagtaaggagaaaagttccagtaagaaacttaaagaaattgatcggactgcagtatctgctggcagcggtaacagtaaaagaacaatgtcatccagtgaagattacagtgcagagggctccagcgatgtaaacgatcagaaggtgaacaaaacttccaggaaacggagcttagttgatggacctggtgctgaaacatctgaagccgcaaagctggcaaatacagccatcctgccacatcactgctttccagctccagtaattaagcccagcgctacaaatgttgctaactcaagggcaatgggtgcaacgatatctccatctcctggtgtgattgttccgcctcatactggaggaccaactgacttatcaatcaaggatgagagggaactgaagcgagaaaagaggaagcaatcaaatagagaatctgctagacgatcaagactgagaaaacaggctgagacagaggagctggctacgcaagtggagtctcttacagcagaaaacacatcccttagatctgaaatcggcaggctaacagagagttcggacaaactaagattcgagaattccgctctgatggtgaagctgaaggacactgcagcgccgacccctgcagaaccatctccgaacaaagcagccacatcctcgtcctctcccggcgccgccgccgcggagaatttcctgtcgatgattgacagcacgaacgcgccgggcgtcagccggcacacggagcacggcgagcccaagctccggcagctcctcgactccaatccgtcgacagatgttgccgccgtaagctaacgctgatctacggtatctctttcccctggcacggagaggccggctaatacaacacatgcatgtggcctggggatgtcggcatgtcgccagctcatgctgctcaccataacatcatcagcgttacagtgtactaggaggcattgattccagtatagcattgagaacactggtaactttcctgctccagtgtagtcgctggcaggggttcttgatcatgtacccgtgtgttagttttgttgtgagcttctagcagtgttgcgctgcatgccaacctgaaaaacttcgagaccgtcctttggaccatttccggtgcaataacaaaatacagatttgagcttgtaacaagcaaggatgtcagtacagaactgcagcgtttggtttgatatctgtattttaccaaaagaaaaaaaaagtatct

SEQ ID NO: 36 - DNA, 1514 bp, Setaria italica
gcaaagcgaggcggaacccgccgaagagccctcgtcgtcggtgggggtgggtccacgcacgcaggcggtggtgcccatggcgtcgtggctgctgctccccctcccctccttcccctggcttccccctccgccaccgcccggatcctcctccggcggccgcggcggagggggcgggggcggagacggcggcgactggaggcccaacgtcgtcgcggccttcgccggcgcgcaggtcggcagcgccctccgccgccgcttcgcgggcctcctccgctcgccggaggtgcgacatcttgaagccttgccgaacatgggtgacatttgttttgggggatcacactcatttgcaacacacccaattcttggcgcgttggggaatgtgttccctgcgtcatatgtttgcagcttcactctattcaatgggaatgggtcaggtgggacatacatcggcaaaggaaaggtgctgtctagacgacctcgcagaattgattcgaagaagaggctgtggactaatgttcttcttgctattaatgtcctggcttatatcgctcaggtagcatcacaaggaaagcttcttatgtggggagccaagatcaacagtctgattgatagaggacaattttggcgtttggcaacatcatctctccttcacgcaaatgtcactcaccttgctttcaattgtttctctttaaactcaattgggcccatggtggaaatgctaagtggtcctagaagatttattgctgtttatatcagttcagcgctggcaggttcactgatgagttatcgctgttgtgagtcacctgctgttggtgcgtcaggtgccatttttggattggttggcgcccatgcagtttatatgtggaggcatagaagttattttggcaatgcaagggaaagtttagagcatatcgggcgtgtggttgtcttgaatatgggtatgggcctcctttcaaggggaattgataactggggtcatctgggaggcttgctagggggagttgctgtggcatggttcctaggtccggcatggcaatatcagtatgtgggaaaggatggcagagtggttttcaaagacagggctccagtcctccggctaataaaggggtaggcttaggcttctgttattttgtatttggggagaaacatagggaagagaaaagtaaaagagggtgaagattcattcaacgcaccaagaagagctaattccttaggaaacatacaaggagcctgttgcccgtgttcggatcattagattgtcaatattcaatgctgtggcaggttatggttaatcaatcgcataacattttattaggtgttagtgttaccagcggctgacaaacacacattgttctttctgttcctgcctatgattctcgatgtaagttctgcctatgattctcttgaggtcactaggttctttctgttcctgtactacaagaaatggtcaaacctgtaaaattgttctcagtgatccactaacatactccctccgtttctgtttataaggtgca

SEQ ID NO: 37 - DNA, 1458 bp, Setaria italica
gcagaggagcacaagtgagcgagagctagcagctcaagccttctagcctcacaggccactgcagccgcctagctcgagttgtatagctagtaatataatccggctgcgacatcatcagccatgggcgtgggcaaggtcctgaacgaggtgaagccgtacctgtacatggtgctcctgatggtggggttctccgggatgtacatcgtctccgtcgcctccctccggcgcggcatgagccacttcgtcctcgtcgtctaccgcaacttcgtcggcaccgtccttatgacccccttcgcgctcctcttcgagaggggagtgaggcccaagatgacgccgctcgtcttcgtcaaggtcatggggctcgccttgctggagcctgtgctggaccagaacatgtactacctgggcgcgaagctgacctccgcgggcttcgcctcggccctcgtcaacatgctcccggcggtcaccttcctcatggcgctcgtcctcaggatggagaagctcaggctgcggagcctccacagccaggccaagatcctcggcacggtctgcaccgtcgccggcgccgtactcatggtcctctaccacggccccgtcgtgccgttcccgtggtccagcggcggcgcccaccaccacgctgcggtggccgccggcacggcggcgagccaaagcggcggtgcctggctctacggcgtcgccatggtcatcggcagctgcgtgtgctgggccggcttcttcatcctccagtcgaacacgctgcagagctacccggcagagatgtcgctgacggcgctcatctgcggcgtgggcacggtgatgagcggcgcggtggcgctttttgcggagcgccgcgacatgagcgcctgggtcatcggcttcgacacccgcctcttcaccgtcgtctactccgggatcgtgtgctccggcgtggccttctacgtgcaggggctagtgacgcgggtgcgcggcccggtgttcgtgacggcgttccagcccctctgcatgatcttcaccaccatcatgggctccaccatactcaaagaagagaccaccttgggaagcgtggttggcgcggcgatcatagtggtggggctctactccctcatctggggcaagagcaaggaccacctcggcgacggcaagcccggcgccggggtcgtcaccgagctgcccctgacctcggctccgacccccaacggcaacggatacggcaagcagcacgcgctcggcggccatgtcgttaccgacgtcgagacgccggcggccaccgtgaccaagtgcgcttactgacaagccgatcgatcgagcttccatcacactgcacactagtgtagtgcatccaacatcagtggctgtacgtgtaatccaggagagatgatgcgctgtgcttcgattgctctgctctcgtagagacgccggactaaaactatatcactctgcattaaccacttttgtttg

SEQ ID NO: 38 - DNA, 3250 bp, Setaria italica
gcattccgaattcccgtgctctgcagtctgcacactgctctgcttagagcttgtctctcctctcccttccatctgtctcttcttctcaatccccgccgctgctcctcaatcctgcccgtgcgccgcgggaaggttctggaagctctccggagatgaggaggggtagaggacatggaggaggaggggtatccgcgtccctcgccgcgctgctgtgctgcggctgcgtcatggtcctcgccggcgcagccgccgcgcaggggccccggcttccctccgcgtacaaaaccctaagaggtgatgctccacgagttgtggccaaaggcgggttctcaggagtgtttcccgactccagctcagatgcctactcctttgcgttgatcgccagcgcacccggtacaactctgtggtgtgacgtccagctgacaaaggatggcgttggagtctgccttcgggacataaacatgaataattgcaccaacgtcgcccacacttaccaggcgagaaagcggacctatgtcatcgatggcgtgcggaaaaatggatggtttgctctggactttaccaaggatgagcttcagtctgtttctttaacacaagcaatttggtctcgcacctacagattcgattctgtcggatattctatcctctctgtcacagacttgctgtccattgtcaagcagccttctgtttggttgaatgttcagcatgacaccttctacaaagaacatggtttgaacatgaggaactacatactttccatccaaaagcgtgtatctgtggattatatctcgtcacctgaacttggcttcctccaaaatatatctggaacagttcatcgcaaaacaaagcttgtgtttagctttcttgataaatccctcttggatcattctataaaccaaacatatggttcacttttgagtaacctaacgcttattaagtctattgcatctggcataatggtcccgaagacatacatttggccagtgacaaaggataactatctacagccgtccacatcaattgtcgccgaagcccacaatgcagggctggaaatatatgcctctgattttgcaaatgatagaattattccctataactacagttatgatccattggcagaatacctaaactttatcagcgatggtggcttctctgttgatggtgtattgtcagaacaccctattactgcatcagaggctattggttgcttcgctaatctgaattcaagtgagactggtcatggggaacccttagttatctcgcataatggtgctagtggagattatccagactgtacggacctggcctacaatagtgcaattaatgatggcgcagatgtcattgattgtcctgttcaagtgacaagtgatggagttcttatgtgcatgagttccattaacctgcttgataccacgaatgtgcagggaacaactttcagctctcttagttctgttgttccagaaattcaggctacagcaggaatcttcacattcaaccttacttgggatgacattaatagtagcaccttaaaacccaaaatatcttccccagtgagtgattattatcttgtaaggaacccaaggtacacaaatcaagggaagtttctgaacttatctgactttctagcaatcggaatggataaggatttgtctggtgtcatgatcatcattgagaatgctgcatttgtggcaaagtcattaggaattgacatagttgattctgtaaatgctgccttaagtgctgctggctatgataatcagactaccaagcaagttctgatccagtcgaaagatagtgctgttcttgtcaaactgaagcagcagaaaacaaaatgcaagcttgtgtacactctccccttaggcattggggatgcttctacttcctcattagaagccatgaagaagtttgctgatgctgtagttgttgataggaaatctgtttttaccttaagtcaagattttgcgatccgacagaacagtcttgtgaaagatctacagtcagcagggctagctgtgtacgcacaggtgttccggaatgagtttgtatcacaaccgttggacttctttgcagatgaaactgttgagatcaattactatgttcaatcatttaatctgtcaggcatcataactgacttcccgaagacagtcagaagatacaaaaaaaacacttgtacaggtttgggaaatgacatgcccaactacatgcagcgcattgacgttggctccctttaccagttacttcaacccttcaaagcccagccgccatctgtgccgccaatgccgacactgaatgcttcaagcgtggaggaggcaccgcttcctcctgttgcgtcaagaaatgggtccggtggttcctcaagtggcgccgaaactcctggtgcgcctcctgctgctgctcacaaggctactgtaagtactggcatgctgtttgtaatggttttcacagctcttctgatctgagcaaaccatgaggctgtatagtaggctgatctgagcaaaccttgaggctgtatgattcaggcaagcttcgaccgatgttttggtgctcccaagcacttgtttctgtagctgtttcagtatgtccctgcatattcgtttccacctgtataaattccccggtagaaatgttacactattcagcgagcattggtgttatacattgctaatggaagccacagttcctggtgtttgcacatcactgctctgcatagatcctcatactgagctaaatgacacggtacatgttcagcaaattggcaagccttacccttacgcacataacaaattttcctgatgtcagttaaaaggtgaacatttcttaggactaagctttgtctcctaaagtgaagaacagcctaagaacatattgcaactatgctctcggtcacagtatcaactatcaaacattagcatataagatagagcacgactgcggaggacaatcctctgtatgtacaacactacattgaaccaggaagcagcagaagctatgacgcaccaaagccgctgctcacatgttcctgaacgatcacacgcagccggctttgcatcatgctggatgaagtgtaagctggcagatggaggtggtagaagcaggtttgcgaagtggggagatggtcgcgggagctggaggccctgtatatgaacagcctgcaccccagtccccagaaaccatctgacggcaaacatttcactgaggtccagaagaaaagtagcctcccctgctgttcgaccgtcatgttttccacggc

SEQ ID NO: 39 - DNA, 1044 bp, Setaria italica
caagaatctctctgaatccgtgacgccgacgtgaatgctttgtcttttctcaacttctggaatcggaaagaggcgtgcggttcgtgcagccacttgctattatttgattgcttaattgattggccgggagcgcttcctcgtccgctcctccattccttcagatcaccatggacctgcccaacgggcgagacgacgccccgatcccgaatggaggcgtcggcgcggaggagacggtggggaggaggaagaaggtggagctggtgcgggaggccatccatggcctcctggaggagaagaggatggacggccaaggggagaaggagatgccggccaggcagcggcaggaggacgaacacctcctgtcctcgttgctcaccaagccagatgcactggagagagatccagattcggacacgttggaaacacactccctgcacccgagtcatcagcctgggagaagcgaaaccagcaaagaggtggagctagccgacatcgccaaggacctgaacaagatcaagaggcagaacactgtcacccacatcctgctcggcgccgtcatcgtcctgacggcggtgtggcaggttaacgaggtgtcgttcctcctctgggtgcagaggaaactgagcaacccgttcaagtccctcggggacatgatcaagggatccctcaagctgaaggggaggaagcccgtgatcgagtcgtcgccgctgccgccggtcggcgtccccgatgtcagccggcctgatctgccgtcgttcgtcatcggcagcactgaaggcaggtagtaagactagctgcgtggtgatgctaggaaaaacagggttcgtttgtgattgaggtccatttttttttgggttcagtttgtctgttcatcaaagttgaaatttagaagttatgccactagttccatagtgtttctgaaatagcgcacccggattgattctcgaagagaaactagatcacttcttgcgagcataatggctcagagcttcaaaactggctcctatgtttctgaattggttcttgttaacttgcaagattcag

SEQ ID NO: 40 - DNA, 2163 bp, Setaria italica
agccacagaagcagagctttgagataacgtcaccattcttcctgcacccagctctgcttcgctcgtccatcccatccatccatgggcctcttcagctcgccggccaaggtctacaagccggcggccgacgtcgacctcggcccggacagcgacgagcactacatcagccccaacgtcaaagctcctcgcgtcgcagggctcctggtgaagctgctggcctgggtgctggagatgcccgtcgtcggctggatcgtgctctccgtcctcaaacgcgacaacctcgtctacaagctcgtctccgacgccgagatcccggagccgccgctgttcacggccacccacacctggcaagacatcccggagcagaacgtcaggctgacgaagcccggcctgccgccgccggagcgcgtccaggaggccgtcgtctgcctcactgctcccctgccggagccggcggcggcgctcgctgatccgtcgccggggttcaggcgctggacggtacgggacttccacgaggcctacagctcggggcagacgacccctgtcatggtggcgcggaggttcttggcggcggtgaaggagtgctccggcccggaggtgaacatggccttgttcatcagctgcgacgccgccgacgtgatgcggcaggccgaggactccacacgcagataccagcaaggggcgccgctgtcggccatggacggggtgctggtggcggtgaaggacgagctggactgcgcgccgtacccgaccacgggcgggacgcggtggctggcggcggcgcggcggccgtgcggcgcgggcgacgctgcgtgcgtggcgcagctgcgggcatgcggcgccgtcatggcggggaaggccaacatgcacgagctcggcgccgggaccagcggcatcaacccgcaccacggcgccaccaggaacccctactgcctcgccagggtctccggcggttcatcgggcggatccgccgccgcagtctgcgcagggctatgccccgtcgccctcggcgccgacggaggcgggtccgtgcgcatgccagcggcgctctgcggcgtcgtcggattcaagcccaccgccggcaggctctccaactccgggctgcttcctctgaactggacggtcggcatgccggggatcctggcagcaaccgtcgaggatgcgctcatcgcttatgcggccattgttgatcagtctaaaccaagtcatttacagcctgaactgaacctgccaatgctgacgtgtacgagatccatgcctaacatcaggctagccaaatacgcaaagtggtttgacgattgctccgaggacatcaggagcctctgcggcaaggccctccagatgctgcgaacgcagtacggttgggagtgtgtggacgtgactgtccctgagatcgaagagatgcgtctggcgcactacgtgacgatgggctccgagtgcacggcctccctcgctaaatacctcgacaacatgagcaagtctgagatcgggtgggacgtgcggatcggcctgagcgcctaccgatccttcagcagcagggactacctcaacgcgcagcgcctccggaaccgtcagatgttcttccacaacaagatcttcgagaccgccgacgcgatcgtgacgccgatgacaggggtgacggcgtacccgctgcaggaggacgcgctgggcaccggggagctcgactacatcaacggagctgcgctggtgcggtactcgatcgcgggcaacttcctggggctgccggcgatcaccgtgccggtggggtacgacacgggagggctccccgtcgggctgcagttcatcggcaggccatggtcggaggcgacgctgctgcacctcgcctacgccacgcaggaggcctgcgccagggagcaccgcaagcccaaggtgcactacgacctcctcctcagcaaagagtactagccttcagtcttccacgcagttgggatcgacgatgatccaacaggtgtatggtgaaattggtcagtgatttatttgttgactggcagtacaaagaaaaaagaaactgtgggttgcgattatgagtgcataattattgtttttgtgccgggagagcagtgcctctcttttttcgtccaaagggggaaaaactactgtatcgacagattcttgggtgcaattgaaactctttttaggaca

SEQ ID NO: 41 - DNA, 774 bp, Setaria italica
aagcaaagccccataccaagcacacgcacctctctgctttttagtttcctctacaactcttcctctctgcagctgctcataccatcatccttcctagtcagacacaagaacacgagcagggggagtttcttccatggcggtggccacggagactccgttccacgtcctggccgtggacgacagcctcccagacaggaagctcatcgagaggctcctcaagacctcttcattccacgtcaccactgtcgattccgggagcaaggctctcgagttcctggggatccatggcgaggacagcagcccagtttctgttcatgaggatcagctggaggttgcggtgaatctgataatcacagactactgcatgcctggcatcacagatatgatcttgacaggatatgatctgctcaagaagatcaaggaatcatcgtctctaagagatatcccagtgctgatcatgtcatccgagaacattccttcaaggatcaatagatgcctggaagaaggagcggacgagtttttcctaaaaccagtgaggctatcagacatgagcaagctgaagccccacatactgaaaagcagatgcaaggagcactaccaggaacagcaccagcaaagcgacagcaacagcaacgaatgcagtaaccccacaaacgacagcagcagcagcagcagcgataacagcaacagccgcaagagagaggcagaagacaacgaagaaattttgccccagagaaacagatcaaggcacagttagctgcaaactgattatag

SEQ ID NO: 42 - DNA, 1451 bp, Zea mays
gagttactttacctcccttgagcgaccactcttcccaagttcccatcccagtccgtcagtcaagcgagcgaaatcgaatggctcccctcttcgccgcggcgtcccacgcgtccctcctccccctctcctccctcgaccgccccgccgccggccacctagtccgtggcaccctcaggccccacacctcgagcctccgcctgcgccgccccccgggggcaaccgggcgcggccgcgggcgtggccgagggggcatcccagacgagtggggcgagcgctcgccgccggacaaccccgagccccccgcgcagcccgatcctcccatcgacgaagacgagtggggccgcgacgactctgccgagggcaactcacgccctatcgtcgtcgacgagtggggcgagcccggggtgcctgagcccgagccgccctccgccgcggacccgcctagcccctccgcagacgacgactggggaaaggagccggaggcgccggcgccggcccctgctccggcggcggaggaggacgagcaggaggtgaagagggaggagctcaagcggtgcctggtggacacggtgtacggctccgacctcggcttccgggcgtccacggaggtcagaggtgaggtcgtcgagctagtcacccagctcgaggcggttaaccctactactgctcccgtcgagtcgccggatctcctcgacggcaactggatcctcatatatacagcatattctgagcttctgcctattctagctgctggggcaacacctttggtcaaagtaaagcagatatcccaagaaattgactccaaaatcatgacgatagtcaatgcttcgacccttacgactccattcgcttcattttcattcagcgcaaccgcctctttcgaggttcaaagcccatcaaggatagaggtccaatttaaggaggggagctttcagcctccgacaatatcatcatccgtggatctacctcaacaagttgatatatttgggcagaagatcagcctggggccagtccagcaggcactgaatccattgcagcaagcatttgctagcattgctgggtccatttctgggcagccacccctcaaggtaccaattcccggcaacaacagagctcgatcctggctcttgactacctacctggacaaagacttaaggatctcgagaggcgatggaggcttgtttattcttgccaaagaggggagccctttgctagatcaattgtaaatctgtaattggttgctaccggaaaggatatccagaactccacaggtaacctaacagaggacgcctcacattgtatttatcaatcaatattgttgttggcggcactgttacatgtatggggccatgaaatcttataaatgaatatttagtcgataagaatcgagagctgaactgagactgatacaaacaaaacacttcaatgttcatctgatgtctgtcctttta

SEQ ID NO: 43 - DNA, 1313 bp, Zea mays
tattattggactattcctaacacaacggaggcaataggatgggatggtcatctataaataagtagcccggcgcagccttctttggagcagggagaagaacacagggcacacgcactacacgcacggcacgcagatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcaccaactgttcgtcgttgttttcgacaccgacaggctcaagggctccacgctcgtcaccaatggcgtgataacggccgggtctgacgagtgggcgatctacggcggaaccggggtgtttgccatggcgaggggcgtcataaggagaaggtatctcgccgacagggccggcgggaacactgatgagctcaacatggatgtcttctgccggccgtttggctcacagtcagagctgcaagataagatgcaggtgcaggggcagggctctagcgtcaccaagattggactatggggtggaccgggagggtcggcacaggacatcacggcggagcggccgccgcagcgtctgcacagcgtcaccgttcgtgctggcgtcgccgtcgactccatcgagttcacctatactgacagcgctgggcagaggcgcgccgctgggcgatggggtggactcgggggcaatgttcgaacgatcgaccttggcgacgccgaggatgtcagggaagtctcgggaacatacggcgcatttgaaggtgccactacgctgacctcgctcaggctcgtcaccagcagcagaacctggggcccctggggtgtcgagaacgggacgcgtttctccgtcacggcgcccatcggcagcagcatcgtgggattctatgcgcgggcgggaaccaggctcgtcgatgctatcggtgtttacttgcgtcagatttaattcgaataatagcaggggagctactgctagctacgtacctgctccatcctccattatcctttatttcaattcgctcatcatcgtcgtgtgtaaattaaataaataaagctcttgtgcccatattatatata

SEQ ID NO: 44 - DNA, 575 bp, Zea mays
gagtacctagttacgtgtgcttctcatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagctcttgttgttgttttgtatgtttgattgggtgtcccttcccagtcgagatggaataaaataaatcatcaggcgccaataagca

SEQ ID NO: 45 - DNA, 1267 bp, Zea mays
gagctggcagaacccgcctctcctattggccaggccacggcaccacccactaaactgccactctgccaggaacgaggaagcttccttcctgtccttcctcgcgaagcaagacacagataagagagtccactataaagcaacacagctgcgatcatagcgacaaaatatctcgccgttcccatggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcaggagggggaggcggaactgggcggggaggtcgatgggatcagcgtggaccagttcttcgacgcgctgtacgacggcgaggaggcgaaaggtgagcgggaggcgggggcaagcgcggatgtggactccggcagggacgatgtgctggaagtcgtgacgccagaggcggggacggtggaggtggatggcgatgatcccatcagcaagaagaagatgaggcaaatgaggaacagagattccgccatgaaatccagggagaggaagaagtcgtacataaaggacttggagacaaagagcaagcacttggaggcagagtgccgtcgcctcagctacgcacttcagtgctacgcagctgaaaacatggcactgcgccagagcttgctgaaggataggcctcttggtgctcccacagccacgcaggagtctgccgtactcacggaaaccctgccgctggtttccctgctttggctggtgagcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctatgcgcctgtcttgcagagaagcctgtcgatatccatggagtagtaccttttttttgtttaatagctcctgtgctacccagaatatgtttaaaatctggattttgtgtta

SEQ ID NO: 46 - DNA, 760 bp, Zea mays
ggaagagaaaaaccccgtccccctcggccgccgaagcgaaacagcctctggccgctgcccgaccccgacgccagctgcccagttcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgtcgcctttaaatgtttggaactgtcgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcactaaggtatgctgcaaataagcaattcctgggaattgtcgagac

SEQ ID NO: 47 - DNA, 2735 bp, Zea mays
atcgtactagtggtaccaccacacacagccccctgtgccctcctgccgtccgtgacgtgacgcagccgagccgcgcgcgcgctccgggccggacgcctccgctcgaatcgatggacgccgaggccggcgtcgccggcgccgaccagcttccgcggaggcagtactacctgaatctactgcttttagcttaccagagctttggtgttgtttacggggacctgagcacatcgcctctctacgtgtataaaagtacgttctctggaaagctcagacactaccaagacgaggagacagtgttcggcgtactttcgctcatcttttggaccttcactctgattcctttgcttaagtatgtcatcatcgtcttgagtgctgatgataacggcgaaggtggaccattcgctctctattcgctcctttgcaggcatgcaaaactcagcttgctgccaaatcaacaagcagctgatgaggagctatcttcatactatagaaatgggttcgcgcctcgcaatggatcttcaccttggtcaagaaggtttctggagaagcacaaaaaaatgaggactctgtttcttctcatagttctctgtggcgctagcatggtgattggtgatggtgtccttaccccagcaatctcagtactctcgtctatgtctggattacacgttcgagctactggtctacatcatagttctgtagttctcctttcatgcattgtgttggttggtctatttgcattgcaacaccgaggtactcagaaggttgcattcatgtttgcaccaattgtcatcatctggctgctttccattggaggaattggtttatacaacattcttcattggaacccaaatgtatatcaagctctctctccatattatatggttaagttctttagaaagacaggtaaagatggatggattgctttaggagggatccttctttctatgacaggcagtgaggcaatgtttgctgaccttggtcactttacgagtgcatctgtcagggtggcttttattaccgtcatatacccatgccttatgctacaatatatgggtcatgctgcatttctgtcgaagaacacatttcacatgccgacaggtttttatgatactatcccagaaccagtgttttggcctgtctttgtggtggccacacttgctgctgttgttggtagccaagctgttatttcagcaacattctccattgtgaaacaatgccatgctttgggatgtttcccgcgagtgaaggttgtccacacatcgaggtggatctatgggcagatatatattccagaaataaattggattcttatggttctttgcgtcgctgtcactattgcatttcgtgatactactcttattggcaatgcctacggtattgcatgcatgactgttatgcttgttactacattcttgatggcattaatagtcatctttgtttggcaaaggaacataatattttccctagttttcctggttttctttggatccattgaagctgtatatctttcgtcatctctcatgaaggttcctcagggaggatgggtgcctcttgtgcttgcattcatattcatgtcagtcatgtacatctggcactatgggtcaaggaggaagtaccagtttgacctacagaacaaagtatcaatgagatccatcctatctctcggtccaagccttggcatagttcgggttcctggtgttggattgatttacacagagctggtcactggtgtaccctccatcttctcccattttgtcacgaatctccctgccttccatgaagttctagtctttctctgtgtgaagtcagtgccagtgccatatgtttcaccagatgagcgataccttgtgggtaggattggacctaaagaatatcggatgtaccgttgcattgttagatatggttacaaagatgtgcagagagatgatgacaattttgagaacatgttagttatgagcatcgcaaagtttattatgatggaagcagaagatgcttcttcagcaagttatgatatcgctaacgaaggaaggatggcggtcataacaaccactgatgcctctggcagcccattggccatgagggatttcgacggcctagctgactccatgtctacgaggagcagtaaatcagaaagccttcgaagtttgcaatcctcctacgagcaagaatccccgagtgtaaaccggcgccgccgtgtccgctttgaggtcccagaggaggatggcatgggtcagcaagtgaaagaagaactcacggcactagttgaagcgaaacatgctgggatcgcatacatcatggggcattcttatatcaaagccaggaggaactcaagtttcctgaagaagtttgctattgatgttggttactctttcctccggaagaactgcagaggcccatcagtcacgctgcacattccacacattagtctgatagaagtcggcatgatctactatgtttagcttaatgcccattgccaaagctcacatgtggatacccggtcgggacaatgcttgtgctgtctgcggattgtggtgtggaaggagttcaggcttgttcgttctgggccaagtttcagcttgtagagaagaaggcagacttctttgttaatattatttttagcctaaataaaccagcacaatgttagacggtgatgtttctcatttggcatatttgcatgcatgctctgtaattttttctgcgagctatgtgatggaaatatatgcatcatctttata

SEQ ID NO: 48 - DNA, 2395 bp, Zea mays
acagtcccacaccacaccacgcagtgccgtgccgcactgctgtcctgcaatctcccataaactcactcgcctcgcctcgcctcgcctcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcaggatgttcgggcgggacccctggggcgggcctctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcgcagcgatccggtccgctgccgaagcacaacggcgtcagctggaggggcaattcctgcatgaaggatggcctctccgacagcaccgtccgccggagcttggtcggaggcttctacgatgcgggggacgccatcaagttcaactaccccatggcctggtccatgaccatgctcagctggagtgtgatcgagtacagggcgaagtatgaggccatcggtgagctcgaccatatcaaggagctgatcaagtggggaacagactacatcctcaaaaccttcaattcatctgctgacacgatagacaggattgtcgctcaggtgggtgtaggtgacacctctaaaggcagcagtcagcctaatgaccattactgctggatgagaccagaggacatcgactacaaaaggccagtcaccgagtgtcactcttgctcagatctagcgtctgaaatggctgctgccctggctgcagcttccatagtgttcaaggacagcaaaacctactccgacaagctcgtcaaaggcgcaaaagccctgtacaagttcggaaggctgcagcgcgggcgatacagccccaatgggtctgaccaggcaatcttctacaattccaccagctactgggatgagtttgtgtggggtggtgcgtggatgtactttgccacagggaacaattcatacctcacggtcgccactgccccaggaatggcgaagcatgctggagcctactggtttggaagtccaaactatggagtatttacctgggatgacaaacttccaggagctcaggttcttctcagcaggttgcgactcttcctaagtccagggtacccttacgaagaaatactgaggacattccacaaccaaaccgacaatgttatgtgctcatatctgcctctattcaattcattcaacttcactaaaggaggactaatacaactcaaccatggaaggcctcagccacttcagtatgctgtcaacgcagctttccttgcttctctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgattcctccgatgttcccaacacccccgccgccgccatcagcatggaaaccatagaggcaatacctctgaatgtttttccaaagcatcgaacagggaagtggagcaaacgtgtgatcatttggtacagcgaaggccagagacaggaaagctgacagcataagtttatagagcttctatttctgtaccaatatgacagatcagtataagatcctctgtcagacatagatcggaagctgtgtgcatcgcgtggagctaatttttgggggtcttgttgctattggcactccagctcatgtgtgaagttctttttgtagaaatggt

SEQ ID NO: 49 - DNA, 1168 bp, Zea mays
actctaaccgtttggacccagccagctcatgagctcacatgcctaggcgtgaggcgtatcgtcttcgacccttcgccttcctcgtccctttctctctcccagattctgactccgtcgggctcccccgtgtctgtgtcttggtaaacatcggtctctccccatcccacctggcagttgccatctcgcaaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccaggctccgccgacgccgccaagcccctgcgcaagcccgtcttcaccaccgtcgaccagcttcgcccccagacacacggtcacactctcacagcccgcgtcattgccgtccgcaccgtcctcgacaagccctccacgcacctcggccgcacccgcgtcgccgagtgcctcgtcggagacagcaccggcaccgtcctcgtcaccgcccgcaacgaacaggttgaccttttgaagccagatacaacagtgatcttccgcaatgccaagattgatatgttcaagggcaccatgagactggcggtggacaagtggggccggattgaggtgactgattcttctgttttcaaggtgaatgaagacaacaacatgtcactggtggagtacgagctggtggatgtggatgaagaggagtgagctgaagcgatattgcattgccatctgttgggccaagtcgtgctgcggatatgtatttccagctaaaggagggcggtagcgtttaggcttctatctagttatttattattattattatcctggaaggctggcgattgggacggttagttttaagaccatcctaaagaagcacgtcaaattatgtacatcagcattaggtgttctgtctgactgatgctttctgttccgcgacgccgaagtctatcctaatgctactacttttttccctctcacgttgggttgggtgtgtgtgtgtgttgttaatcctttttgacctgtagttttggtagattaaaatctagattctcttagaaaccttaaaaaatcttataaataaaaacatatttcagagtatt

SEQ ID NO: 50 - DNA, 1308 bp, Zea mays
aaggctcatgaaactttcgacccattggaggcccacgacctctccgtccgatccctaggcggcggatccttcctccaccaaacccgcacctgccgcaactgaatcgggtcagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttgtggaactgtcaacagggtcacaatcttgactgacaagtttggacagccaaaaggttttgcttatgttgaatttctggaacaggaaggtgttcaggaagctcttaacttgaatgaatctgaattgcatggtcgccagattaaggtcgcgccaaagaggactaatgttcctgggatgaagcagcgtccaccacgtggatataatccataccatggctacccttatagatcatacggggcaccgtatttccccccatatggttatgggagggctcctagattccgccgccctatgcgctacagaccttacttctgaagtacggggtagggtaatgaagttcaatgcaaaaccagcccatggtcactggtcagtcccgggaataattaactgtatcgtttgcactgttgcggctcaatgctcctgtatcagctgccttttctgacctttgtttcaagtgccgccataagcgacggacatgttgtattggcttgtaatacaggacgtagtaagtgcacacactttctgtaagcgtgctttcccacttcccagggttactactgtttgcaatttctgtagttctttgggtcggtcggttaggacatgggagtggatcgttctatgcccatttgaggtagattagttatatgaagagaaagcttcgcatgcggggctgtcttgtttgcagattgccactacctcagtacggttccaggttcctcaaggtatccgctgagcatctgttctggtgtcggattccgagttcaggtcttgtaactaataaaaaacggaaattataatgtctctctttaccagactgttttaccgcgggcaaa

SEQ ID NO: 51 - DNA, 3124 bp, Zea mays
cggtgggcggtggcagtggcacctgcttccactggagtggagggaaagcaccgaaaggcgcggctttttttacctctctctcgctttgcttgccccttcttttcacttccctccctccctccctttcctctcctccccgctccatggcccccgcggcgccagcgggcctggcctccgtcgcggtcgcggtcgcggttgccgtgctcgccgccgcggcgtcggcggccgtcacctacgaccgcaaggccgtcgtggtgaacggccagcgccggatcctgatgtccggctccatccactacccaaggagcgtccccgagatgtggccggatctgatacagaaggccaaggacggcggcctcgacgtcgtgcagacgtacgtcttctggaacggccatgagccctcccgtcgacagtactacttcgagggtcggtatgatctggtgcacttcatcaagctggtgaagcaggccggactctacgtgcacctccgcattggcccctacgtctgcgccgagtggaatttcggtggtttccctgtttggctcaagtatgtcccgggcattagctttaggactgataatgaaccgttcaaggctgagatgcagaatttcaccacaaagatcgttgacatgatgaagtccgaagggctctttgaatggcagggagggccaataattctttcccagattgagaatgaatttgggcccttggagtgggatcagggagagcccgccaaggcctatgcgtcatgggcagctaacatggcggttgcgctcaacacaagtgttccatgggtcatgtgcaaagaagatgatgccccggatccaattattaatacttgcaatggattttattgtgactggttctccccaaacaaacctcacaagcctacaatgtggactgaggcttggacatcttggtatacaggatttggtattccagttccacatagaccagtagaggatctagcatatggtgtggccaagtttattcagaagggtggctcttttgttaattattacatgtatcatggtggaacaaattttgggcgcacagctggtggtccattcattgcaactagctacgactatgatgctcctattgatgaatatggtttgctgagagaaccgaaatggggtcacttgaaggagttgcataaagctatcaagctttgtgaaccagcattggttgcaggagacccaattgtaacttcacttggcaatgctcagcaggcatctgtttttagatcaagcaccgatgcctgtgtggccttccttgagaacaaggataaagtatcttatgctagggtatcattcaatggaatgcattatgatctacctccctggtccataagtattctcccagactgcaaaacaacagtctacaacaccgccagcgttggaagtcagatttcacaaatgaaaatggaatgggctggaggattcacatggcaatcatacaatgaggatataaactccttgggtgacgaatcatttgcaacagttggattactggaacagataaatgtgacaagggataacacagactacttatggtatacaacatacgttgatattgctcaggatgagcagtttctcagcaatgggaagaatcctatgctaactgttatgtcagctggtcatgctttgcatattttcgttaatggacaactaacagggactgtgtatggaagcgtagaagatccaaaattgacatatagtggaaatgtgaaactttggtcaggcagtaacactatttcatgcttaagtatagcagttggtctcccgaatgtgggagaacattttgagacttggaatgctggaattctaggtcctgtgacactggatggcctaaatgagggaagaagagatctcacatggcagaaatggacctataaggttggtctgaaaggtgaggctttgagtcttcattcacttagtggcagctcttcagtagagtggggagaacctgttcagaagcagcctctgtcatggtacaaggctttcttcaatgcacctgatggtgatgagccattagctttggatatgagtagcatgggtaaaggtcaaatctggataaatggacaaggtattggaaggtactggcctggctacaaagcttctggaacctgtgggatctgtgattaccgtggagagtatgatgaaaagaagtgccaaaccaactgtggtgactcttctcagagatggtaccatgttcctcgttcatggcttaatccgacggggaaccttttggtgatatttgaggagtggggcggtgatcctaccggaatttcgatggtgaaaagaatagcagggagtatctgcgctgatgtctccgaatggcagccatcgatggcaaactggcgaacaaaaggctatgagaaagccaaggtccacctccagtgtgatcatggacggaaaatgactcacataaaatttgccagctttggcacaccacagggctcctgcgggagctactctgaaggcggttgccatgcacacaagtcatacgacatattttggaagagctgcattggtcaagagcgctgtggggtaagcgtggttccagatgcatttggtggagatccatgccctgggactatgaaaagagccgttgttgaggctatatgcggctgagtcatatgatccatataacgtactggtttctacaataatgttaccctatatcaagctggcaagaggtgaaagtggcggcaactgcgacacacggattgccagggtttacaggaattagttgtatgttagatttaagcatcgtatgtgtatgtaacttaggtcacatgagacttgcatggaagaagtggttaggaccctagctgtgagaaactaagtcttgtagctctctacacagtagaattggtctggcaggtgagggtgcagatgagactctgctttattacctgagtccatgtgcgcggtggctcttgggttggagattgccaaaaggccagcaattggctttgcattatctggtcattcatttttttggtcattggagggtgcaatgtaaatgttcagggtcaatcatttatgaatttttctagctagtaatgaaacagtaaagaaaatgttggttcagattataaaacaccagttatcttcca

SEQ ID NO: 52 - DNA, 1179 bp, Zea mays
cagcgccgcacgaatctcggcgcggtccgcgcctgcatcttctccctcgttatccgctgggtcactcgctcgtcgctcccaagtcccaccaagctgtcccccgaccactccgccgcccgctccaatggcggcgccggccagctcctcatgcttccacccacgcgcgaccgccagcccgccgtcttctctcagcgtcggcaccaaggtcttcgtcgggctcagggcgcagaccaagctcggttcgtcggagtcgtcatgcccgaatgtcagcgctgggttccacactgcggtcaaccggagaatctctctcaggttgtccaaaaagaaggcgaccagagcccgcatctcgatgatgcctattggtactccacgtgtgccttaccgaacacctggtgaaggaacctggcaatggcttgacatatggaacgctctgtaccgtgagcggattatcttcattggggacaatatagatgaagaattcagcaaccaagtgttggcaagcatgctctatcttgacagcattgataattccaaaaagataatgctatacattaatggaccaggaggagatcttactccgtgtatggcactatatgataccatgctaagtctaaaaagtcctattggcactcactgcttgggctttgcattcaacctggcaggattcatccttgcagccggtgaaaagggttcacgcactggtatgcctctatgccggatttcactccaatcacctgccggagcagctcgaggacaggctgacgatatagaaaacgaagcaaacgagcttatccgcatcaagaactatctctatggcaagctcgcggggcacacaggccattctgtcgagaagatccatgaggacctgtctagggtgaagcgcttcgacgccgaaggggctctcgagtacgggatcatcgaccgtattgtcaggccgtctaggatcaagaaagagggctccactgctcaaaggagggacatgcggaatctgggacttggctaataatagacgatcgaaatcctgttgtatcagaattttttgtgcaagggatgcgcttattatgggagagcgagcgatgcactgttccaagctctacgccggcgtaggtgttttgttgtgtcagctgtgcttttgctaactgtcagcactactattataatatatttgctgggattgtt

SEQ ID NO: 53 - DNA, 3439 bp, Zea mays
ggatggacagctcagggctgcgggctccggcgccggttcacatggtcgggggatgctgcgaggactgaagactttggatgggtgttgcgtgtgctcatcccaccgagcgagagggagagacgagtcagaaaggcccgcccgtgaagctccatcccgttcttgcccagtgttcatcaggtgcagcttgcgcggatccccctcatgaactgagcaatcgatagaagaaacaaaaagggccatttccgctacagaaaataaatcatcaggaatgggaaaacgaggccacaggcggtctgcatcacaagacgacgacaatgtgggctgtgtgtggggcctcatgcgcatgctttacttccgccgagaccccaaacttttgctggatgcgaagcagttgagtgggaggcatgcgttccgggaggtcagcgggagggggcattcagcaaagaggccaaatgattttgacgggatagaagaagatggtaacatagaagatcgcactttgcagaaaccgacagtaaaaaaccttatggaggatgaattggaaaaattaatgctgctgaagaaatttccaaatgatgaggttcagagaagaaaagccgacctgggaattgatgtctctcttgatacgatttcagagcatacaaataaatcaacagataactcatatcaccaggcaggaatctctacgccttcaactccatcaatggattatggggttttgaattatactgaagaatataatcttgaatctgtgctggtgaattttctaggtgaaatatatagttgtcacaatgaatgcccacacagtgattgcaagaacaagaatgaattgtgtccttcactgaagtccctaatccataaaaaggtcaatgaattgaataatcttccccacaatattggccgtgggcaatctcaagagggcagtgatgctaagccatctgaccaaaataatctttataacaccatggcagcccaatccaaacaattcaaggatgcattggaaatactgggttcgaacagtgaactttttgtgaagctgcttcagaagccaaatcaacatatagctgatagtatccaacagcatgaaaacagtaaggtgtctgctggattagagcctgacaaaattcatggacagaccaattttgttggaggaagaggaagctcaaaacagcatcctttggctacaaaagagcaggctaaagagagaaaatatatgttcttctggaggaagagtaaatcaaatagaaggcagatgcttgacgcaacagatggagctcagactgttagcaaaattgttattctgaagccaaatccagaaagagggattaatcagaaagcagctactgcaagaactttacatcaacagccatgtacatcgaatgctcctggatgcagtggaagggaaaactcaaagttttcaattaaggaagtcaagaaaagattcagatttgtgactggtgagagaagtgaaagaaatttgtcacctgcagaggaccttcaaggagacccacgtaagatcaaagattctgttgttgcaattaataaatattttagacatctccctgaagggagcttggcaaacaagtctgcatcagacattgagaatggcatcaaaccttttatcagcagtaagcaaaagaatcaaaatgggagcataactgaaatcagtggccatatagtagcaccaaaaggtgcatctgtattttatgaagaggccaggaggcatttatcagagatgctaaaaggtaatgactgttccataaactatccagaagttcaaatatcaaaatccttggaaggcatactttctcttcctcatggcaatgtgtcaaccactgggagtagcctgaggggaaaggattaccttgacccctcacctggagaaacagatgtttacgatgcatgtgaggttgagagagaagaatgcacacaagagagaagccaatcacaagaggattttggaagcattgctcactgtacttgcacaacagttgatgatcaggtgacagttcgagaaggatattacacgaatgaagcacaagaaggaccaagacatgctcatgatgagccagacactctgtatattgaaggacttgataaattcatttgccgcgaaaacattcgcaacgaagagtccagtccagcagaacaaagcagagacgatatacgtcaagagatactagaagaaataaatcagggaaaagagcatgttaaaatgtccctagcttctgttgagggcatagatgaaaagttggggcagcaagagccagaaacaccggaaccaagagcatcagccaaattaatctcagacggttctcctaatcaaagcgatgaaaagcaagagaggcccagtccagtatctgttcttgagtcatccttcgaagatattggcagtccagactgcataaacaagaaagagtgtgagctgcatggtctccaaaggaccctgtattttccagataatgaaccagacgttaatgtcctttgggaggacaagaatgtcaggttggactacataaagctggtgctagaactctcagaactgtgcgcagaacaaaatctagaggtatggtacctagaagacgagttgatcagcccctgcttgtttgaagaactacagagccagggtgatcagacggatgatcgaatgcttctgtttgactgtatctgtgaagctctaacagagatccaagagagatattttagactctcctcttggctaacttttctaaaacacgacatacggacacctccgacaggagagaacctaatcacagaagttgataggtacgttaacgggtatattatccagtacagtcttccaagtactctagagcagacaattaaaagggatctggaagttcagacgtggatgaacattagatcgaaaaccgaagggattattatggagatgtgggagtttgtattggatgagttgatagatgagactgtctccgatttgtggatttgaagttctgattaggcttcgtccatggtgcctctgtggcgagcatagtgagtaggatacaggagttctttcgtgctgaaaaataaccagttctatgcggcagaatagcatgggctaccgctagccaagtgtgtaactgcagtggagatcgttctcgtgtagtcgtgtggaggagaacagaagtctaggttcagcagatctccagagctgtgaagtttgcgtggatgaagttgggcacggtttgtctcacagccatgcctctgcacggcgaagtgtacagcagtctgaagcgcattgcgattttcctctttgcccgttgagatttgggagcttgtgtgtgcatgtgtgatgcgtgcacttttcagcgtgatcagatcgcgcttgtttttttataggtttgttttgtgtgtaaatgtgaaaaaaagagagaaagcaaacatacatgattaatcaaatgacatgttttatgta

SEQ ID NO: 54 - DNA, 3766 bp, Zea mays
attcgatttctacacctccagagcactcactctcctggcaaaccccttcgtctcccaaccctagagagcagcagcagctaccgcagcccctgccatggcgccgagctccccgtcacccgccgcgcccacacgcgtctctgggcggaagcgcgccgccaaggccgaggagatccaccagaacaaggaggaggaggaggaggaggaggaggtcgtggcggcgtcctccgccaagcgcagccgcaaggcggcatcttctgggaagaagcccaagtcgccccccaagcaggccaagccggggaggaagaagaagggggatgccgagatgaaggagcccgtggaggacgacgtgtgcgccgaggagcccgacgaggaggagttggccatgggcgaggaggaggccgaggagcaggccatgcgggaggaggtggttgcggtcgcggcggggtcacccgggaagaagagggtggggagaaggaacgccgccgccgccgccggcgaccacgagccggagttcatcggcagccctgttgccgcggacgaggcgcgcagcaactggcccaagcgctacggccgcagcactgccgcaaagaaaccggatgaggaggaagagctcaaggccagatgtcactaccggagcgctaaggtggacaacgtcgtctactgccttggggatgacgtctatgtcaaggctggagaaaacgaggcagattacattggccgcattactgaattttttgaggggactgaccagtgtcactattttacttgccgttggttcttccgagcagaggacacggttatcaattctttggtgtccataagtgtggatggccacaagcatgaccctagacgtgtttttctttctgaggaaaagaacgacaatgtgcttgattgcattatctccaaggtcaagatagtccatgttgatccaaatatggatccaaaagccaaggctcagctgatagagagttgcgacctatactatgacatgtcttactctgttgcatattctacatttgctaatatctcgtctgaaaatgggcagtcagacagtgataccgcttcgggtatttcttctgatgatgtggatctggagacgtcatctagtatgccaacgaggacagcaacccttcttgatctgtattctggctgtgggggcatgtctactggtctttgcttgggtgcagctctttctggcttgaaacttgaaactcgatgggctgttgatttcaacagttttgcgtgccaaagtttaaaatataatcatccacagactgaggtgcgaaatgagaaagccgatgagtttcttgccctccttaaggaatgggcagttctatgcaaaaaatatgtccaagatgtggattcaaatttagcaagctcagaggatcaagcggatgaagacagccctcttgacaaggacgaatttgttgtagagaagcttgtcgggatatgttatggtggcagtgacagggaaaatggcatctattttaaggtccagtgggaaggatacggccctgaggaggatacatgggaaccgattgataacttgagtgactgcccgcagaaaattagagattttgtacaagaagggcacaaaagaaagattctcccactgcctggtgatgttgatgtcatttgtggaggcccaccatgccaaggtatcagtgggtttaatcggtacagaaaccgtgatgagccactcaaagatgagaaaaacaaacaaatggtgactttcatggatattgtggcgtacttgaagcccaagtatgttctcatggaaaatgtggtggacatactcaaatttgcggatggttacctaggaaaatatgctttgagctgccttgttgctatgaagtaccaagcgcggcttggaatgatggtggctggttgctatggtctgccacagttcaggatgcgtgtgttcctctggggtgctctttcttccatggtgctccctaagtatcctctgcccacctatgatgttgtagtacgtggaggagcccctaatgccttttcgcaatgtatggttgcatatgacgagacacaaaaaccatccctgaaaaaagccttgcttcttggcgatgcaatttcagatttaccaaaggttcaaaatcaccagcctaacgatgtgatggagtatggtggttcccccaagaccgaattccagcgctacattcgactcagtcgtaaagacatgttggattggtccttcggtgagggggctggtccagatgaaggcaagctcttggatcaccagcctttacggcttaacaacgatgattatgagcgggttcaacagattcctgtcaagaagggagccaacttccgcgacctaaagggcgtgagggttggagcaaacaatattgttgagtgggatccagaaatcgagcgtgtgaaactttcatctgggaaaccactggttcctgactatgcaatgtcattcatcaagggcaaatcactcaagccgtttgggcgcctgtggtgggacgagacagttcctacagttgtaaccagagcagagcctcacaaccaggttataattcatccgactcaagcaagggtcctcactatccgggagaacgcaaggttacagggcttccccgattactaccgattgtttggcccgatcaaggagaagtacattcaagtcgggaacgcagtggctgtccctgttgcccgggcactgggctactgtctggggcaagcctacctgggtgaatctgaggggagtgaccctctgtaccagctgcctccaagtttcacctctgttggaggacgcactgcggggcaggcgagggcctctcctgttggcacccctgcaggggaggtagttgagcagtaaaaggatgacagatctgagctgagctgggcaacatccagcggcaggagcatttctggttcggttcgattcgggctcacgagcgcattgtgctgattcgcagggtgcactcgagctcgagtgcggagttgttgtaatgtaggttgaggtttcaaaacatccatccatccatcggccccgcctatttgtggatggtgtttctcgtgccattttagttcagctgtattgatgcttcgtcatgtatgtgtattgtaccattcgttcttgttacctactggtaaggcaacatttgatccatgttcaacgcgagcaaaattcggtaacatttacaacctattattttgcctggtattatctgaaaacgatttgctgaggatgttttttttttgaagtaaaggtactgtaggaaggtcctacagtaatattattaaatcaaaagaactaagtttagggagacagaagaatattacaaagaaataaaagggagagtgaggagggggaagaattctggatacatgtatttactctatttcacataaacatatggacatcaacatagatgtgaaggtatctaatctaaataagcgccgacatgctttacaagatagtttgatctataaggtgagggatgttgtggatgaagattgtgaccaactagctcatgtgtagttttgtttgtagtacctgtcctaaaaaatatgtaattctaagtttaatttgaatcagccttgttttttaaaatttttttgaccaagtccgttaaaaagtaataacattttttacttcaaatagatttactatgaaattttgtcttatggttatctaatgacatttatttaaaactgtaacaaaaactggtttggttaggggactgagggagtagtgcttaaaatggaagacgataggagagatcacattagtggtggc

SEQ ID NO: 55 - DNA, 817 bp, Zea mays
gacgagactctgcgcgcgcacaagcccacaggagtgcagaattgaccgcgcgcacgacgacgacgaccaccaacagcaacaggagagaggaggagatcgataagggatggagggcggcgagacgacgctgtccgggttcggcggtgccggggcccccggcgtggacaccaaggtgctgcacgcgttccagaccagcttcgtgcaggtgcagacgctgctggaccagaaccgcctcctgatcaacgagatcaaccacaaccacgagtccaaggtgcccggcgacctctcccgcaacgtgggcctcatcagggagctcaacaacaacatccgccgcgtcgtcgacctctacgccgacctctcctcgctcttcgccgcggccgacggcggcggcggccgcgccgcgtccgagggcgggtccgtgggcaccgtccgccaccaggcgggcgccggccacaagaggatcaggtccggcctcgactgatttgttgccaggcatttcttcttcgcagagaaaaggagtagcagtactaagtacagtagctagccacgtaccaccagccgcagcgaaaccacctcccttttgtcttctgacttgagctcttcttgtatctatcgacatacgctatatatctatctatctatttatatgtctccattacgactgttaccatattcttgttgctaagagctactactacttagtatgcgattagtctgtattttcgatgcaatgcaattcatggacgatgcacgcaacatacagggtgaacttgtctgaattcccagagaaacatatactacactgaagtttgctgtg

SEQ ID NO: 56 - DNA, 3151 bp, Zea mays
cgatgccggcggctttaagttttttttactactagtatacttgaccggcaggagtaacaatggaggaaggatgcccgtgattaagatttaactcgcttcgaggcagccagcgctggtgtcgcccaccggtcactgtccagggcccattaatgtcctcctgcaggagcagggctgctgactgcgtagatgagagatcaatctctggcgcactggggcgctctcgctcctcccctccgctgatgggtccattcttgcctgccccggctgcttgcttggtgccgaggaagaacggggaggagaaggttgggggggttcttggatgcattcacggcgttcaggctatgaactaagctgagcagcttcttgcgttttaattgagctctcttgttcttgctcccgcgtcccctgcatttcaggaaactgatatcggggagcaagcaaggcaaggtttctctcggaagaagcattacagtgccccacttcggcctttctgatttatttgctttgctagtcctcgttaaagttctgaccattttggtggcttggaagtgataaagtttaccaattcactaagccaattgagaaaggatagtgctaactgagctccaatggcttggcaccttgatatccttgtcatggtcactacttgtttgatttttttctcaataagcgagcaatcttcacagagcgagctgctgcagcagctcaggaagcagctggagtaccctaggcagctggaggcttggggcagcccaagcagcgatccctgctacactcaacccactgcagtgcttgcggtcacgtgtgaggaaaatgccatcagagagcttaagataatcggtgacaggatcaccaaaccgccaaagttcagtggcttttctgttcctaatgtcaccctctcagaagcctttgttttggattcgtttgttactacgctggcaaggctaactaccctaagagttgtcatcctggtgtctttgggcctatggggtcccctcccagataagatccaccgtttatcttcactggaagtgcttgatttgagctccaattttctctatggatcgatccctcccaagctgtcagtcatgtcgaagctccatactgtgacactggatggtaactacttcaatggaagtgtgccagactggcttgactcattctcgaacctcactgttcttcggttgcagagtaaccagctgaaggggtccataccggcatcgattggcaaagctgccatgcttacggagctcgcgcttgccggcaatagcatctcgggggatgttccaaatttagtcaacctaaataagcttgagatgctggatttaagggacaacaagttggatggagagcttcctgagatgcctacatcagtggtaacaatcttacttagtaaaaattcactaaagggtgaaattcctgagcagtttggtcagttgaaccggcttcagcaccttgatgtctcgttcaacttccttgtggggagtcctcccgcagagctgtttgctctccctaacatcagttatctgaatttggcggcaaatatgcttagtggttcattgttaagtagtttaacatgcagcagcaccctgggatttgtggatttgtccactaaccgactcacaggcgatctgcccagctgtctgaacggtaatttgaataacaaggtcgttaagtttgatgggaattgctttagagttgaccctgcccaccagcatgaagataaatattgccaacaatctcataatgggagaggatcaaaaaaggatgttggacttgtagtcactgttgttggcatattgtttgttattcttgtgctttctctgttgttaatggcttccaacaaaagaagctgtcagaaagttctggccgaacaacagatccagcaaaagcatacacaagataatttgttgtcaggaatgtcgtctgaactgctggtgaatgcaaggtgcatatctcaagctgtcaagttaggaacacaaatacaaccgtcatatcacatattttctttagaagaactcaaggaagcaacaaagagctttgaaaggtcagcatttttaggcgagggagcaattggaaagctgtacaagggaaggttagagaatgcaaccctgattgccataagatgtttgccattgcaccagcgatattcaattaggaatctaaagcttcgtttagatctccttgcaaagcttcgtcatccaaatttggtttgcttattggggcactgcattgatagtgcggttgatgaatcaactgtgaagagggttttccttgtgtatgaatatgtgcctggtggaactctttcttcttatctttctgcctgcagtccagacaagactctgaaatggtgtgataggctgcaagtgctgattgccattgctaaggctgttcatttcctacatacaggaataattcctggttccttatccaatcggctaaaatcttccagtattttggttgacgaacaccatacggcaaagttgagtgactatggattatctataatcacagaggagatatacagacatgaggtaataggacaaaaggaaaaatacttgcaaaatgatgctacagaaatggaaaatttggaggatgatgtatgctcttttggttatattctactggaagtacttatgggcccaaaattacatgagaaaggtggccctttcattttgaaagatctggttgtgtcaatgtctactttggaagagcgcgatcaagttgtggatcctgtcatcattggcacttgttcacaggattcgttatccatcgtggtttcaattatgataaaatgcctgtccatcgaatgctcggctcgaccttccatggaagaagttctctggaacctgcaatatgctgcccaggtccagacaatggcggacagcgaccaacgatcagaagtttcctcacaagcttgttagcatggaaactggaaatagctcgaaactgtaatctagatcggatcaaagatgataggaagcaagaatcatgtttatatgatcttgatttgagaacaggggatgaccggatgagtgagctcggctaactgttgcttcatggctatcctgaatttgatctctccattgcaactgtttgctgctacatccaaatcaggttccttgtaaaataaatagtccaattcccacaa

SEQ ID NO: 57 - DNA, 1503 bp, Zea mays
ctttggcgccagcatctggtaacagtagtttccgttgctatataaagggaaggtaaggcaggagtgtgagggcaggctaaccgaggagctagctagccagcaacgcgtagcaagcagcgcaagcaaagctccgagcgcccggccggctagcttcgccatgaacatgggtggaaggtccccggcggcgacgacgatccggtgcaagtactgcagcgcgagcctgaccgtgtgcgccggcgagcgcgccatccagtgcgcgcaatgctgcggcgtgactcgcatccggcggtcgctgtcctcgcggctcccgctgccggcgctgacgaggccggcttccgtcgcgggcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgtttatacgtgtcgagtttatta

SEQ ID NO: 58 - DNA, 764 bp, Zea mays
ggagcagcccacaggccacaacgattctcgtcggtcgttctgtgccctatccgtcgtcggctatcgcaacagcagcgcctcttccctgtcgccctgactcctccctagcagcagaaaaccggcggcaagtcttcggtggcggcgagggaaggccaaggctttgcctgagagaatgcaagacccaagggatgatgatttcttggcgccaaagttgcataagaagaaggttgtctaccggccgcagccatcaggccatctgaagggtgaacctgaactgttgcggagagagtttccgcaatcatcaggcatggtccaaaagccacccaaaagaagcttgaagggtgagcctcgcacgcccccttccgacagggggaccccggattccctgccggaatctggtcctaccgacgaataccgtgcgttaaggaggaagtacctgatgctggaggaagagaactttgcactggacaaagaactgagcatggaagatgaagaaatgaaggccctagaggatgaaaagcttgcactgcttgatcagcttgttgtcttggaaggccttgtcgagccatcccagttgcagtctcaacctaggccgtaaggtgttttggtttatgtataatcgttgtcgttcattataattcagctactagtagctgttatactatctgggcttaaacagtgtgtagaaacagcatagtagacctgttacttctatcggacatcgacgaataaaaaaaactcttatgactgtttgcagggttgac

SEQ ID NO: 59 - DNA, 2821 bp, Zea mays
gccctccttccccccgctcctgtgcgcgttgtttctcgtcgccgtcgtccgtcctccggcgtccggcaacctgcaaccggcgacgacgatggaggcggcgctgggggcgctgtgccgcgccggaggctggtcgtacgcggccgtctggcgcttccatccccaagaccctcgattgctcacattgggggactgctactgtgaagatgaggcaaaagcaatggttcagaagatgcttaatcttgttgaagttgttggagaaggcatcctaggacaagctctagtaagcggagagtgtcaatggatttacgacgatacttgccacgcgttgaatcagataagccatgctgataacggagatttacatcagggttatacttggtggcagcatcagtttctcagtgggatgaagactattgcagtgttacctcttcagttgcatggactggtgcaatttggttccacacggaaggttcccaggagctcagtttttttgaatcaggtcagagatatatttgatcggatgaagaatgcttcaagcgatggtccaatggagtatacccagaataactctcttgcatgcggtcagcaacctatccttacttcatcgagacctgtcaatgacatgctcgtacataacaaggtcaacccattgcaaactgagaaacttttggaggatatcgagagaacagaatctataaggagttcgatctgttctccaagcaattcacaaagatctttaaatgatctaacctcccatggtactggtaacagcagcatggatactaatatattagccatgcctgttaactccaagtctatatatgatctcaaacgatttgataacgtcacagagttgtttcatcgaagttctaatgacagaattggttttcaagtcagctctagtaaagagcctgattctaccattgctggtgtaatgtcagaatacaaaagtttgaacaatattcatatgacagaaaatgattcatgtggtcaaaacataggatataccccgtacctttacactaccaccaactcttcaaattctggccttgatgaactttcttattctggcgttgctttgtcgtcatcgtttacagcagtatcagggaaagttaaagattgcctgcaaactgagagtgacaagtttctatgtaaatctgtatcattcggcagcaacccttgtgcttctaaattccaagaaaatcgcctatcaccataccatgccctcatgcacgaacaatccctgatacctgaccctggagaatctgtgaggctcctctcacaagaagaatcctttattgttcaaggtgactcaagtcaattcaaggatactgccgactttacaggccagggtaacagtacatttcctgaattacctaacagatcacctgaagaagctactgctgaaactctagaaaacaacatgaaggactgtagtggaaacaacagtctgctggaaactatgatgcttgatcttagcaccaacagctttgtgcaagattggtgggacaacagtgttctactggcagaaaaccttccaaattcaagcgaaaaggacccagagcctgctatggaattggccaataggcattcattgccaactggggagagaggctcgcctttcatacctgtcatcgaacaattgctaggtgatgttgcacatccacctacacctaccggacatagttcacttgaggctgaagctactgctttagctggccgtgtttcagattatcagctgcctcagtttgctttccgagactgcctaacagtagacaacgcacaaatcccagcattggcctgcagtaattacacatgcagaactagaagtgcacaaaatggttcttcagaagtgccatcagcaaacgtatctgtggacgacacctgcagtttgaacacagcaaactccaatggcagtcagtcgagcaatcctgagggaacgaaggttgctaagagaagagctagagctggggagagtacccgacctagaccaaaagaccgacaactgatacaagatcgcgttaaagaattacgagagattgtccctaatggtgcaaagtgcagcattgatgctttgttggagcgaacaattaagcacatgctgtttctacaaagtgtaaacaaatatgcagagaaaattaagcaagctgatgaaccaaagataatcgacaaagggagcggtgttatcttgaaagacaacccagttgctggcacaaatggtggtgccacgtgggcctacgaggttgctggccaaactatggtttgcccaataatcattgaggatctttcaccacctggtcagatgcttgttgagatgctttgcgaggaacaagggctctttctggagatagctgacaacatacgtggaattggtctgacggtcttgaaaggacggatggagctctgtgatggcaagatatggtcgcggtttcttgtcgaggcaaacagagaggtcacaaggatggatatatttctgtcgcttgttcagttactggaacagaacagccttgttcgacctactgaccagatggccaaggtcatgaataatggggttccatcctttgcaaaccaccaacggtctccgctgctagttccagtgggcattcctgagagactacagtgacatgcagatgcttcaactagatagagttaggtaccacgactgttaacatatctggtagccagaactccatgcattagactgagcctagtgataacatctgaatgaagatagtctcactgctgctaaagatgactgtatcaagaacatgcatgactggtgcagacatgagcctctagcgcagaaattatgaactttccc

SEQ ID NO: 60 - DNA, 2834 bp, Zea mays
cactaacacaaacaggttgcactccactctcccacctccactgcgctgcccgcctgcctttataacgcggcgagcccagtgcggggaggcagagaacccaaggacgcgcctcgcctcgagatccactcggagggccaccgcgaccgctccggtcggttccggcgaggtgccgcgcggtcgtaagtcgtaacagcatacacagggcagacaaagctgcgattttgggggggctgttggtccagccgtggttgttggtggagataaaccacgtgaaggctggtgctctggtacatgttcgccaggcactgatggcatttggccgaggtggaaagatggacggccgccggccgtcctcatcgtcgtcgtcgtcgtcgttctgcacaaccaccacggtcgtgctctttgtggcgctctgcctagtcggcgcgtggatgatgacctcgtccactgtcttcccgctggagatttcgtccaataagaagccggtggtgaagcaacagcctgcgcctgtcaatttcggggcgtcgcaggaggcatcacctggcattgctggtgaagggtccgagaaatttgaggacaccgacaacaatgatgccacagtcccagaggaaccgaataaacaggatgcttctgagcaagagaatttcaatgagaagcctgaagagaaagagctggaagtgccggtagagaaagcggagaccaaggatatgtttgatgacgcaaatggaaaatcagaagggctgtcagatgaaacgaagaatgatgatggggagaagagtgtggagaagaaagacaatgaaatcacaaatgagagtggtgatgaaaaaactgatggtgagagtaaggacggtcaagaagagaagcctgatggcgatgccacccaggaggagcaacctaaaatagaggagaatgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggtgttgcaaccagctatacctggaaattatgtaatagtagtgcctcgacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaaggtggcatgcttttgctggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggaggaactgctaccacgtaggggtgaaattagaggaattttgtcttctagatatgcgtatggctcttgttggtgctgaaaggaccagaaaatatttggtgtaactgtagaacaatacatctgttttttctgccgtt

SEQ ID NO: 61 - DNA, 1610 bp, Zea mays
tttctctcgtcccaaaagcttgcttcgcgctttcgaaaaaccacaccaagtcgggaaggcagaggcacagggagggagccgacagccgagagcaccttccgattccgcccaagaaatctccacccaatctctctgtcctctcctcccttctcatcatttcgccatgctgccatcgcacctcaacggccactccgccctcgggcgccgtcgcccgcgcctctccgccgccgccggggagtctccggcggcagcgggggtagaggcggcggctccgctggaggagcacgaccgcatctacttccaggcctactcccatctcggcatccacgagactatgatcaaggaccgcgtaaggaccgatgcttaccatgcagcgatcatgcgccaccagaaatttatcgaggggaaggttgtgctggatgtggggtgtggtactggaatactctctgtgttctgtgctcgtgctggcgcaaagcgagtgtatgctgtcgaagcctgtgaaattgttgtccaggctcgtgaaattgtaaaagcaaacaacctaactgatcagattgtggtcatccatggacgtgttgaggatgttgaccttgaggaaaaggttgatgttataatatcagaatggatgggctatatgcttctctatgagagtatgctgccaagcgtcctatttgcaagagataaatggcttaagcccgggggtcttattcttccttctcatgctacgctcttcatggcccccgtaacaaatcgtgagagatatgaagacagcgtcgatttctggcgtgacgtctatggcataaacatgtctgctcttgtgccacttgccaaaaagtttacatctgaggaaccctccattgaaacaattggtggagagaatgttataagttggccatctgtgttcaagcgcttcgattgctataattttacagctgaggaattcaaatctatcacttcaaaatacaaagtttcatcaatgatgttagctcccattcatggctttggtttctggtttgaggtggagttcaacgagcctatagagtcctctcataattttccttccagtttggatccacttgagattatacagaagaaaaggagacgatcctcagaagatatagttctgtccacagccccagaggatgagccaacccactggcaacagaccattttgtatttcccggatcctatagaggtgaagcaggaccaaattatagaaggttctgtaacagtgtcccaaagcgaggagaatccacgttttctgaatattcatctagagtgcttcacaggaggacagacattggttaaggactgcgccatgcgatgaactggtgtttttatgcttctagtggcttgatttcaggcgcgcaatggggtgttggcagggaggagctgacaatatttcagatttctttaatggaagtggagaatttgtactatttatgccaattatccgtctaatacgaaggcaggattttagtaattgtactccgtcttattctatagagtatatactggttgttgattttggatccgcacgctgtgacctaagtctcgcatccaagggtccctttggaacaaaggaaacatgaaggatttttttatgatcc

SEQ ID NO: 62 - DNA, 1131 bp, Zea mays
atttctaagcaactgtatatacgctttctttgtagaaaggcgtatctatttgagtcgcttccgagcagacgtcctccttggataaggggataggcgcgaggaagagcggcctatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaacctccgggtgctcatgatcaagggggccgtgccagggaagcccgggaacctcctccgcataacgccggccaagatcgtcggcaagaacatccccaagaactagacttcttttttcaggggggtgaatgttgagtgtttgtgtttgttaccctgctacaaactggatgtaatcctttgccaatttccagtttttgaacacatgcaacttcagattagtaaaactataacctgtacaatttggatgcttgggtga

SEQ ID NO: 63 - DNA, 1259 bp, Zea mays
ccagtatacttctccctcaccgcccaccgacctaatcccctcctccactttccccaccgcgaagccatgtcggagcaccccgcgtcccgcagctccgtaggaagccgcagctccgcgctgccccctcaccagcagcgccttacgcctgcgcccgacccgctcgcctccgtctggatccgccgcctccacctctcccccaacccgccgccgccgccgcggcccccacccctgcacatccgcgcgccgccgcctgcacatcaggatgccatctccaccgacgagtcccacacgacgcctccgccgccgccgctcacgctgcgcggcaccgggttcggccccttccgctggagcccgcgcccgttgctgggggcgccggccggcgcatgggacgccgccgccgccgcttccgttggggtggctcctggcggtagtgccgtcggcggcgaccaaacgatgctgtcgccgttcttccgtctcccagcgccgctgccgtcagtcgtggattttgaggaggccatgcctttgaggccgttgatcgggctcggaagccacagcggcagtggtgggtttcctggactgtcacgacagatggtcggcggcggcgacccctgtgacggctggctgtcgtccagagttgcaggtgctgcatatcctggccatgctttggacatggttcccacaagaacccttaatgatctgcgtgacagacagcatggcgcaataccagcacaaccaaatctcgcaaggcatgatcctagctctagcagccaacgtgatgaacctttctcatactggaacatggggaggttccgaagaaatactgcaacttcgtcggtcacacctttgggtgccgctcctgccaatttcggcacgaagaggaacgctgactcgaacgatttcctccctctgaagctcaggaaactaagcggggctatttagtggctgatttatgaaaaatatctggccgaccgttttttgatatgcataagaagcacaagtatgctgttacctgaaacagcatgcagtaatacttaaccacgttagggcttcagaaggctggagatggacgcatttggtggtggcaaccattgtaaattgtacgtttgctcccaaatcgttgcatttggcatcctctgacccactggcctgcatgtttgtatattttttgtgtgatatacggggagatgtcttgtgccacgtttcctccgtggcgtgtacattcaaacaaattggcatcaaacatgtagtaattttcgttc

SEQ ID NO: 64 - DNA, 682 bp, Zea mays
cgttccgatcgccaattcgtcttccaccgcctgcaacccttcttcccttctccgtcatcgtgacggcatcacgcgcgcgctctcctctcccacgagtccgtcagcctgctaagtcttaagatggcgtcaagcaatggtcagacagaagctccagcaccatctgtccccaaaaatcccgctatggcatcatgccggaagaagaaaacagatgatgctaccttccttgaagatctgaaagaccacatggatgagttcattcatgcctctatggatgagcacaagacctgctttaagaagacaattcagaagatgtttgggatgtcgaaggctgttgcagagagatccgcggaagcaaacaaagctgaagttgaaagtgctttgccacttcagaccagtgtctcgcagtagaatttcatgttggtagtttcttgctcgtgccaatagttttataagggtttttgttgctgtgttttctgaaacgcataagcgtgtcagtagcatgttttcataaccggattgtagtgcttcattatctatagttttctgtacgtgtaaaatagaccagcgtaacagcgtagtttgcttcattctccgaagtcttgtatggctgtacacccaggcatctgggcatcatgaacccaactgattggctaaatgaaataaatctcctccatccaacagc

SEQ ID NO: 65 - DNA, 903 bp, Zea mays
ggaaacccagcggcggccgcgggcgccccaaacccagggcagagtcgcagggtgacggggagagcccatcatggcgccgcagcagccgtgaagcacaagagcttttctgcagcacgacggctttgtcctctctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgccgaccacccgcacgtcaaggtggagacgatggtggagagcggggacccgcgggacgtcatctgcgacgcagccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatggcgaccatataggcatatatgtacacacttcacatcccattgcatggcagtgtcttccctagttcaacaactagctttctgctggaataaggtgttcaga

SEQ ID NO: 66 - DNA, 2038 bp, Zea mays
ctcggatcctttgcccgtcccatggcaacgcctaggtggctgtggctgccatgatgggcgctctcgccacgccaccccgccaccccgccatgtgcgtgccgcttttgacagaagaggacgaggcagatctccagtccccggccctccgtcccctcctcctgcgaaggctcctccagcaccactagctagagctaaccccgtgctgctgctgctgctactacctgctgccgcgcgccgttcgttgccgtgcgggcgtgttgtggtccgctgatctcgttcgcgggacgccggggggtggtggtggtggcagcggtggttggtggtgcgcggcgtgaaagaaagaaagaaaaaaaaaaggcccgccgctttgcgctgctctgcttccgtaggtgtcacgagatttggccctagcctttcgctttcctttttcatctcgctcacaagggaagggaccgagggacgagggagacgttggggaggggagcgagcgagccgtaacatccgagctgttccaatggcgacccctgccgttgctttcgtcgccagcgctttgttggggcggtggtagcgctaggagcggagcagtactaggttggtaggtggttgtagctttgcgcgtgacccgagcgcgcgctcgctcgctcctgtgcctctctacctcgcttgcgtgcgccgggaaggcagtgggtggctggtcggttctcgcaagaggttgctggtgctgttcctcctcccccggttgatgagcatggggcattgctccgagcagcggacggggttcgaggtgactaaggactggaacggcgccgaccagttcgcgatccggtccccgcggggggcgtccgttcgggtctgcctgcacggcgggcaggtcgtctcgtggaggaaccaccgcggcgaggagctcctcttcagcagcagcaaggcaatcttcaagccgccaagagcgacccgtggtggcattccgatatgcttcccacagtttggaaactgtggaacattggagcagcatggatttgcaaggaacaagatatggacaatagacgatgaggctccacctctaaattatggtgataataacagcaacaaagcttctgttgaccttctgctaaagccatctgaagatgacctgaagtgctggccacactgttttgagttacgtctcagagtctctctttcaatggatggagacctttcactgatatcacgggtcagaaatgttaatgggaagccattcagtttcgcatttgcttaccatacatacctttctgtttctgacatcagtgaagtgaggatagaaggtctggagacccttgattatcttgacaaccttagccagcgggaacgttttaccgaacagggagatgccataacatttgaatcagaggttgatcgagtctatgttggctgcccaggcgtaatagctgttcttgaccatggaaagaaacgcacattcatcgtgcggaaagaagggcttcctgatattgttgtgtggaacccctgggagaagaagtccaagacgatggcagacttcggcgacgacgagtacaagcagatgctgtgcgtggatgcagccgcggtcgagagggccatcacgctgaagcccggggaggagtggacggggaagctggagctctccgccgtggcgtcgaccaactgcagcgaccacctggatcgcccgggcaggctgtagagcgctgggtgggtgggttcgttcgcccctgacgaaaggcatgtactagttttttttcatgtacatgggggcgctaggtccggcccttgcaggctgcagtatcatctacctgtcaggtgtgtcatgtgtgagtttaaacttatgtcagatccaagtattgctgtgatcgacatgttcgatgttcctggactgcgaagtctcaagcgcaggctgttcgtttggctggctttaatccgaaacggcatctatagattgtagctgcagttcgaagcgaacagtaatgaaaacggacggaacagttaggaaaacactccaatcacttttaaatctatattttaatctaaa

SEQ ID NO: 67 - DNA, 1573 bp, Zea mays
acgaaaaacaatctacggttgccaggtctgcgacgtcagtgccgacgaactcatggctcgcgagaggcccgtaaaaacatgatagccagatctgcgacgtcacggctgtcgccagtgatcgccattcgccaccctctccgttccattccaatccgttcagcggtcagcggaacatgatacggtctgcgcccttccaagcaatcacatcttcttccccgttataaatcgctcactcgctatcgtcggctacctgtatcctggcgacacccaacagcctgcttgccgcgcttgcattgaggggagttcggggagcggccggtgcggaaggaatcgacacagagttcagttcacatggctgctgaatcagagaacggcaactgcaaagcttgggcagcgagagatccttctggagttctctcaccacacagttttaaccgcagagcagtgcaaagcggcgatgtttcgctgaagatcatatactgtggagtctgttatgcagacgttgcttggacgcggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatggctaccctttggcgaaggcagcacctcttctgtgtgctggaataaccgtgtatactccaatgatgcgacacaacatgaaccaacctggaaagtcacttggggtcattggtcttggtggtctgggtcacatggctgtgaaatttggtaaagcatttggtcttaaggtcacagttttcagtacaagtgaatcaaagagagatgaagccatcaacctccttggagcagataattttgttatatcatcagacacacagcaaatggagtccctgaagaactccctgcacttcataattgacactgcttccggtgaccatccatttgatccgtatttctctctccttaaggttggtggtgtgatgacattggtaggttttccaagtgagatcaaaatgcatcctgcaagccttatacttggtgcgcggaccttgtctggcagtgttgttggaggtataaaagacatccaagaaatggttaacttctgtgcagccaacaatatctatccggagattgagatcattaagatagattatatcaacgaggctctcgcgaggcttgttaatcgagatgtgaaataccgctttgtaatcgacatcgagaactccttcaagtagcgtgctagtgcacatgctctcgtctttctgttagtgttcaacagttcaagagctattacaaatgtgagtcatgccaaataaacttgatgtaaacaaccataattgaacagcaaggggaaacaggtatattgtgataatgaagtcgctctatgaatat

SEQ ID NO: 68 - DNA, 2462 bp, Zea mays
agctgatttattttctctcgctctcgccttcgcggcgctgcctgcgcagtactacgagctagcaggctagcagcaccaggaccaggagcctcttcccacacttccgctctccctctctctctttcctctcgagaatggttgtgtaggcgggcgcaggagggaggagagagaggggagctagctagggttttgcgtcgccgccttctgttacccttaggctctgaacccctccggtccggtgcggcggcggattaggctccgatggggaagtctccggcgaagtggatcaagtccgtgctcttcgggaaaaagtcgtcgtcgaggtccggctccaccaaggccaaggatttatcgaagggtacgactaacaaagcggcggctgctgctgctgccgggaaggagcccgcgttctctgagagctctccggtcatctcggagcctgtgcttgttagcgcccacaacaatgagaccgcgcgggaggccgctaagggtgagaattccagcgtgcaagaagtgccagtgactgatgtcagtcaagacttggagaagcagggcactgttgggtctgatacgtctaatgatgctgagaggttgagggaagagcaagcggccgtgaaggcacaagctgccttccgtggttatctggcacgccgagcattccgtgccctgaaagggatcataagactacaggcactgattcggggacatcttgtaaggaggcaagctgtttcaactctccgtgcgacatggttgattgtgaagtttcaagccctggtccgtggaaggaacgttagactttctaaagtttccattcaagcaactatggaactttcccaacagaacttcgggggttctaaacctggttcctggaaggagaagttgtcttcaaatgcatttgctcggaagcttctctcttcaccaattgtggttgaggctcttcacgtccagtatgatgagatggaccctaattcggccttcaattggttagagaggtggacagtaagtcatgtctggaagcctatttcccaaccaaagagagttggcgctgatgctaagcctcatacaaggaaggccagttatgcaatggaaacagagtcagcgaaattaaagcgtaatgcacggaagagccctgcagtgccatttgagccttctcaaacaaacaccaccattgaaaatgagaagacaagacggaatccaaggaaattaagtagcactcctgctgagtcagttcccgatggccagttaacagaacttgagaaggttaaacgtagccttaggaaggttactagttccatggttgaaacctcaaaggtgcctagcccaacaactgagattcctgaccgtcaagaggtacaatgtgagagaccactaagaagtgcaaagcaagctccaattcatgttgagaatcaagaacctcagaatgttaatctatcggacaatgcaaagatggatattctggtaccagatatccagcctgacgtggaagttgcttcagatctagtcacaatcacaaatgaagaaaaagttgatgagacaccgtctgttgttgctccagcggctgaaattatgccactgcaagacatcaacagcgaagaaaatgctttggtgaatgatgtggaagagagatccaaagaagaacatccatctactgataacctgaaaggcagcaagaggaggtcttcattctcagctaagcctgaatatccagaaaatggctccaaaaattctccagccctgccaagctacatggctgctacacaatctgcaaaggcgaaactgcgggggaatagttcaccaagacttagctctgattcagcagagaaaaacgggttcactcgtcgtcactcccttccgtcccctaacaatggtaagataatttcacattctccacgtacgcaaaggccaacccatgctggtggcaaggacggagcaaaaggcgacaaggctatgctgtcatcaagagatgcgagcgagagaccactgaaagctgagtggagacgctgaggtggcgaatcaaaaccccaaaccctccatttggttagtgcaactatttgggtcggtggatggcgtctgcagtttgctcaattgttttgcttgtgatgtaaaaaagacgttatcatcatcatccgaggcgatgaacgggttcagctttgttgtgatgaatctgctgggagtcaacttatttacagggttttgggtcatgccttttgtgatgtatagctgaagtattttcccggtttgttttgtttcccagacccccagacttacccccccccccccccccccccccctccccctcctgcttgctgagagggctgctgatgttagagagaacgagaacctgtatggattgagttgaacagaacaatcttagtcccgtttggtcaaatctgggctgcgttttgactgatggttgtgtgtcatttatggttattgcccttgaggtcgtagtattcttttcc

SEQ ID NO: 69 - DNA, 2409 bp, Zea mays
ctgcggccgataaataaaacgagaaactccggcgagtctcgcccccctcttccccccactcgctcgcaactcgccgcgcggcggaaacgccacgcccggggtgagatccgcgcgggccctcgcctgcctcgtcaccgtcccgcggcctccgatctccacagggcggccggaggagtcggaggggcagagtgagatggcggcggaggagggggccatgtcgccgacgaggatgcttgcggaggggcacctgcgggtggccaccggcgggggcgcgccggcggacggcgggatcgccgtcagacacctcccgcaccatcaccccactaagaaagacaatgttggtgggaaaactgaaaaagacaatcatgaaggtgtaaattctttactatctgaggagttggaaaaactagctaatgggaatagcaagattcctggtacattagatgagtatagaaagcttgtcgttccaataattgaggagtattttagtacaggagatgtggaattggcagcttctgagctgaagtgtcttggatctgatcagtttcatcattactttgtgaagaagcttatatctatggcaatggatcgccatgacaaagaaaaagaaatggcatcgattctgttatcatctttgtatgctgatctactgagctcctacaggatcagtgaaggttttatgatgcttctggagtctacagaagatctaactgttgatataccggatgctactgatgtattggcagtttttattgcacgggctattgttgatgaaattttgcctcctgttttcctcactcgagctagggcactacttccagaattttccaagggcattcaagttctgcaggttgttgaaaagagctatttgtcagctccccaccatgcagaattagttgaacgcaaatggggtggaagcacacactctactgtagaagaagcaaaaagtaagattaagaatattctaagagaatatattgagaatgaagacatagatgaagcctttaggtgtataagagagctcagccttccatttttccatcatgaggttgtgaagcgtgctctcacctttggtatagagaacatatcctcgcaaccatcaatccttaagttattgaaggaggcagctgcaagttgcttgatcagtcctaatcaaatctcaaagggtttttctagactagctgagggtgttgatgacttgagtcttgatattccttctgctaaagctctttttgacaagctggtttcaacagctatatctgaaggatggcttgatgcttcttttggtaaatcagctgcccctgacgaagagatacaaagtacaagcgttgtaaaggtgaagcgttttaaagaagaatgtggccacataatccatgagtattttctctcagatgatgtcccagaacttattcgaagccttgaagagctttctgccccagaattcaatcccattttcctcaagaagcttgtgacgcttgctatggatagaaagagcagagagaaggagatggcctcagtactcctttcttcattgagattagaattgttttcaactgatgacatcattgagggttttgtaatgctcttgcagtcagcagaagacactgcactcgacattgtggatgctcctagtgaacttgctctcttcctagctagggcagtgattgatgaagtattaattcctctcaatttggatgaaatcagcattaagcttcggccgaacagcagtggcagccaaactgtccagatggcgcgtgctctactgtcagctcgccattctggtgagcggatactgcggtgctggggcggtggcactggatgggctgtggaagatactaaggacaagatcactaagctattggaggaatacaacactggtggtgacctaggagaagcctgcagatgcatccgtgatcttgggatgcccttcttcaaccatgaggtggtaaagaaggcactggtcatggcgatggagaagcagaatggcaccagcatcttggtcctgctgcaggagtgtttcggcgaggggctcataaccatcaaccagatgaccaaaggctttgcccgtgtcaaggaaggccttgatgatctgatcctcgacatcccaaatgcccaggagaagtttggagagtatgtggagctggcaacagagcgcggctggctgctgccgaccttcgcctccgttccctgagcatccaccactggcgataccttccttatgtgtacatttgtgcccatgatgtcattagctccgtaccaaagttttcctattcctagtttacttatgttaccgtatactggaggattgtaggatggatgtggtgtcggttgttgagatagtgtcctattggtctaatctgggagggtacttttgagagttaaaagaataaagccatttcgtttcaggtt

SEQ ID NO: 70 - DNA, 1374 bp, Zea mays
gccagtggtatcacgctcacacaaggagctgaagtgcacgccaccactatccatcctgctccggtgctcccactcccggactcccctcagtccctcactcccacgcgcacgcataggcatagcaagcaccgcgcccagccggccgcacctccgctccgcgctctcgccccgcccacacaatgcgccgcgctgccgcgatcctcctgtccctcgccctcgcagccgccgccaccaccacggcggcggcggccgtggcgaaggctcccgtgccgccgccgccgccgccgccgcctccgaacgtgacggcggagatggccaagggcgggtgcaaggcgttcgcgggcctgatcgcggcgtcccccgacgcgtcgtccacgtaccagtcggccgtggagggcggcatgacggtgttctgcccctccgacgacgccgtgcgcgccttcctgcccaagtacaggaacctgagcgcggacggcaaggcggagctgctgctgttccacgccgtgcccgtgcactactcgctggggagcctcaagtccaacaacgggcccatgaacacgctggccaccgacggcgccgccaggaacttcaacttcacggtgcagaaccggggcgacgtcgtcaccatcgccacggccgcctccgcgcccgcgcgggtcaagtccacggcgctggacgaggacccgctcgccatctacgtcatcagcgccgtggtggagcccgtggagctcttcaagcccgcgccggcgccggtgccagcgcccgcccccgcccccgctagtgtcgcggacgcgcccaggcccggcaaggccgccgcgggccggcgccacccgccgcccgccgcggccgacgcgcccggccccgccgcagaggacaacgcggctcccgtggaccagaaggacgccaagaagagcgcggccgccggcgcgccgtgcgctctgtggtggctcgccgccgcgctggccgcggcctcagcattggcttagcgatcggtgttgtttgtgcctttagttttttcttccggtgttgatccattggcgtgcgatcgtggtttgtgatggcgtatttgcgaggtttgtgcttttttttttctcgatcgggagaaaatagtgtatgcctgcttcggtttagatgtttcttcttgcctttttttttctagttctacctgttaccacaactagagtgaggatcagcgcgtgtttatcaggaggtgtttgtatttttggttatgatgatgacggacgagtgaggtcggggcactgaattgctgctctgtctgacggcgacgagcttctggtggtttccttgttatcgtaggttaaaatcgctggtatggtacgccaatttctaatgttcatggtcaaatctcactaa

SEQ ID NO: 71 - DNA, 1034 bp, Zea mays
catagatcttgacacctacctcctatacacgtcgacgtacggtttacaagggtatgcaccaagatctatagcgcctacccctgtcacgtaggcgccacttcaccaggatctaggcgccaatatgattagcgccggcctgttttagctggacgccaatgtcattggcgctgagctagaggtctattttttaagatgaaactgacaaagttatatttgtaaataaaatacagaaaaatagctaaaatgcaaaaaaaaaaaaaaaaaaaattggccgacctgcaccccagaaccaaactaccaaagcgagagacaaccgctgcgccactgcggaaacgatttcgtcgccatgaccatgacgtctcgtttcgttgcggcggcctcttcctcctcgtcctcgtgccccctcgcccgcctaatctctcgccgcggccttgccggtgccgcagacggccatggacctgcgaaggtgcccttgtggaaagatccgttgagcccgagcaagtggaaggaagagcactttgttctagcaagcctctctatgtggggggctcttttttatggtggtttcaagttttttggtggaaagaaggaagacaagattgaggcggcatcaggacagacataggtggctgggatgggagttcttgcctatttctgtggccaggcaacaatgttaaataaaaggaatgtgttatattgtgctttcaagttgataaattgtggcaaccaggttttgattatgtaggcaatattttgacaagctactcttatccagcatgaatgacttcatgtttgtgaatgctgcaaatgttgtacttctttcatgcgattgagtagatgttttacttctgttgccatcaccagttcaacgctgtactttcaattgattcgatcacgtgttttctagtttgcgttgttacagatgaatttgacttaagttttattgataattctatttgtgttgcttgcaattagaaattgcaatgtgggttgttggatgtatctacgtgcctccataatctggtgttagctcc

SEQ ID NO: 72 - DNA, 1114 bp, Zea mays
ggaagaagtcatttctacctataagctaggtgctgttgttgtttgaatagagaccatctctactcctttaatgcctaaacctacagctgtgtgacatgaagaacttgtgaaccaaaatcacggcacaactgaagacataactaactggaaaaatgacttttttattttcaagaactataacagaatccagtaacattgcagcaacccctgtttccccaacattgactctcgtctctgcatctgtttccgcaggggaatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatgcagtacttggagagaagagagtgtgagtacgaccagaagatatccattgatttctacaaggaaggagatcccttgaaaccagctgtgacaggcgtcttagtgttcgtttccactccagatccaattggcaacaagtactatcttggccctgctcctttgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgttgtggactcgagatagcgagagccttggacgttggacctctactcggaatctacttccagctcttgcatgtttgtggccatcatgtactgattttcccttttcaacagttgtcgtgaggctgtatcttctggagttaaaaaaatgctaaaagccggcactaataatgatattaacttgaaaaatcaaaaaaaa

SEQ ID NO: 73 - DNA, 1584 bp, Zea mays
gaaaacgacaccagagaacgaggtggaaaggtgaggccgttccctcagccgtaggcgagcccatccagcaaagcagtggcccgacgcggcagcgagctcggcaacggaacaacccgacgccacacacacacgcctgctgttcccgtgcacgcatgcaggtgtcaggtgatgtgccgcggctaccgcaggagttaaaacccgagcacatgctatggttaacgagcaaacgccgcagcggcactgcggtagcagcatcgcgcggcaagctcacctcatccctctttcaccccacctctgcaattgcaagcaaagctccggcctccggatcaggatcacactgaccaccgcgagcgcgtgccggcgtccagtggttacgtcgagggagcctaggctagcgaggaacaagcagccaccagcccgccacgatgctcgtgaggagcgcctccacgccggtcctcggcgcgctgcacccttccggctgccactcgccggcggtctcctccccggccgtgcacttcgccgagtcgccggcgtcggccgcctaccacgcgccgcccatctcctgccacctgggcgggcccgggtccgggtccgaccacgagcgctcgcgcagccgcggcgccggcgccggcatgcgccgcacgtgctccgaggacaacctcgcgtctctggccggcggccgcgcggacgaccacgaccaccaccaccttctcctcccgccgtccggcaagggcgcgccacgggcgcggccggtgccgctcgagaccatccagtcgttcaggggcccgcatgcgtccaccgacgacgaagaggaggaagacgacgacgacgaagacgcgtacgaggtggagcgggagctgcgcttcggccagttcagctttgccggcggcgcctactcgcaggagcacccgctgttcctggccaggggcctcggcatcgaccgcctcggctcgggcctcctcagcgccgacggcggcggcgggttcggcggcagcgacggcagcgggagcggcggcggcggcgggaatttggtgacgtcggggaacggaggggaccgctccggcatcgagacgcactacaagaagatgatcgaggaggacccctgcaacggcctctttctcaggaactacgcacagttcctgtaccaggtgaaaggggactacaggagggcagacgagtactactcccgcgcgatcctcgccgaccccgacgacggcgagctcctgtcggagtacgccaagctggtctgggaggtgcaccgcgacgaggaccgcgcctccagctacttcgagcgggcggccaaggcgtccccgcagaacagccacgtgctcgccgcgcacgccgcgttcctgtgggacacggacgacgaggagggcggcgccgacgcgctcagctacgcggccttcgctcagccggcgcactcgtctctggcttcggcgacggcaacaacctgaactctctcgccatctcacgagtctcgagagcggttcctccgcagtcgaaatggagcgtgacagtggcctctgctcgtctctgtctgtagtagcataccaataatactactcgcgaactctctttctgagc

SEQ ID NO: 74 - DNA, 1103 bp, Zea mays
atctacccatatgcgataaaataaaatctttcaattacctgcttccggcagcggtacgatggccgctgcgagaatggcgctcgtctcttgcgcccgccgcctcccgtccttaccctctccgctcaccctctcgaggccccgcgccggcgccgtctcatttctggctgcccaaccgtcgccggcgacggcaccgagatccggcaggaatcttgctctcttctgttctttatcaccgacgtcgccatcgctaactgaggccgccgtagcactgccgccaccgaaggctgcggtggaagagacgaagccccctgtgccgagcggggacgagaagggggaaccgaccgtggaggagctagcgggcctgctggacgtccgggtgggccgagtggtgaaggcgtggaggcacccggaggcggacaccctctacgttgaggaggtggacgtaggtgaggcggagccccggaccatctgcagcggcctcgtcaacttcctccccatcgaagaactccaggacagaaacgtcattgttcttgctaacctcaaaccaaggaacatgcgtggcatcaagtcaaatggcatgctcatggctgcctctgatgcttcccatgagaatgtggagctgctcatcccttcagaaggttcctttcctggtgaaagagtatggttcggttccgaagaagaaaagaaccgtcaatctgaccctgcatcaccaaatcaggtccaaaagaagaagatctgggaagctgttcagcctcatcttagaacaacagataactgcattgcggttcttggtgataaacaaatgcgtacctctgcaggcctagttttctgcaaatcgcttcagggtgcaagagtgtcataaatctttatggccaacatctttcttgtatcatggaatcgtgtgtcatgtatcttccctgcaaataataactaactatatgaggagagcagcagggaaagaattttctttccaactactgagataatcactgtactggaaccattcacatttagttctcacttttcagtgttaaaacaacgtgcttcctgggctgacgcaataatcttgatgccttggggcgagttattacattgactttggt

SEQ ID NO: 75 - DNA, 947 bp, Zea mays
gaccgggaccaggcacaccacgcacgcagagccctagaggcattcccaagttcgagcaatcgagccccagaggaacgactcctgccggacgccgccacaccatctgaaactgacggcggcgggcggccgctgcttcctctcccttctccgttcagatccggctactggcgtccctcctccgccatcttccctacccccgacgtggcgacgagctgtgagccgtgagctgttccaacattcctgtcctagttcaagctgaaaggagaacataaaagaggagaggctagggttttggcgtccgagaccaaaccaagctctctccggcgacggtgagggctcgatatcggagtccagtaggcggctcctgctgcttcggcggtccctaatccctctctcggcagtgtacagatggcgtccggcggtccggcgctcgagccgctcgtcgaccaggtcatctccgtcatcaccaacgatggccgcaacatcgtgggtacgctcaggggattcgatcaggccaccaacattatactcgacgagtcccatgagagggtctattctagaaaggagggagtccaacaacttgttcttggtctgtacattatcaggggtgacaacataagcgttgtgggcgaggttgatgaagagctggattcaagattggatatgtcgaagctaagggcgcacccactgaagcctgttattcactgaggtccgagtatgtctttgggtaatatgtggactggatggatgggtcactgttgaatgcaggatgtagcatcatcatggtgaggggactgagtaatatggacatgtatcttgcgtattgtgcaatgaatgtgttggctgttgggtcgcttgcctacgcattctgtaagattgcagttaccattaggaactgaactcaactcgactgaattaatatcatttggctctactcgtagatacag

SEQ ID NO: 76 - DNA, 2369 bp, Zea mays
atcgcccagttctctcttctctttctttcttccccttcctacaccgccgcaccccactcccagatcccactgctccccagatccgcgcccgagccctagtccccagatccgccgcggcgccggagatctactcctcgtcttggcgtccgcggcgccatggcgtgcctcgcgatctctctgcagccggtgaacggcccggacatcctactgcaaacgcggtcctggttccccgtctcccgcgccctcgccgccgtctccgcctttcgcctcgcgcgcctccaccttgcacgcggcaagcaacagtcctcctcatcctccgcctcctcggcctcgctcgacgccatcggcgacgacccgctcgccgccgcgtccgggcagctcgttgtcggcgtcgagtcacagtaccgcgtggtgtaccgccttgtcaactccatctacgttctgggtgtcaccaccgcaggctctgaccatgctgcccctgctgtcaacgccttcgccgtcgccgacgctgtcaaccagtccgtctccgtcgtcgttgcagcctgccgtggcgtcgacgtcacccctgagaaggtgcaccgcaagtaccctgaggtctatctcgctctcgacctcgtcctccacggcgttggctccgtccgcctctctcagatcctcgccaccatccatggcgacaacctcgcgcgcatggtcaactcctcgcccgacgccgaagcccgggcccgtggcgcggatccctggcccgtcgtcgaacacctcgcgcaggaccgccacgctgcgagggagggcttctcgggcgcctctttcgagcttccccaggagacgctcgcggctggtgacgaattctcgtctaacatcgcccccgcgaccactgttgctactggggatgaaccaccacctgaggaggcagcacctgtggaaaaggatcctttcgcagccagtgacctgattaacaacaaaccggaggaggcattggtgggtgggttcaaaaagaacaaagagactgcccttgtggttgctgatcctgcagctgcgctagctggattggaggttacgactttgccaccagctgaggcgactaagccgacatttattggagttgaagggtttgagggtgattatggtggcattgagtttggcaacgatgagacttcacttgctgaggcatttgaagggctcaatgcgccatttggtggtggcctggatgcttctgagtttgttacaacaacgaagaaggatcacaaggacaggaccgtcactgggcttgagttgctagtagcaagtgggcagccaccgaatgcagctgctggtactccattggagaatctcttgctgactaagcgcgcagaaatgaccgctcctgagttgtttattgctgaggagatcaatgcagaattcaaggagtctattcttgtgcgtgttggattgaagggtacaatcttcctgcggaccttgccactgaataaggcagcgggtaaggagacagagttctcatttcgtcttgagggcacatcaggaatgaagagggctgcattgcagagtaatgtcttgagtaacctacaaaatggactgttccatgtcaggaccgtgtcgaaagaagaacccattcccctcatgaagtacagcttcctgccgaagcactcacctctccctttgaggatgcgcctagtgaagcgccatagtggaacgttactctcagtgatgatacagtacgcatccaatccaatgctgccccagcctctgagcaatgttacattcgttgttaagcttcctgtggatcctactctgctcaatgtttcacccaaggctgtgctaaaccgggcagagaaagagcttagatggcatatttcagacattcccctgaaaggtccagccggcaggctcagggcgcggatgcctgttgaccaagactccaaagatggtgagctagaggttgttgggatggtgaagtttgcttaccaaggtccattcacattgtctggcattaaactatgcccagccactgatggcattgcccaatttaatgaagttggccataccttctccagtgggagttacctgtgcatttgataggtgctgctgcgcagaagcaggccgcttgctgttgactgtcaggaggatgcaggtgacaattgagctgtggccggtagcatggcctagtaaaaatgtggtctgttggagcatgcaacatggtttatgtaaaacttgttttcttatagaaacgagtaaaagttgttttgtccaacactcggaacttctgggctttccgggtacttgtttttcttgaacacgaatttgttaagaggatatgagcaaagttattattggttaggctaaaatgataatcaagaaatttggttttcctcaaa

SEQ ID NO: 77 - DNA, 1773 bp, Zea mays
ataaatgcgtccgcaaatgccgccagtccgctctctctcgctgcgcctccgcccccaaatctgcgcaaaggcctcccactcaaattcctcgcggcgaccgatatggttgggagcgtgggcaacgggctggccgatctgggtgcaagagccgtctccatgaacggggcggggaaggcgctgcgtcctgccgaagcggcggcggcggccgccgccgcggagacgctcccgatggagctggatccgtcggaggccttagtggccgctgcggtggaggcgaagggcgagaaggctgccaacgggaggagggagatcgtgatggggaggaacgtacacacctcctgcttcgccgtgaaggagcccgacgcggacgacgaggaaaccggcgagcgggaggcaaccatggctagcgttctcgcgctctaccgccgctcgctcgtcgaacgcaccaagcaccacctcggttacccatacaatctggactttgattatggtgcactgacccagctgcagcacttctcgattaacaaccttggtgatcccttcatcgagagcaactatggtgttcattcccggcagtttgaggttggagtgctggattggtttgctcgtctctgggagttagaaaaggatgagtactggggatatattactaactgtggtacagaaggaaatctgcatgggattcttgttgggagggaggtgttccctgatggaatattgtatgcgtctcgtgagtcccattattcagtattcaaagcagcaagaatgtacagaatggattgtgtcaaagttgacacccttatgtctggggaaatagattgtgctgatttccagagaaagttattgcagaaccgagacaaacctgccatcattaatgttaacattggaacaactgtgaagggggctgttgatgatctagacttggttatcaaaacccttgaggaaaacggctttaaaggtcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcacataaatgccctttctagcaatgtggagtatctggcgtcaagggatgcaacaatcatgggaagcaggaatggccatgcccctatcttcctctggtacaccctcaacaggaagggctacagaggcttccagaaagaagtccaaaagtgcttgagaaacgcacactacctaaaagatcgcctcaaggaagcaggaatcggagcgatgcttaacgagctcagtagcacggtcgtgtttgaaaggccaaaggatgaagaatttgtccgaaggtggcagctggcttgtgaagggaatatagctcacgttgtggtgatgcccagtgtcaacattgacaagctagactatttcctgaatgagttagttgagaaacgggcgacttggtaccaggacgggataagccagccaccctgcattgccagagacgtaggtgttgagagctgtctctgtggccttcacaagtagcgagccttttgctttgcaagtgggttcattcttgagtcgagttaaaagtgttatgttgtactgtgttcattcttgagttgagttaaaaagtgttatgttgtactgtgttcgtgcgttctgcttctgtgtttctccacagtgtagcttatttgttgccatgggaataaaattccttctattaaattg

SEQ ID NO: 78 - DNA, 1233 bp, Zea mays
tgcaccaagcccatttttcgtccgttcaatactgctccaggctcgatgagccggcccacatgaagatgaacaagtgaagagcatcagagcccagacttctttagagcccagcccacgtatagcacggagcccgcgacgagccgacccggcgagcctggccggccgggcggaccgaaccgaatagcgaaggcataagccatcagtttccaccgcacgtccgcaccccctctccggcgtgccgacggtatccatggcggcggtggtgcgcggcgtcttgaggggcatcaaggagaagggactcaccaacttcatccgcgacgtccgcgacgaaggatacttcaaatgccttctggacgggaaccttttgcaaacgaaaatccacaatattggcgcaacacttgtaggagttgacaagtttggtaacaaatattatgagaaactacatgacactcagtatggaaggcataggtgggtagaatatgcagagaaaggtcgttacaatgcatcccaagtgcctgctgaatggcatggatggctgcaccacatcacagatagcaccggggataagctgctgaaccagaagactgctaggtaccttgtagagcacaagcagaactactccggtgagggtgaagagcttatctaccactccaaggggcatgctttgaatccgggacaaagggactggacgaggtatcagccctgggagccaaagaaagagcaagcctagctcgtgagtacattgtggggaagctgctgaatgttttgcgttttcttgcattgcgctgggtcaggtatcaccgagctgaatagcctctgggttattgcctggacgggacccaaataatgttgttctgaataccaatatattgtatatttgatcatcttttgacattgaaatgttgttgctgttgtaaaagcagctttgaggaatatctcatgcaggtgttactgacttcggttacgagacattgggtctatttgtttcagttttttttttgctgattctgaccgtcagaagttgttgtagaccaaacactaagcttttcagtcagcttttatatgaatcactttagtattacgtaaaaatcgtttaaaatcaacgtgaacacacatcggtcaagtcgtcatgataaaaggaatctatcacttcatagatcctaaatcttatatactcttttatcttctcgcgatacttagattctccctggtcagattctcttggagggaatt

SEQ ID NO: 79 - DNA, 1301 bp, Zea mays
agacacatccccttggtgctacggccaccccgcgcgctgtacctggtcttggcttgccgtgtttatttatatatatatgtaggcaccccccagcccagctgccgctcaaagcgacaggtggagatcggagggaggaagaagaactgagctgcggatcgagggaagggaacaagcaagcagccagagccaggtcgtgggggagccggcggcagtgatcttcttgcgtcgaaggcgaggccggagcgtcggtttgagcgctcgtgcgatatgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccagggatcatgttcaacgacatcacggagctgctgctgcggccgggcgtgttcagggacgccgtggacatgttcgtcgagcgctaccgcggcatgggcatcgcggccgtcgcaggcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcgagcgcgcaggagctaacgtggttgagtgtgcatgcctcattgggcttcccaagtttaaggatttctataagctcaacgggaaaccggtttacatcctggtggagtcccgcaaataggacgcagtaaatggtcagacaaaaaagctttctagcttcccgtccaaagaagctcacaacttcactcatttgcacgcgcaagcaaggtggtatgggggcaccgagaaactccgcagtaatctgtgttgaggccacggccagatgatgctatgtatctatcttcatggagagggtgatggactgggtgaaacgtagtcactgtacttttgtagcacgtcatgtctagtgtttcttagtagccatggctgaagagagtttgtagcttattcccggcttcctgcagccaggaacatcagtgttagccagagaagaggaaaaaggatcttatgttgctgctcagttttctaccagaatcgtcttcctttttttcccctttgcagaatcaactc

SEQ ID NO: 80 - DNA, 4001 bp, Zea mays
tggacactgacatggactgaaggagtagaaaaaccacaccagggcccaggccaccgccgccttcatcccctatccgcgtaccgccccccgggcgatcgatcgaacgcggctagcctcgccgccgacccgtcgaggcagccatggcggagatcgccgaacgggccgtcgcgggcgaggtgccggaggagccgcggccgccgcacggggaggaggacgacgaaggggaggaggagggggacgtgtgccggatctgccgtaaccatggcgacgaggatcacccactgcggtacccgtgcgcctgcagcggcagcatcaagttcgtgcaccaggactgcctcctccagtggctcgaccatagcaactcgcgccagtgcgaggtctgtaaacatgcattctccttctcacccgtgtacgctgataatgctccgacaagacttcctttccaggaactgatggttggtgttggaatgaaagcatgccatgtgtttcagttcatccttcggcttgcctttgttctctcagtttggctcatgattatcccattcataacctattggatatggcggttaacatttgtgagaagtctcagtgaagctcaaaggctgttcctcagtcacatcagcgctcagttgatccttagtgattgccttcatgggttccttctctcagctatcattgtccttatatttcttggagccacctcattacgagactacataaggcatttgcgtgaacttggtggacacgatgctgagagggatgatggtgggcgtgaaaggcatggtgctcgggctgttaggaggctagctggtcctaataatagggttcctgcagatggaaatgttgatgaattagcagaagcccaaggaatcggtgctggtgaacttctgaggagaaatgctgaaaatgttgctgctcgattagaacgacttgaggctcaggttgagcagatgcttgatggtctagatgatgcagatggtgcagaggacgttccttttgatgaacttgttggtatgcaaggccctgtcttccacttggttgagaacgcaataacagttttggccagcaatgctatattcctcattgttgtgatctttgttccattctcattgggaaggattatcctgtactatctatcctggtttttctcttcggcttctactcctatgctggcaaaagtgatgcccttcacagaaacagctatttctatagctaatgatacattaaagagcgcacttaatgttgtgaagaatttttcttctgacagtaataatgaaggtgttatcgggcatgtgattgaggttgttactcaatccttgaagataaatgccactggacttagtgtaattcaaggcactgggaagaacagtctgatgaaaggaacaacaattgcctcatcttatctttcagatctgacaactcttgctgttggatacatgttcatcttctgtcttgtgtttttgtatattggatcactggctttacttcgatatgccaggggagaacgttttaccattggaagactctacggtatagctactatattagaggccatcccttctctatgcagacagttctttgctggaatgaagcaccttatgactatggtcaaagttgcattccttctggtcattgagcttggtgtatttcctcttatgtgtggttggtggcttgatgtttgcactctaaagatgctgggcacaacaattgcgcagagagttgaattctttacaatgtcacccttggcgagctcatctatccattggctagttggtattgtgtatatgcttcaaataagcatatttgtgagccttcttcgaggggtgctgcgcaatggagttctttattttctgcgggaccctgctgatccaaattacaatccatttagggatttgattgatgaccctgtgcataaacatgcccgacgagttcttttgtcagttgcagtgtatggaagtttgattgtgatgttagtcttcttacctgtaaaagtggccatgagagtagctccttcaatgtttcctctggacataaccatatttgacccattcactgagattccagttgatgttcttctgttccaaatatgcatcccattcgctattgaacatttcaagcctcgtgcaaccattaaagctcttttacatcattggttttctgtggttggttggggccttggcttaaccgatttcttactgccaaaatctgaagaaaacggtgggcaggaaaatttgaatgcaagggcagaaagaagagacagaggacatggtgggagggaaatggtcgccccacaggttgaacaactcatgatacaacatgttgccgcagaagataatggcaggggggattcaaatgaagccaatgatgtaactgaggactctgatgtagatgaccagggagactctgagtatggctttgtgcttcggatcgtgctcttgcttgtactggcatggatgacattactaatattcaatgctggaatgatagtttttcctatctcacttggccgtctggtttttgaggctgttccccgcctgccaatcacacatggcatcaagtgcaatgatctgttctcctttagcattgggtgctatattctctggagtgtggcagctgggaccagatatgcgattgattacatcacatcacgacagctggggtttttggtacaacagatctgcaagtggtgctcaattgttttgaagagctctgttctcttgtcgatatggatctttgttattcctgtgctgattggactcctttttgagctgctggtcatcgtacccatgagggtgcctattgatgagagccctgtcttcctattgtatcaggattgggctctggggttaatattcttgaaaatatggactagactggttatgttggatcagatggcacctttggttgatgaaagctggaggtcaaagtttgagagagttagagacgatggcttctcccgtttaaagggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgcactcttcttttggggcaagagatttcatgtctggttcaccaacctccacaactccatcagggatgaccgctatctgattgggcggaggctgcacaactttggcgaggactcacactcacctgagcggagtgaatctggagcaactatagggtcagatgatcaggacagagatattgtactaagagatcaggaagaggaagtggggttgaggatgaggcgcaataatatgcatgcaaaccaacaacctaggcttgctttataagtaggaagtagttttggacaaagagctcataaccctctataagcttcggtctgcaggttctgcttgtgctttgtaatgggcattgtagagtgagtttatgtgttagtgataggaaatagtctaaggactgttctacgataaagcctggagaaagctgaagtggctggtgattataaaactggtggcaactcccattcctgtggtagtcctggctgactgtaaatatcgtttgacagagcattaccatgccaactcaatctgttgtgatcctcttgtaatgactagtgagttaaggtgaactgttgggtagatacgagatactagattattatcgcgttcactcttttttttttgggtcccatctttgtttttttagaaactgcaattgcattctgtttatatcatggagcatctagcggcttgaaatgaacaagaacaagatgcatgggcagtgggcagtattggttgtgggtaactgaaagcagggaaaagttcctgatgaataagggctattttggaaacttaatttttctaagggttttctattttatcaagagaaattagtttattttttcttgggaaaataaaaatcccttcaaaaaa

SEQ ID NO: 81 - DNA, 632 bp, Zea mays
gggatacgaggaggggaaggaacaagatgagttccaagaaagcaacaaaccggggtttggtacttgtccttctgctcgttgttttgcctgcgctttcggtcgccacgcacgcaggagaaagagagttgccagatgaaaaggatcacaagggccattccactgttgcttctggaaaggggggaacggcttcaggagatatggtgaagacgaatgactatgggcgctacgatccaactccggcgttctccaagcctcgctccaagcttatacccaactaattacactcacacttgctgcatctacatgcttactatatggatggcatgcatagaaatatagtcctgtacagaatataatgctcacttcgtttttttttgtcgcgttctagttcaaaaataaactaatcggcgataaatatttaagaacggaggtagtatctagtatctagccttgacgcctctactgaatgtacctctactgaatgtactcggcttcagttcttaagtttggtgtgttggatctctgtttcgtcttccttttattttctaacaacaccaggttaagaatccttatttctccaatttatgaaggcaagatacacattgctgaaatgcttttagctggagcccgac

SEQ ID NO: 82 - DNA, 1445 bp, Zea mays
ttcttttccacacccttttcccgattcctttccgccccgccccgccccgcgcagtcgccctccccaccccacccacccaccccaccccacccggtccccactttccactcccaaccccaccagaccttcaaccgctacatttccgtcactaccggagccgccactcccacgaacgcgggcggcggagcggaagcgaaccagttatctagtggagttgcctccttcaagctactctaatgtcctttctattcaagtctagcaatggcggcaccactgaaaaaatcccatccccagaagaacagcgagaaaaaataaatgaattacgcaaggagcttggtgaacactcatcagcagccattaaagacttcctttcagatgcctcgttagcgagatttcttcgagcaaggaactggaatgtgcagaaagctagtaaaatgatgaaagcagctgtgaagtggcggcttgcattcaaacctgaaaacatctgttgggatgatattgcagaggaagcagagactggaaagatatatagggcggattataaggacaaacatggcagaactgttcttgtattgaggcctggcttagagaacactacctcagcaataggacagatcaaatatctagtctactctctggagaaagcaattatgaacctgacggaagatcaagagaagatggtatggctgacagatttccagtgctggacattgggaagcacaccactgaaggtgacccgtgagactgtcaatgtcttgcaagactgctatcctgagaggttggggcttgcaatcctttacaaccctcctaggatatttgaatcattctggaagatagtgaagccgttcctagaccatgagacccgcaagaaggtgaagtttgtgtactccaacgacaaggagagccagaagataatggcagaagtctttgacatggaggagctcgactcggcattcgggggaaagaacccagcgacatttgagtacaacagctacgcagagcagatgcaggacgacgacaagaagatgggatcttcgcacggctcagccaatagcttgcttggatcagctgggaaggaggctaatggcgcagactcggacgcctcaagcgaggcctccttctacagtggaactgactctccgacacatgagaacggtgaacacagcatcgcgaagaagaatggttgagctgagttgaactgctttgattgctcaaactgagggagctgactaatgtagttggtcaacataacagttatatctagcttgaacgattgtcaggaccgatggcgatgacagattccaggctggttagatcaccttgtcgggtctaggcggaatgtatatttgctgctcatgatattatagtatgtaagaccataaacggtgagtttgtgatgcgctatatatcttggaataaagttcaacttcttcgttttcttactc

SEQ ID NO: 83 - DNA, 1222 bp, Zea mays
acaggatagtgaggataaggggggcactctttcgttgggccagcgctgcatgcttccttgcttgcttttttgtcgcgcctgcttctcccccctctgcctcttggtgctgcttcctggtgggggaagggaaggagaaggctgtgtgcgtcctgcgccgataacgcgatggtgtccattgtcactgaggtatgggcgctcgctggatgcggcccggcgtccaaggcggcggcggtagcggtagcggcgcaggagttgccggcgcagcatccttctcctgccgcagcgggaggagggaaggccaagaagagagccgtgccagtgtcgttcagaggcgtcagcagcggcggtggtcaggaccaccagcgtgaggccgccgccgtcgtcgtcgggcggcggcgcggcctcgcgtcgtgcgcgctcgccgccgtcgccgcctcgttctccgcccgcgctgaccgccccgcgcgggcgcttgtcctcgaggaagacgacgacatcgagctgctggagcgcgtgaaggaggacaggaagaagcggctgcagaagcagggcatcatcagctcctccggcgccgagaccgggtatttgcaggacctcatctacaggctcagcaaagtcgggcaggccattgacaacgacgacctcccagccgcgagcagcgtgctgggaccaagctcagacgcccagtgggtgcagaacatcaatgcagctttctccaagctcagctcaagcccggagcagaggaacgtggtcgacagcttcaacagctcgctggccacactgtttacatcagtgagcaagctcgaccctgaatcctccaagtcggcgttcgtgtcgtccgcgacggcgttggagaaatggatcgcgttagctggactgggcggccagctcaagggctactgatgcgtgcgaggggaagagaagcactgggttgttctatgtttgggtccggcatttgtgaatctcctgaagagggtaccgtgaccgagaactgagttcagataggcatgctatgctcatcaagaaactgtgactgtttttgagactctgctgttacttacaagtggtaggaaacgaagttgtcttgtatcttgttgtccagtttaactttcgaaattccaaagcagctggcgtttattttttttaaatccaaaaattgttgcatgccatgtgggactgaggcaggctcgtgttggtatggtattgacaggatacacgatag

SEQ ID NO: 84 - DNA, 1364 bp, Zea mays
atcacactcgcacagtctcaccacagcgagcgagagcaaggcgcccaagcaaccaccgcgagaacaagtcgcagccaaacagccccgtctcccagcgaagcttgagcttgcattattctaccatgtcttccatggagctgctccacgccgtcgtcccggagaagcagagcgaggaggaggtcgcgcccgcagcgacgaccacgagcagcagcgccaccgccacgggcggggacgagggcgcccacgtgccccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgggtcaagctgccgacgcctcctcctcctcctactgccgccgctgtaactgtctcggcagcagtgcccgtcccggaggcccccgccccgatcaccgtcgtcgtcccgccgctgccgccagtcgaggtcggccgcgagccggccacgtcatccaccgccgcgtcctccgacggggcggcctcgagcagagtccacaggtgctccgtctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcgtgaaaccgctgcgcgcgcgggcggcggatctcatctcatcacccgtccaagattttggtccgcagctgccgagttcagcggtggaagtggaacacactattcgttcattcatttcgtatggtgccagtagcgctattgtttgatttttgtggctgctcctcttgtacagtaccgagtgcgagaaaagatgcatagtcatcgtatacataccaatacaataccgtacctataggtcttcctattcctgtggaagagtagaacttgtatccttattagctgtcagtactcagttcatacacacttggttctcattaccagagatcattggtgaattagtggttttgtatcataagcttattgtaaatgatggattggagattagtatggaatcagatacccatttgttcc

SEQ ID NO: 85 - DNA, 2225 bp, Zea mays
cccaactctggaccacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagtggaggtattgtggttactaatgatggtaatgccattttgagggaaatagacattgcacaccctgctgccaagtctatgatcgaactaagtcgtacacaggatgaagaagttggtgatggcactacatctgtcattgttctagctggagagatgctacatgttgcacaggcattcatcgacaagaactaccatccaactgttatttgccgagcatataccaaagcgcttgatgatgctattgctgtacttgacaaaattgcaatggctgttgatgtgaatgatcgtggggcaatgctaggccttgtgaagagctccattggtacgaaattcactggccagtttggtgaccttattgctgaccttgctattgatgctactacaacagcaggtgttgaccttggtcagggtatgcgtgaagttgatatcaagaaatacattaaagttgaaaaggttcctggtggtcagttggaggattctagagtccttaaaggagttatgatcaataaggatgtcgtggctcctgggaaaatgaggagaaagatagtaaacccccgtatcatcctgttggactgccctgttgagtataagaaaggagaaaatcagaccaacgctgagttgatgaaggaagaagattggcaggttctgttagagatggaggaagaatacataaagaacctgtgcggtcaaattctaaaattcaagcctgatttagtcataactgagaaagggctcagtgatctcgctatccattatttgagcaaggctggggttagtgcaatccgtagacttaggaaaactgacaacaacaggattgctaaagcttgtggagcagttatagtgaacaggcctgaggagctccaagaatctgatgttggaacaagagctggcctgttcgaggttaagaagataggtgatgagttcttttcctttattgttgactgtaaagatcccaaggcatgtactgttctgttgaggggagcaagcaaggatgtattgaatgaagttgagagaaacctgcaggatgccatgtccgttgcaaggaacattttgaaaaatccaaaactccttcctggaggtggcgctacagagctgactgtatcagcaacactgaagcaaaagagttcttcagttgaaggtgtggaaaagtggccctatgaagctgctgctctagcatttgaggcaattccaaggactttggcccaaaattgcggtttgaatgttattaggataatgacacaacttcaaggaaagcatgctaatggtgaaaatgcgtgggttggcattgatggaaggactggtgatattgtcgatatgaaagagcgaaagatctgggattcctacagtgttaaagcacaaacgttcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgattccagagtagaggctgtggcgaacctgcactggcaaagttatttactagtgtcaaggtagcacttcgagcagagttcattttggtggttagccttagcttaaagatgcaccttgttttatatagtttgatgagtggtacgagggttttgggatccaggttttgagtgtggttgctgctcgttttgatttggactgatgaaaaagcagtgaaactagcctttatttatggctaactttgcctgttgtatgccgcaaatctactttttttcttggcaacgtctcgtttcgcacgatcca

SEQ ID NO: 86 - DNA, 1451 bp, Zea mays
ccagatcacacacgagtcccgtccgccgctgtagcagtactgcagtagaaatcctgtcctgtcgctccctccaccacacactgaactgaacacgcgcgcgcgcacgccattcccctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcgcgctcaccgcggtgggccgcaccctggtgccggggcccgcctcgggcgcgtcctacgccgactacgtgctgcagcaccaccaggacgcgctggtggcggcgtggccccgcctgcacgaggccgtgcttgaccccgcggggcccgagccgttcgcgcgcgccaacgccggggtcaccgcctacgcctactacggcaaggaccaggacgccaaccgggtcatgctccgcgccatggcgggggtatccgagcccttcatgggtgccctcctcgacggctacggcgccgccggcgggtttcgcggcgtcgccacgctcgtagacgtcgggggaagctccggcgcctgcctcgagatgatcatgcgcagggtccccacaatcaccgagggcatcaacttcgacctccccgacgtcgtcgccgcagcgccgcccatcgccggagtgaggcatgttggcggagatatgttcaagtccatcccctccggtgatgccattttcatgaagtgggttctgacgacgtggaccgacgacgagtgcacggccatcctgaggaactgccacgccgctctgccggacggcggcaagctcgtggcctgcgagccggtggtgccggaggagacggacagcagcaccaggacgagggcgctgctggagaacgacatcttcgtcatgaccacctaccggacgcaggggagggagcgctccgaggaggagttccgccacctcggcgtcgacgccgcaggcttcaccgccttccgagccatctatctcgaccccttctatgctgtcctcgagtataccaagtgatctccactccatccgcccaaatctccttgcgagttgaatagcagaataacgaacagataaataaagctattccattcacgttggaatccgaatctctgcctactgtactcaacgttagcttctgtaaccaggatatctctttcaagcatttccaagcttttgatgac

SEQ ID NO: 87 - DNA, 2081 bp, Zea mays
aatatttcgatcgtggtgtgagtctccgctttcccacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcagaaaatacaaaggctgttattgatcatggagctgttcctatatttgtgaagcttcttgggtctggtagtgatgatgttcgtgagcaggctgtgtgggctttgggtaatgttgctggcgattctccgaagtgccgcgaccttgttctcgccaatggtgcgttgatgcctctgctagcccagttgaatgagcatgttaagctctccatgctgcggaatgccacctggactttgtctaacttctgcaggggaaaaccacagccatcatttgatcagactaagcctgctctgccagcacttgcacgacttatccattccaacgacgaggaagttctcactgatgcatgctgggccctgtcatacttatctgacggcactaatgataagatccaggctgtgattgaagctggtgtttgcccccggctcgtggagcttctcctccatccatcaccatcggtgcttatacctgctctacgaactgttgggaatattgtcactggagatgatttgcaaactcagtgtattattgatcatcaagctcttccccgcctcctgaatctgttgacgcagaaccacaagaaaagcattaagaaagaggcatgctggactatttcaaatattactgctggaaacaaagatcagatacaggctgtcataagtgccggtatcatcgctcctttgttgcaactgcttcaaacagcagagtttgatatcaagaaggaggctgcttgggccatctcaaatgctacctctggtggttctcatgagcaaatcaagtacttggtgtctgagggctgcatcaagccattgtgtgaccttcttgtctgccctgatccgagaattgtaacagtttgtctggagggtcttgagaatattcttaaagtagggcagcatgacaagaccatgggtgcaacaggtgacactaatgtcttagctcagatgatcgatgaagcggaaggcctggaaaagatcgagaacctacagagccacgataacaatgaaatctatgaaaaggctgtgaagcttcttgagacatactggatggaggaggaagatgacgcaatggctactgccggggaagctgctcctgctgtttttgactttaaccaaggtggcaaccctcctgctgctggtggtctgaacttcaactgatacagtctttgatcgaaagggtgttaattccctcagtgatgggcttggcattggcttgtcgtgacaaatgtagtctggtcgactccacgtgggatataatggtttgtggtgagtccaataaactcaagatttcgaagggagatgggctgagcattatattcccaagtgaaccatggctatcaatatcgcagggtctgtaacaaggattatataatcgtcgaacattagagcgtgggttcttgagaacgctactctaggttgtgcgtcgtttaattatatctggctactgtaaggcattcctga

SEQ ID NO: 88 - DNA, 1368 bp, Zea mays
tgaaacatttatagccgttagacacagccgcccattaattccccaccctcggcgtttaaaatttgcaactctgctgcatcttcttccattccccactctccagtctccactagcatcagtcgccgccgcctatcctcgagcgccatttccatcaacagcatccgcctctggcaagctagcgacagcaactcatggcactccgcgcgctcgacaatacgaagcccgccgccgtcgaggagcggcccaagaaggtggctaaggtgggcgtccccgccgccgccgccaaggccgccgcctcccccgggagtggcggcaagaagaagaaggggaacgacgagaactcggcgccaagggccacggccgcggcggcggagcaggccgtggagtacatctcgtcggaggagctggaggcggcggccagccccaaggccaaggccgcggggctggtcgcggacctggactccaaggactgggtcaggacctgcgaggcgctcaacgacgcgcgccgcctcgcgatccaccaccccgcgctgctgaacccgatcctggagaaggtggtgctggcggttgtgaagacgatgaagagcccccgcagcgcggtgctcaagacgtccatcatggcctgcgccgacatcttcagctccttcggcaacctgctcgcctccgtctccgacgacgccttcgacaagctgctgctccagctcctgctgaaggcgtcccaggacaagcggttcgtgtgcgaggaggccgagaaggcgacgcgcgcgatggcggcgtcgatgccgccgctgccgctgctgaagaagctcaaggcgtacgtccaccacgccaacctcagggtcagggctaaggccgccgtcgccatctcccactgcgccgcccggatggacatcggcgcgatgaaggagttcgggatgtcggcgctgctgcagctggcggtggagctgctgaacgaccggctgccggaggcgagggaggccgcccgcggcgtggtggcgtcgacgcacgcggccttcgtcaaggaggccgccgcgagcggccaggaggacgacgctgccgcgtcctgggagagcctctgcgcgctgagcctcccgcccatctccgcgcaggccgtcgccaagatcgctgccgccgccgccgcctcctcgcagtagccacggcacgcgtgcggacgtgcgccgctggcgttgtttttgggggtcgtctggttcggttcagaagtagcgctcgtgagtcttcagacagagctcgtttgtcgccgccgccgagtctgtttgtttgttctttctactccatgctatctcgcatggttagtgttctgtttatggcttcgtcaagtaataacatatcaattaacatagtttacta

SEQ ID NO: 89 - DNA, 2169 bp, Zea mays
gccaactgccatgtgaccaccggctatatatagcgatgcacagctccccttgctctgatcacgacccgcgtgtaggtgtagcactctccatcctcattgctaactgctcgattctcctccatacccttgtgcacgcacagccgacactgcagtgaggaacttgaacagaggaagaagcccggctgagcgctctctcgtctagctagctgcgctgcggcgatgaagatgcatcgcttcgctctgcgtggcctggggtttctcgtcctgtggatgctgcattgcggaagcgagctcgccgcggcggtgcctccagatggctggtacgattactccgcctacaccgactgcaggggccagccggagccggcgctgtacaacggaggcattctcaagttcggcagcagcggcggagacccggacggataccgcacgacggagaccggcgtcttctccccggcgttcgtggtgtacaacctcaacaagaccaccatgtacaccttctcatgctgggtgaagctggaaggcgcgtactcggctctgatcaccgcgaggctggcgccggacaacaccggcgccaggtgcatcgccacggtcgttgccaggagcgactgctgggccttcgtcaagggcggattcgtcctggactggccgacgcagacctcggtcatcttctttcagaatgctgacaagacgcccatgaagatcaccgtggcgagcgggtcgctgcagccgttcaccacggaccagtgggcgatgcaccagcaggataccatccggaagaggaggaagcgcgtggcgaccatccacgtggccgacccgcagggcgcccgcgtggtgggcgcgtccgtgtcggtgcagcagacggccaaggacttcccgatcggttcggcgatcgcgtccaccatccttgggaaccaggcgtaccagcagtggttcgtggaccggttcaacgcggcggtgttcgaggacgagctcaagtggtactcgacggagcccatgtcggggcagctgcgcttcgacgtgccggaccagatgctggcgttcgtgcggtcgcaccgcgtgatggtgcgcggccacaacatcttctgggagaaccaggacgcgacgccccggtgggtgaagaacctgacggcggacgacctccgcgccgccgtcaacacgcgcatccagagcctcatgacccgctaccgcggcgagttcgcgcactgggacgtgaacaacgagatgctgcactacaacttctacgagcagcggctggggcccaacgcgtccgcggagttcttcagcgtggcgcaggacgccgacccgctggccacgctcttcatgaacgagtacaacgtcatcgagacctgcgacgaccccttctccaccgtcgacacgtacgtgtccaagctcaaggacctccgctccgccggcgccatcctggaagggatcggcctggagggacacttctccaagcccaacatcccgctcatgagggccatactcgacaagctcgccaccctggggctgcccatctggttcaccgagatcgacatcagcaacaagttcgacgcgcagacgcaggccgcctacctggagcaggtgctgcgggaggcatactcgcacccggccgtcagcggagtcatgctgtggacggcgctgcaccccagcgggtgctaccagatgtgcctcacggactggaacctcagcaacctgcccacgggggacgtggtcgaccgcctgctcaacgagtggcggacgctgcaggcggccggccagaccgacgcgcacggcgcctacagcttcaccggctacctgggggagtacgtcctcactgtcagctacaacaacaggacgacgcaatccaccttctcgctgtcgccgggagacgagaccaggcacatcaacgttcagatgtgatgcgccaacattatatttagggctcctcggatcggactacttattactagctgatgtagtgattgttgtggaagaagattgcacagtcaatctatgtttcttacttgtcctgtgtcaaatttagtgtaagaactggcgtccttgacagctggtatgtaaaatagtatgaccaccactattactatatataacaagagacttcactccacattaatcttcacaagacgcataaatgagaaggggcagggccgcagcccgcaggggatc

SEQ ID NO: 90 - DNA, 2064 bp, Zea mays
cacgggagggagtttgggttggggaccggatccaccaatttttcttccggcgatgggaaaacgaaagagacctgcatctgattccattctggaagcaccccactccaatccactctacatgtcccacgctcagacccgggtccctcaccgccgtctctcgcgctccggtagatataatttgatgggaagatgaatggtgcagaggaggaggagccgcctcacgtcagcagcatgcccaagacacaagacggtgttaccaagcccagtctagggaaagagcccatcccagggagcgagctctggacggatgggctcatctgtgcttttgagctggtcaagagtcacaggaagcctgttcagcacaaatcatggctggcaactgagcagatacaggagaagggccccactatgtgcacgaggaagcactcaagaaggaatgggcaccagatcactgagccgaaagtggatgagagcattgtgttggaaaacccccagcagactgatttcagtaacgatccttcagtgctcaaagataggccattgtatgctggggagattttggatcataaatgggtgcctattggatggaataggatcgccgagctggtcctgagggttcagtcagactccagctgggagaatgagttgatggagatgagtgatagcgaggatgattacaccgtggctgatcttgcagctccatactggcagcgccctgtgggacctacttggtggtgtcatgtcaccgcaggccatccttcaatagatgcatggttgaatagcgctcactggatgcatcctgccatcagaattgcactgagagatgagagcaaactgataagcgaccggatgaagtacctgctctacgaggtcccagttagagttgcaggagggctgttatttgagcttcttggccagtcaataggagacccaaatcatgaagaggaagatatacctattgtgcttaggtcttggcaagcacaaaattttcttgttacaacaatgcatgtcaaaggcccttcatccaatataaatgtgttaggagtgactgaagtgcaggagttgcttcttgctggtggaagccaaacacctagatcagtgcatgaagtaattgcacatttggtcagccgtctttcacgttgggatgacagattattccggaaatatgtatttggggaagcagatgaaattgaattgaaatttgtgaataggagaaatcatgaagatcttaatcttgttagcatcatactgaatcaggaaatcagaaggttagcaacacaggtaatcagggttaaatggtcacttcatgcaagggaagagatattaattgagcttctcagacatttgaggggtaatgccacaagagctattctagagagtattagaaagtgtacgagggacatgttggaagagcaggaagctgtgcgcgggcgcttgttcactattcaggatgttatgcagagcactgtccgtgcatggctacaagatagaagcctcagagttacacataatctggcaatttttggcggcggtggcatggttttatccataatcactggccttttcggaatcaacgtcgatggcatacctggagcgcagaacaccccctacgcttttggtttgttcgcgggacttctcttctttgtagggatcgtcctaatcggcatggggatgctgtatcttgggttacagaatccagttaacagtgagaaggtgaaggtgaggaagctggagctccagcacctggtttcgatgttccagcacgaagcggagcagcatggcaaggtcagggaaggtgttagccggcatggcgcctcgccgagttcatccacggcctctgatgaagggtacattcttatctcctgagatgggagatttatttgctgacgtgcaaggtcttgttttgaaaggctggaactgaagagaagtcgggtaaatggtatacttacacgtgtcttaagaattgtaattgggggatttgacatcgaaacgttggatatgataattgtagcagcagattggctttcctctgttgcttgagatcgcggctgtgatcgtttctta

SEQ ID NO: 91 - DNA, 779 bp, Zea mays
tcaactgccgagggcggtgagcgacggatatttttggggcccacagtggagatgatcggtgatcgcagtgtctgggtcaccgaggctgtgttccctgtctgcaatttcgggcaagcctaggggcccaagcggaaaaggtaagccgactccggcggcggcggcggcgatcatggccgcgcagagggagaagtccgcggccgtggcggtcgccccagcacacggcgctgcggtttcggggtctccttctccttcttcctcatccggaggcccggcagtgtcggcgtcctcgtcgggagaccggtggtgcgccgcgatcggtaaccttggggagctcggcgccaacgtggacgcgctgcagaagctgctcgggcggaaagccgtcttcgtagacgatgacatcttctccaaggcctccctcgccgccgaccaggcccgcaccattaaggttcttgaccagagggtgcagtctctggaacgtgaactcgatgctgccatttcagcagctgctcgagctcgtgtagagaaacgtcaggcggaagctgcgcaacgagctgcagagttacgcacacgggaggtcacagaagaactggagaacactgctagggtgtttgagctgcacatggaggagttgcggctgaagcaagaggatattgcgaagaaagatagcgatatcaaggtgttagaagcgatcatacgaacccttagtagtaaagatgatgatggatccagcgaataattgccatgcacagggagcgaataaattgtttcgattgaaattc

SEQ ID NO: 92 - DNA, 1285 bp, Zea mays
cttgccaggtcgggcgtgggccaacgtaaaaagagtgacgtttcttcaccaatcaccctgcgtttcttctcctgttcatcacccgtgcgtgcgctctctctctttctcgtgcggcaactgcgaggccgccgacgcccgacggcagggtgcccaggccttcttcggtcccatcgcgaggccatagttgcatcattcgcctgagacgactgcccaccaccaggactgatctcctcactaggggcgtagaggtgaagagaagaacttgacaatgagcagcataggcacaggttacgatctgtctgtcaccaccttctccccagatggtcgcgtcttccaggtcgaatatgctaccaaggccgtcgacaacagcgggactgttgttgggatcaagtgcaaagatggcattgtcctgggtgttgagaagctggtaacctcaaagatgatgctggaagggtcaaaccggaggatccattcagtgcaccggcactctggcttggctgttgctggtttagcagcagatggcaggcaaattgtttcaaggacgaagtcagaagctgccagttatgaaaaggtctatggagaacccattcctgttaaggaattggctgatcgtgtggcaagttatgttcatctttgcacgctgtactggtggctcaggccttttggctgcggtgttattcttggaggttatgatagggatgggccacagctctacatgatagaaccctcaggagtttcttataaatactttggtgctgcattagggaaggggagacaggctgcaaaaactgagatagaaaagttgaaactttcagagcttacgtgccgggaaggcattgttgaagttgcaaagataatttatggagtgcatgacgaagcgaaggataaagctttcgagttggagttgagctggatctgcgatgaatcgaaccaccagcatcagaaggttccaaatgaactgttggagcatgccaaagctgctgcccaggctgctcttgaggagatggatgccgactaagagacacgatgatttgcccaaacttggtgttttcggtggtgttgatatctctgatcccttggggggggggggacccactaggggtaggcacatttcaaccgaaaaccgagccgaactggaatcaaggttttttcggtttttcgattcggtgtcggttttcctttcttacgaaccgaaaagatcggctcggcttcggtttctatttgctggacaccgatacaaccgaacttactgcagtctaatgtcctgtgtggcgcgcgttcaact

SEQ ID NO: 93 - DNA, 1621 bp, Zea mays
tcttcttttcttctggtcccaaaagcatttggcgacgctgcatctggttcagacaactttacgtacgtggtcgaccaaattaacagcccactgacatcgtttggttcgtacaaattaagggaagaagaacgtggtcacatgctggcgagcttagctatttcctcgatgcatcgtcgtcgtcgtcgtcgtggagtctgaccagaacagccgccacaagcccttctcaactcaagtctcatctcatcatctcccacctacctaaactaacagcccacggccaacttgcaggacgcatgggcgcatggcatgtggcggcatataaatggaggcagccgagcgcgcaaggtctccacacgcctctcttgctcaccattctcttctaaccagccaagccaaggcgcatctagcgagctgagcagcaatggcggctgctacttcttctaggcgccctgcagctgctctgctggtcctggcagcagccgtcgtggccctggcggccgagggggccaggtacccgccgctggcgccgggcctgtcgttcgacttctacaagaagagctgccccaaggcggagtccatcgtgcgggagttcctggcgtcggcggtccggcagaacgtggggctcgccgcggcgctgatccggctccacttccacgactgcttcgtgcagggctgcgacgcctccatcctgctggacgccacgcccacccagcccagcgagcagcagtcgccgcccaacctcacgctccgccccgccgcgttcaaggccgtcaacgacatccgcgcccgcctcgaccaggcctgcggccgcgtcgtctcctgcgccgacatcgtcgcgctcgccgcacgtgaatccgtcgccctgggtggcggcccggcgtacaagttgccactgggcaggcgcgacgggctggcgccggcatcgaacgccgccgtcctagcggcgctcccaccgccgacgtccaaggtgccgacgctgctgtccttcctggcgaagatcaacctggacgtgacggacctggtggcgctgtcgggcgggcacacggtgggcatcgcgcactgcagctccttcgacaaccggctgttcccgacgcaggacccgacgctgaacaagttcttcgcggggcagctgtaccggacctgcccgaccaacgcgacggtgaacacgacggccaacgacgtccgcacgcccaacgccttcgacaacaagtactacgtggacctgctcaaccgggagggcctcttcacgtcggaccaggacctgctgaccaacgctaccacgcgccccatcgtcacgcgcttcgccgtcgaccaggacgccttcttccaccagttcgtctactcctacgtcaagatggggcaggtcaacgtgctcacgggctcccagggacaggtccgcgccaactgctccgcgcgcaacggcgccgctgctggtgacagtgacctgccgtggtcgtccgtcgtcatcgagaccgtcgcggacgccgccggtagcctcgtgctctagataataagcaaataagcagtttgaagcttgcttcgcatgcatgttgcaacaaataagcagctagtagcgatcgatcgattggaaataaagcagctagtagcgatcgttattaca

SEQ ID NO: 94 - DNA, 958 bp, Zea mays
cctagggcgactgggcgagtcagtacttcagacttgagtccacccagccagccaagacacgcagcgcaggcgcagcccagccagattcgacccgagttcacgacgagagcacgagatggcgatgcgaaccgcgctgacctccctccccgcgcgcctgcgcgctcctgcgccccccgcggcgacgggcggccggcgcctcctcagcgacgggaaggggcgcgtgctcagcgaggaggagcgcgccaaggagagcgtctacatccagaagatggagagggagcggcaggagaagctcaagaagaggctcgagcaggagaaggccgactccgacaaggccaagcccgccgacgccgacaagaaggccgagggatctacctagctaggattggcatggcgctgttggaaggcaatcacgtttcgcatgtatccgaatccgatggtcagctttgtgaatgaataaattctgtaaaacgtcaacagcactggatatgctgttgcttcggttgcttgcatgttgaagttgaagacgacattcatattttgatactgctgctctttgtggactcgcggtagattggtctttgtggtgttacctgctgttttgagttttctggttcctggctcggagacaaggacttcgaggtacagctgacgcgtttcctcggtctgcctgcttgcacttgccccctcgaccccgaggctgattcaaattgcatcgtgatcgaaccaagtttatgccaaaggaacttgggttccatattgcacccggtccgctagacacgtacgaagtccgatgtccctattccctacgaacgtaccagaagttcgatacggtgcctatgaatttcgttgacatgttatgttgtggctagcagaccgtgtatatatttgtgtaaaatattgttcgctttgattaaaaatcggctgcaatctatatagacaaaaaaatttataaaaa

SEQ ID NO: 95 - DNA, 1772 bp, Zea mays
ggcgcatccggccgtccgtccttccggagccccacgcgataggcggcaggagcggccgagcgggacacgcgttgcagttcaacaccgcagtggcattctcgctactgagactgagaggcagcctccctccctcgtgggcgttctaccgcgacgggggtcgctctataaagagcggacgcgcccccgctgctctgctcatcgtcctccgctccagcagctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatcacgttcagcgcggcgcggacgtgcgcgcaggcggagcggcagcggctgaacgtgtcggtgagccccgagtggggcgtgctgccgatgcagaccatctacggcagcaacggctgggactcgtacgcctgggcattcaaggcgaagatggacgcggtgacgctggtcatccacaacccgggcgtggaggaggacccggcctgcggcccgctcatcgacggcgtcgccatccgtgcgctgtacccgcccgcgctcgccaggcgggcggggggaaacaacctgctcaagaacggcgggttcgaggagggcccctacttcctgcccggcgcgtcctggggcgtgctcgtcccgcccaacatcgaggacgaccactcgccgctccccgcctggatgatcgtctcgtccaaggccgtcaagtacgtggacgccgcgcacttcgccgtgccccagggcgcgcgcgccgtcgagctggtgggcggccgggagagcgcgctcgtgcaggaggtccgcaccgtgcctgggtggacctaccgcctcgccttcgccgtgggagactcgggcgacggctgcgcgggctccatggccgccgaggcctacgcggcgcgcgccacggtcaaggtgccctaccagtccaggggcaccggaggatacaagcgcgccgtgctggacttcacggccatcgccaaccgcacccgcgtcgtcttccagagcaccttctaccacatgaagcccgacggcacgctctgcggcccgctcgtcgacgacgcctcgctcgtcggcctgcgcaagaagaagcccgcgcgccgcctcatgcagctcctgtaagcgctgcttccacgtgcactacgcccggacggaccgcgcaagcgatggtgtaatacggctggtatgtgttttttggtttggtgtgtgcgtgcgtggtatacgcgtgccgtgcgcgccctgtggctgtggctgcagtggcgtcgcgttgggtgttttcttgttgtgacgaagaaaaaagggtatgggttggggtggtccgctggccggcgcaccggggttttaatcaacttatattaacctgatgaaggtgaaggtgaaggtgacacgggattaatggcaaaaatgctcctagtactatttttgta

SEQ ID NO: 96 - DNA, 2203 bp, Zea mays
caatcacaactcttcctctgcatccacacacacttgagccccacccgtgccgccgccccgcatcccttagcgctgccgctgccgctgccgctgccgccgcccatgtccgccgccccgccccgccgcgtggtcatctgcggcggcggcgtggtgggcgcgtgcacggcctacttcctcgccacccacgccgcgtcccccaccgtcccgacgctcgtcgagaggtgcgccccggcgtgcgccgcctcggggaaagccggcggcttcctggcgctggactggtgcgactccaccccggcgctctccaggctcgcgcgggcctccttcgcgctgcaccgccgcctggccgacgccctcggcggcgccgacgcctacggcttccgccccgtccacaccctctccgtcctgctccccccgcaccccgccgcctcctcctcgccgccgcacccgctgctcccgccctgggtcgacccctccgcgtccgccgccccgccgagggagctcgggacccccgacaccaccgcgcaggtccacccgggcctcttcaccaaggccgtcctcgccgcgtcgggagccgaggtcgtcatcggcgaggtggagcgcgtcgccgtggcctgggacggccgcgtcgccggcgtcgtggtcaaggggcgcgacggcgtgctggacgccgacgccgtcgtgctcgcgctcggcccgtggtccggccgcctcgaggtggtcagcgaggtgttcgacgtgtccgggctcaaggcgcacagcatcgtgctccggccgcgcgagcccgagaaggtcacgccgcactgcctcttcctcagctaccagccggagcccggcgccaagatgctcgaccccgaggtgtacccgcggcccaccggggaggtgtacatatgtgggatgagcaaggacgagaacccgccagatgacccagcaacgataacaggcgagccagactcgattgcaatgctgcataagatcgcagggaaagtgtccagccagctgaagaaggaggagggcgctgaggtggtcgcggagcaggcgtgctacctgccgtgcaccgccgacgggctgccggtcatcggggagataccaggcgtgaaggggtgctatgtggccacgggccacagctgctggggtatcctcaatggtccggccaccggcgcagccctcgccgagctcatccttgacggcaaggccaagatcgttgatctcgaacctttcagcccggcaaggtttctcaagagaaggagcaggcgtggagtctgacagtgtgaatgttcagattcaagctcgctactgaataaaacactcttggttctcccttttgcatgactgatgagtgttgcaaaacatgtatgtgcgaataaatcatggatatatagtacttgatgttctgtatttgttgttaatcacagacggacaacttgccaacacccatgatcagattcagatgttcatttagctgaggttgagctcgacaagctgttgcatctgcagctattctacgtacaccatgtctacgcaatgtttccttgtggtcaagtgacacaagtaaccttataaaaaagtgctctttctctccgtatggttcaccacatgcctgtgatctctctcaagctaggtatcatagaagtccgtcatggaattgaagtggtagagtgcagccttcctttcccagcttctgctcggtgacatctaccagcttccagacacagtagctcagcctgagtgttaacggactcgagcaagaagatgccatccttcagcaagttctgcttcggcataagctgtttgcaagttgctctcgcccacctctgcttcagatggttctgaagaactggctgcctccgtacccccaccagcaggtgcgcctgaatccgtttcttcctgctgtgcctgcgcagtgctaggcggggaaccaggtggcgggttctgttctgccagactaagacgaagcgacctcccttccagctcctgcattgccgttccataaccatgttagccactgcaacagtaaggtcaatgggactcaagtgatatgaactatgaaggtatacactcaagtaaatcgcaattcatgtattcacattgacgaagtgcaattagcatctatattagctaccttgtgtgctctaatttgttgattcagtttgaagtgcccacaggccacagataacaatgccactggatcagttggcatttccat

SEQ ID NO: 97 - DNA, 1934 bp, Zea mays
gcccgcagccacgacgtctactcgcatcccaatctccgtcgtcccccgcggccccgcctcactccttacgccgcactccacctccacatcgccgcccacacccgaccgcgtggccggcctcatgtgggagcgcggcaggccgccccgcaagccgcgcccgtccccaatcctcgtgccgccgccaccgtcgtcgccgcctccccgcctgaacctcctcctcccgagatccctcctcgcgctcgccgcgcgcgccatgccgtcgcgccgcccctccccggtcctcctcctcctcctcgcgctctcgctcgccctcctcttccttctcctctccccttccttcccctccacctcccgcttctctcgctccctcagctctggctccgctttcgcctcctcatctccggcgtcaacctccgccccgcctgcacccgtcaagatctacctgtacgacctgccggccaagtttacctacggcgtcgtccgtagctataaggctgcgcgtgcgacatctggctccgcggacgccgctgctactctgcccgacgagcaactgcggtacccgggacaccagcactcggcggagtggtggctcttcaaggacctgctccgacgcaggccgcaggaccgccccgtggcacgcgtggacgacccgagcgacgccgacctcttctacgtgcccttcttctcctctctcagccttgttgtcaaccccatccgctctccgctggcagcaaacgcctctggggcggggacagcgtacagcgacgaggccttgcaagaggagttgctagagtggctggagcggcaactttactggcagcgccacagggggagggatcacgttttcatctgccaggatcccaatgccctttacagggtggtcgatcggatcagcaatgccgtactcctggtttctgatttcggcaggttgcgcagcgaccaggcatctctcgtcaaggatgtcatcctgccctactcacatcgaatcaactccttcaagggtgaggtcggggtggatggtcgcccctctttgctgttcttcatgggcaataggtaccgcaaggagggagggaaggttcgtgatgcactttttcagattcttgaaaacgaggatgatgtaaccataaaacatggaacacaatcgagggagagtcggcgtgaagctacacaaggaatgcactcatctaaattttgcctgcatcctgccggagatactccctcagcatgcagattatttgatgcacttgtcagtctgtgtgttcctgttatagccagtgattacattgaacttccattcgaagatattatagactacaataaaatatcaatatttgttgggacaagcaaagcagtacagcctggatacttaacttcaactcttcgaagaatcagttcagagaggattctggagtaccagagggaaataaaaaaggtcagacattactttgagtacgaggatccgaatggaccagtgaatgagatttggcgccaagtatcccttaaagcaccactgataaagttgttgactaaccgcgacaaacggttgcttgaaagaggcaccaatggaacagattgttcgtgcatctgctctacaactccaactgacataactgcggccagttaaacaagatggaactcatcggcctacaagctctgtgcctatttcctgtgatcacattgcctgaattttttaggttgtacagttccatgtaaaacgagattaccagccactatttttgaacagtaaatttactaattaccacaatccttgagtttttactagatttgtataggaggagcggatagtcaggaaccttacagtgccctttttgtattgtaagttacattagctattttttgttgtcggcagttcgctgccctagtttttcgacctacataagcatcaatccccgtgccagtgcgtggaccaagtt

SEQ ID NO: 98 - DNA, 2154 bp, Zea mays
tttcggtagactctcccttgccgcctccgcctccacctcctacaggctacaggcctacagctgcgacctgcgagcgacggctataaaaccttcgcctccactcccagccgcgaagccctactcaacttctccttttcccccggcgattattccggccactgaccttcgttgcgtgccgctcgagaacccggttcgagaatcgacggcgcgcggctgcatgagagggtgatataaaatcgataaaaaggacgagcagcacgactctcatttttttgggggagggttgcggtggaagaggattgcgctggagagaacccaattttagggcggtgccggcgcgaccgttccgggatcgggagctttatctggggggcgcgagggatcacggccgcggcgacgaccgaccgaccggccggccaacccaaccccaccaccaccagtccccgcggcccgcgtcgaggaagaagaagggataggagacggagacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgcggccggccggggccgtggccgcggccgtggcgtccgatgccgccacggcctccgcgccgggggccagcgggaggaaggggaaggcgtcgtcgtcgtcgtcggtggttctgcgggtgccggccgggtcccccatggtcgccgcgcggaggcaggcgtccgcgcgcagggagatcgccgtgcgccgggcgcgggaggccgggcgggagtacgagctcgtccccaccgctcgcggcgagacgctcttcacgcagtgctggtggccgcacccgccctccaccgttaaaccgagggcgctagttgttgtcatgcacgggctaaacgagcacagtgggaggtatgaccatttagcgaggcgattgaatggcatcggcatcaaggtgtacgggatggactggactggtcatggtggaagtgatggtctccatggatatgtgcaatctcttgatcatgctgtcagtgatttgaaaatgtacctcaagaaagtgttagctgagaaccctggtcttccatgcttctgcttcggtcactcgactggtggaggtatcattctgaaggctgcacttgatccagaggtagaaactctccttagaggtattgtcttgacatcaccagctgtccgtgttcagcctacacacccaatcatagcggtcatggcaccgatttttgccctcatcgcgccgaggtatcagttcacggcgtcccacaggaacggcccgccggtgtcgcgcgaccccgaggccctgcgggccaaatacacggacccgctcgtgttcacgggcgccatccgcgtgaggacgggctacgagatcctccgcctgacgtcgtacctgcagcagcacctgcaccggatcgcggtgccgctgctggtgctgcacggcgccgacgacctggtgaccgaccccaggggctcgcgggcgctgtacgagcgggcctcgtccgcggacaagtccctcaagctttacgacgggctgctgcacgacctcctgatcgagcccgagaaggacagggtgatggacgacatcgtcgcgtggctgagccccagggtctgacgccgccggcgcgttgcggtgctggccgtaggacgcgagcggcttttcgatcatctgcaggccaaggacgcctcgcctccggatggtgggtgatgacgcggtctggtctggtaggctgcggaccgagggagagcgggtgtgccttctcgcccccttggtgtgctgaactgctgagtgctgatacgatacgaggagcaggacaggagtacggagaactactactacctacggctatgggcgatggctttactcgcgcctcccggtgtgtcccgagattttttttcggggacacgtacgaattatgtaacggagttcgtttcgccgtgccacacgcacgagcggtgtccgatacacctatagaaaacgactttccatattgcgagttgtgtgatgtattcacacaattctgaatcagagttgcaacttgcaacggattcttatcttctgctcttctcac

SEQ ID NO: 99 - DNA, 1939 bp, Zea mays
ctttagtctgacatccctttttttaatcagataatacacctcttcttccctcaccttcctccttctcccagctgcggcgccaccctcgggccgtccgccgtcggcggccacgaccctggtgtaatctgctccatacgtggcggcgcctgcaaaagccacgctgctgccagtgccagccatggatgcagtggcgaccagcgacgccgtactcctccttgccgccgtagctatctccctgctcatcactgccactttctggagcaggcatcgtcgtcagggcgaagcgccgagcccgccgtcgctaccgctgctgggccacctccacctgctcggcaacggcaagccgctgcaccactcgctggcggcgctggccatcgcgcgcggcaccgggggcgccccggcgccgctcctgtcgctgcgcctgggcgcgcggcgcgcgctgctggtgtcggagcacgccgcggccgaggagtgcttcacggcgcacgacgccgcgctgggcggccggccgcggctgctggtcggggacaggctcaactacgggtacaccacggtgggctggtcctcgcacggcgaccactggcgcgccctccgccggttcatggccgtcgagctgttcgccgcgtcccgcctcgccgcgcgcgccgccgaccggcgcgccgaggtcgccgcgctcgtcggcgccctggtccgcgacgccccccgcgccggcgccgcggtggcgctccggcccaggctcttcgagctggtgctgaacgtgatgctgcgcgcgctcaccggcgcgcccggccacggcggcggcgacgtgcgcggcctccaggagatcatcgaggagaccttcgcggtgaccggcgtcatgagcgtcggggacttctacccggcgctgcggtgggtggaccgtctgcgcggggtcgacgcggccctgctccgtctccaggcgagacgcgacgcgttcgtcgccggcctcgttcacgacggacgccgaagccacaatcgcaaagctggcggtggcggtggcccaacagacacggagaagaggagcaccattgacgagctcctgtcgctgcaggaaactgatcctggctactacaccgacactgtcatcaaaggcattgtctcgatactgctcagtgcgggcacagacacgacggcgctgacaatggagtgggcaatggcgcagctgctgatgcaccgggacgcaatgcagaaggcgagagccgagatagacgccaacgtcggcacatcccggctggtagacgagtcggacacgactcacctcccgtacctgcaatgcgtggtgaaagagaccctgcggctctgccccgtcggcccagtcatcccggcgcacgaggccatggaggactgcgccgtgggcgggttccgcgtccggcgcggcaccatggtcctggtgaacgcctggctcatccaccgggaccccaggctgtgggaggcccccgaggagttcaggccggagcggttcctggacgccactgccacggtcgccgcccccttgctgccgttcgggcttggacggaggcgctgccctggggaagggatggccttgcgtctcctcagcttgactctggcggctctcctgcagtgcttcgactgggaggtcggtgggtgtgttgacatggccgaaggcgttgggctgtccatgcccatggccaagccgttggcggcagtctgtcggccccgggagttcgtccagaccgtgttgtctgcttcaacatgagtagccggatgcggttcttttccctgatacatgaatccagaaggggattgaagaggtttaaatccccttctagttatttttgactaggaggaggtttaaatccccttctaattatttttgactaggaggagatttaatcccctctatctctttctggattgttgtaaccaaacatgcccccgaagaataaataaggattgggtg

SEQ ID NO: 100 - DNA, 975 bp, Zea mays
ggaacccaaaatccgcagcatccactgacttcctctgttctctttctcctaccgcttcgtggcttccctgcttccgctccaatggcgtctctcctcttggtcccgcgcctcacccggagcccatgttccaacccaggacccagtgccggtcacaagcctaggcccgtgtccatcacctgcgggccgcgcgacaaccgcgggcccctccagcgcggccgctccctctccacggaggccatcctggcgatccaatccctgaagcgcctcacctccgccgaccgctcgccggcggctgcctcggccgcagcagccaccgccctgggccgcctcctcaaggccgacctcgtggccgccatggccgagctccagcggcagggccactggtccctcgccctcgccgcgctccacatcgcccgcgccgagccctggtaccgcccagacccggcgctgtacgccaccttcgtgtcctccgcgccgcactcgccctccggcggcgagggagacgccgaggccgccgttgacgcgctcgtggaggcgttcctggaggagaaggcgagcggcggcgggttcgtggacggggaggaggacgtgtacaagctcacgaggctgctgcgcgcgctggtggccaagggcaggggccgcgcggcgtggagggtgtacgaggcggccgtcaggaagggaggcctcaacgtggacgcgtacgtgtacagggtgatggcgcgggggatgaagcggctgggcttccaggaggaggcggcggaggtggaggaggacttcgcggaatgggagaccacggtctcaccgcccgccagggacgtgctcgacgaaatgcgagcaagagacgagatcaaaaccactgctgctgcctcctagtcctatagcccaccagggtttttttagctgataaatgggtttggttggtgctagaatttgtcatgctactgcaacaacggtgatactgatacgtcttcttta

SEQ ID NO: 101 - DNA, 1111 bp, Zea mays
aagagcaagtgacgactagaccgactaatccgactccctagctcccacactaccaccatcccaccatctttaaaaagcccccaccactacatcctgcgctgcaaacgcctcgcctctcctcgcctctgttcagctcacggtggaagaggaggcgacaggccgacagcacacgagagggagctagcactagcagaagcgcgcgaaggagctcaagcagccacacgccgaccagcaccaccgcgcgatggcgtgcatcaacatgtacaacccagacggcgcggcggggttcggcggcggcccgcagcagccggccgcgctgggcccgcgcatctccttctccagcgacttcgccgtggagccgacgccggtgcagaaccgggcgacgagcctgcggtgccaggaggaggacctcaacttcgagttctccgtgggcagccaccccatgatggccgccgaccagctcttctccaagggcaggatccttcccctcaaggacaacggcggcggcagtgtctgcttcgctgccgcgcggccgcccaccacgctgcgcgacgagctccgtggcggcggcgacgacgacgacgagagggcggccttctccgccgccggcaccaaggggtccaactccaaccggtggaaggagatgctcggcctgcggaaggcgctctgcgtcggcgtcggcggcggcggcaacggcagtccggccaagaaggctagcagcagcgacaagcagggcgtcgttgccgccgctgcccccggccccgacgaccacatggccgcgtccaatcagcaggagcagctatcatgatgaggcgaccgtaccgacgggagactgggactgggagagagagacgacgagacagccatgggatgggagcactccacatgcgtgaacaagctttaaaattttgtcatccctccttccgatcatccttcctgatgctgttgatcgatcaaccacttgaatcatgcttgtcatcatcggtccatgcctccatggtctagtaggttctgtaaattgttgtgagtttgcttgtgtgctagctagctaggtggcccggcccggccgttgaaaagtgccaaaaaaaaaatacatgtgtattttccctgc

SEQ ID NO: 102 - DNA, 1956 bp, Zea mays
gagtagcgcagaggcggcagggtgggcgaccagtctcctccgcacgcttcccaccgagctcacacactgcacactcccacactcccactcccacctgtaggttcacgggaggcgaggaccctgccccccctgcattcttcccgtatcgcggaccgatcctcgccgcgggaggcgagcggagcggggcgtttctgcgggggagaagcgcgtccctgcaatttctgagagaggggaggcggcgagtggaaaagagcaggcgttgctatcctatcttgctgacacagcggcggtgtggcgaggcgcatggcgagggcgcgcggtggcgccgcgtggtgggtgctggcagcggcgtgggtgctgtgggcggctgcggctgcggcggaggcggaggccaggtcgccgtcggcgaggagggtgcaccggcacctcaagcgcctcaacaagccggccgtcaagagcatcgagagtccagatggagacatcatcgactgcgtgcatatctcccaccagccagcgtttgatcatcctctcctcaagaaccacacaatacagtttaggccggcgtaccaccctgaaggtctatacgatgataccaagagcagcataggctcaaacaatgctggcgagaggccgatgctccagatgtggcatcgaaatggcaggtgccccgagggcacggttccaatcaggagaaccaagaaggacgacctgcttcgagctagctccgtgaggcggtatggcaggaagcggcacactgctccgaacccactgtctgttgatcccaacatgctcagtgagggtggccaccaacacgccattgcgtacgtccagggcgacaagtactatggtgcaaaggctaccattaatgtgtgggagcccaagattcagcaggctaacgaatttagcctgtcccagctctggatcttggggggttcatttggggaggatctcaacagcatagaggctggctggcaggttagccctgacctctatggagacaacaacaccaggctgttcacatattggactagtgatgcataccaagccacaggttgctacaacatgttgtgctctggtttcattcagataaacagcgaggttgccatgggggctagtatcttccccatctcgaactacgcgggctcccaatatgatattagcatcctgatctggaaggaccccaaggaaggaaactggtggatgcagtttggcaaggaatacgtcctgggctactggccgtccttcctcttctcctacctcgcggacagcgcgtcgatgatcgaatggggcggggaggtggtgaactcggagcccgacggcacgcacacatcgacccagatgggcagcgggcacttcccggaggaagggttcagcaaggcgagctacttcaagaacgttcaggtggtggacagcagcaaccagctcagcgcccccaagggcgtgggcaccttcacagagcagtccaactgctacgacgtgcagaacggtaacaatggggactggggcacctacttctactacggcggccctggcaagaactcgaactgcccgtgactggtgcttctaatgtgtagtgtgaagtgccgtcaccattagcaaaatgtaacccaagcgttcaggttcgcttatacagcgtcaatctgcatctccttgttcagtcctagctaggtagtgtgtaacatgtgcatgtgctctctagactctaatgttttcttcttcttttcattgtattttgttcttgtgccatgtaaagtttctgaagagaaggagcatggcttgaggctgcggtgggtggttgggctggtcggtggtgacctctactgatttttgcgaagtctgcttattggtcaccttcgccagttattttgaaagtgtgctatagcttgtttgatgatgaatgatagtaatgctgtaatggtattgagcttagtggttattattgcatccagttaaacc

SEQ ID NO: 103 - DNA, 754 bp, Zea mays
caaccatagaaatcctccaattattcgattcccaagccactaaggcccttggaggaacaacagaatccagaaaccgaaaagaggcctcactgctgccgcctgggccaagtcgtcgtcttgctttgccaatccgtcgctccacctgaacacaccggcgaagaggaggcgaagaagcgatgggcgtgaccaaggaggacgtcgaggcggccatcacctctgctctcagcccttccaatctcgtggtgacggacacgtccggagggtgtggcgcgagctacgagatcgaggtggtgtcggagaagttcgaggggaagcggctgctggagaggcaccggatggtgaacaccgcgctggcgtctcacatggcggagatccacgccgtctccatcaagaaggcgctcaccccggctcaggcccagccccaggcccagccggagccggccgccgataagccccaggcttaagtgcttaacaccccccaaaacggtttgatcccatatgccgatgcacgattacattggctatctgcttgaataatgcggcggatgcacttgctaaattgcaggatgttatccttgactgattagaaacttctgcaccgtgcatttaacttctgtgtcactgtgtgtgtgttctggatgcttctgccctggtcgtttgctcgagactgtgtgttgcagttcatgctgttaatgttctgccagggtggggttttcagtcctggaatttttatatttgactgttgctatgtctt

SEQ ID NO: 104 - DNA, 1482 bp, Zea mays
actagttcagcacttcagccttcactccactccaccacagtccacgcagcccaccgaaatggggaagctgctccctcgccacccttcccccctcctcctcctcgccgcggcgatctgcatctccagcagcagcctcgcggccgtccggggcgcgccggtgtaccgcgcggactacctggtggacgggaaccagctggtggacatgcagtaccacatgggccccgtcgtgtccgggacgccgaccaacctctacctcatctggtacgggcggtgggaggccgcggcgcaggccgtgctccgggacttcctcgcctcgctctcggccccggccccgttcccggccgtctccgactggtgggcgcgcacgccgcggatgtacgcggaccagacgggcgccaacgtgacgggcgccttcgccgtcgccggggagcactccgacgccgggtactcccacggcgcgtcgctccggcgcatcgacgtgcagtccgtgatccggtcggcggtgtacgcgtacccggacccgctgccgctggacccctacagcggggcgtacctggtgctgacgtcccccgacgtgcaggtggacgagttctgccgcgccgtctgcggcttccactacttcaccttcgcgtccgtggtcggggtcacggtgccctacgcctgggtcgggaacagcgccacgcagtgcccgggcaagtgcgcgtacccgttcgccgccgccgccgagtacggcgccgggggagcccagccccaggcggtgctgcggccgcccaacggcgacgctggggtggacgggatggtgatcgtgctggggcacgagctggcggagatgtccacgaacccgctggtgaacgcgtggtacgccggggacacgcccacggcgccgaccgagatcgcggacctgtgcctgggcgtgtacggtgatggcggcggcgcgggcggcctggtcgggaacgtgtcccgcgcgcccgatggcagcgcctacaacgtcaacggcgtcaacggccggcggttcctcgtgcagtggctctggaaccccgtccgcggcgcctgctacggccccaactccagcaactgacccgagtcgtcgctaggggcgagggcggttggaggacgcctcatgccattctgctggattgaatggcattgcagaaatccatggcggtttcaatggatggagacagcgttcgtccacttccctgtccgttcaggaatggtccacaggagacgggacgaggatcagatgatgaagccgacccagtaatttgaagctgcactgcatgagacacatcgtgtggatcctgcctgatctatctgcagttcggtaggaaacaacgagaaaatgccattttgttgttcgttttttttaccttgatttccgggactcgaattttgtttcagctcccgagccagcatctcttgcttgctgaaacaaagtggtcgcctgatcgattgctttcccctttttgactctgcatgctt

SEQ ID NO: 105 - DNA, 1992 bp, Zea mays
tcataagggagaaaccctctcctagacctccattacgtgcatccgtcgagtttcataatgtcaaatttctcccctgcgagacgagcccagcctaccactaccactctcgattaccagccctctcgccttctccgctcctccgtcgtcgccgaaccccatggccccaaaaccctaaactgagcccgccgctgcttctccagtccgcacgaagcgccccacaaaatgccgcggctgacgccggcgcacgccaccctcatcctggaccacgtcctgggcgatccctcgatccccaccgcagtcaccatcgcgttaatcgctgggatcccctctccctccgatccgaccccgcgcctccgccgcggggtccttctccgccgcctcgccaccgaccccgtatccgaatcctctctcgaaaccctccacctcctggcctcgctcccggcctgcgcctcccccatcgcagccgcccacatcgccgtcgcggcattcctcgcggcctccgcgcccgacttcgacgccgtcgccagggctctcttcgcgcgccccgacggccgcgcgcgccaagcggtccacggcggaagttcccccgcgctcgcatccgacgatgccatcgccacagtagaccagttcgaggctgccgtcgggatgtcctcctctcagaccatcctcagggtcctgtggggcaaccgggccgccgtggaggagcgggtccaggagctcctcgctgctgaatgggccgcgattggcccgtcgcggctcgaggcgttggctatgcggatcgtcggggatggggccgtcgatacatggggtgccgcagatgaggccatgcgtgccaatttgcgcatcttggctggggaagcaaaaacgcgcgagattctcgacaaacttgaaaaaactacctgcaacacaaatccaatttcaacaccagctgttgagaaggtgatggatgcgctcaaagcaagctgtgctgacctccacagcattgtggaggatccccttccagctgcaaaggcagttgcagatgagttattgactgcgaggatggaaaaattagttagcctgaatgcccaagaagtaggagggcagccaacaacttgtggcgttgcaggaccgagtattcataatgacaaagacaatggtccaggtataggcaaacctcacagccttatggagcggaacgcaacagcacgaacctctcagtgggaggagtcacttggtcttgatggttcggaaccaccctcaccaccgagaccacacttgcctagcccaaggagactaccaccttctcctttgtcaccgcctgggaacaaaaacaataatcggagaaaggcaaggaggtggagcttgttcgaagaagaaaccttaagaaagggtgttgaagagtatggtgttggcaattggagggatattctagataacaatgctgaggcttttaccggcaggacaccggtggacttgaaggacaagtggaggaacatgcttttccgttgatgtaacggggaaacatgtagctggacatgctttactagggtaaagtacctagcaattagcatgtagtcctcgtacatcacagcagactcttggtcaagcttttctggcagctgcagctacatgattttgtgtctcggtgtagtagcagccgcagcttttctggcagctgcagctacatgattttgtctcggtgtagtagcagccgcagcccaaacggttggctttcctggcagctgcagctacagtattttgtgacggtatgcttaccgagtggctgattcgcgcactgacgtattatggactcgattttgtatttttattatgtacattgtcctgcatgcttgcattgtactagctttactcatatatttggatgaatagggatcggaaaggtgaccccttgtagcagagcaaatttaggtgtcgtttggttcacgaaatgtaatataaatagtaatggtaacgattcacacttgaataccagcactaacaaatttgaat

SEQ ID NO: 106 - DNA, 1784 bp, Zea mays
aataaggtttgatcctattcatggggattccgtaaatatcccattccaaaaatcgaaacaatcgggacttttcggagattggctgcagttactaattcatgatctggcatgtacagaatgaaaacttcattctcgattctacgagaatttttatgaaagcgtttcatttgcttctcttccatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccctaggaatttcaattgcgcttatattcatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccagaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggtgctagggttatgaacttataatcatggaatc

SEQ ID NO: 107 - DNA, 1248 bp, Zea mays
ggcgtggctaccctacctcacaagtccaaatcagtttgtctgctccgcccgttgcccgtggcccgtcggtctctcttgcagtctcgccgctccccttcctcccccgcaggaatccgaatcagtaagtccggcgacctaggtctctcggcttgtccgcagcccgccggtcagtaatggcgcaggatgatccggttgtttctgctcagtggctgcacgagcacctagggatgcctgatgttaaggttttggatgcttcctggtacatgccggtagagaacagggatccatggaaagaatatcaggtggcacacatccccggtgcgctattcttcgacttagatggcatagttgatcggacaactgatttaccgcacatgctgccatcagaagaggcttttgcagcagcaatttctgagctggatataaaaaaccaggataaagttattgtctatgatggaaagggattcttcagtgcacctcgtgtttggtggatgtttagagtgtttgggcacaagaaagtctgggtactagacggcggtttgcctcagtggcaagcttctgggttcaacgtggaaaaggccagccctgacgatgacgcagttctgaaatcaatcgctgcaaacagggctgtcaaaagggtttataatggtgaacagacaaatacaatctcgtttcagactgaatttcagcctaatctattctgggcactggaaaaggtcgcacaaaacgtcactgctaagacgtaccaacagatagatgccagagcaaagggcagattcgacggcgtggcgccagagccacgggaaggggtaaggagtgggcatataccaggaagcgtctgcgttccgttccccgagatgttcgacggcgcaccaccgagccttctcctccccgccgacgagctgcggcggaagtttcagcacgcaggaatctccctggaccgacccatcgtcgtgacctgcggatccggcgtgactgcctgcatactcgctctggggctgtacaggatcggaaagcgtgatgtgccagtctacgatgggtcctggacggagtgggagggtcagtcggactccgattaccccaaagtcaccgctcctggtacagcttgagcgtctgggactgggagttggcagttttagactgccagcatgatggcattgtgtttgcgacaggctgaaccgattttatcgagcactggaagcattgtattcgctactggtaggcctgctaatggcaaaaattccaacc

SEQ ID NO: 108 - DNA, 1868 bp, Zea mays
gcagtgtcgtgggttgtgctcctgccctacctgtatttgtccacgtctccttcgaagcaatgaggccccctcctttcccctcgtgtgtgttgtcttggcatgtgagccttggcctggcctggccgcctggcctggccccctggagcaacacagtggtggtgctggacatttgttttcggggtttcgcttcatgtcggggagataaatccagaggccagtacgtaaagcagcttaaataccacttcagccttgcgttgcgttccttgccttgccttgcctgcttgcgtgcagtgcagtgcagctcacagcctcacaccatatcgctctgcggtgctagctccaggcctttatcaagccttccctgccccccttgataattccagagagagagaaggcgcgcagctagggaggtgcagagagaggagcggcaaggcgtgggctgtgggcacacatggcgagtgaggaggtcgccaccacagtgtgtgccgacgccgaccaagaagcagcggcggcggcggcggcggccatgaaggaggaaggaggaaggggcaagaggcggcggaggaggcagccgaggaagggagaggaggaaggcgggaggaagaagtacgcgctggtgagctaccacgagctgcccgagtacatgaaggagaacgagttcatcctcaactactaccgctccgagtggcccgtcctcaacgccgtgctcagcctcttctcctggcacaacgagaccatcaacgtctggacgcacctgctcgggttcatgctcttcttcggtctcaccctggtgcacctcggccagtacttcccccaggtggctgatctgattgggcatctctcctggccaatctcgaaggtcgctgaaaatgtctccagcaatattggagatgtcctatcaggcgcggccatgttcatccagacgaacccgagcctggcctcgcatggcacggcggtggcgtcgcagacgacgcggtggcccttcttcgtgttcctggcgggggccatgttctgcctgctgagcagcagcgcgtgccacctgctgtcgtgccactcgcaccggctgaacctgctgctgatccgcctcgactacacgggcatcgcggtcatgatcgtggtctccttcttcccgcccatctactacatcttccagtgcgagccgcgctggcgggcggcgtacctgtcggcgatcacggcggccggggcgggcacggtgtacgcgctcatgtcgccccgcctgagcgcgccgcgctaccgcgcccgccgcgcgctgctgttcgtcggcatgggcctgtccggggtggtccccgcggcgcacgcggccgccgccaactggcacgagccgcgccgcaacgtcacgctggcgtacgagggcgccatggccgcgtcctacctggtcggcaccgcgttctacctcgcccgggtgcccgagcgctggcgccccggcgccttcgacctcgccggccacagccaccagatcttccacgcgctcgtcatcgccggcgcgctcgcgcactacggcgccgccatcgtgttcctcagggctcgcgacgagatgggctgcccggccagttaggtgctcagacagtacgggcgcgccggccggatgcttgcccgcgacgacattatatttgcgggtgtccgtccagtgatcgatacgatatgatgattgggaaagaagaaactaaaccatatttttttttgtttacaccttttccttacagcagcagcagcaagtgtgcgagattcatcgttaatgacagagagttgattggcgtcagtcacagattccttgtcaatttgtacatagacgaagctcatcgagtaatgattgattaatacattctttcgatcggtttgaaaatgca

SEQ ID NO: 109 - DNA, 745 bp, Zea mays
gcgccacctcggagcccaggatttctaatctaatctaatccaaaacccttccggtctttgctgcggctgccctgctccatttgcagctagcttagctttggtttcctctgcttctcattctcccgtgcacttccagttcctgcccagcttgcagggctgctccaatggccaccttgtccgccatctctgccaacgtcggctactgcaaggcaccaaccctgagctggaagggaagcggagtaccaggccggattgtggtctccatgtccaccacccgaagaggcctcgtctccctaagacgacgatcccctcggtttcgcgtctacgcggcgaaggcggagacggtgagcaaggtgatggacatcgtgaagcagcagctggcgctggcggcggacgtggggctgacggcggagaccaagttcacggacctcggcgccgactcgctggacacggtggagatcgtcatgacgctggaggaggagttcaagatcaccgtcgaggaggacaatgcccagagcatcgccaccatccaggacgccgccgacctcatcgacaagctcgtcgaccagaagccacgagacagcgactgattgtcgacgcgacgacacccaaatccaatccatcgatcaccgctcgtacgtgcatgtgaatgctccgttattgtactgtaattgagttttttttatctctagctagagatatttatgaacacagatggaagagaagagttgatgatacctaccat

SEQ ID NO: 110 - DNA, 2011 bp, Zea mays
acctgtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaggcctggcagctcctctccatcttcctctccaccatcgcggggctcgtcctcggcccgctccccgtcggtgcgtgggcgttccttggcctcacagccaccgtcgccacccgcacgctccccttcaccgccgcgttcggggcgttcactaacgaagtcatctggctcatcgtcatatccttcttcttcgcgcgcggctttgtcaaaaccggactcggcgaccgcgtcgccacgtacttcgtcaaatggctggggcgcagcactttgggcctatcctatgggcttgccatcagcgaggctctcatctcccctgccatgcccagcaccacggccagggctggaggtgttttccttcccatcgtcaagtcgctatcgctctcgtccggaagcaagcccaacgatccatcggcgaagaaactcggctcttatcttgtgcaatcgcagttacaggcagctgcgaactccagtgctctcttcttgacagcagctgcacagaacctgttgtgtctgaagttagcagaggagattggtgttagtatcggaaacccatggattacttggttcaaggtttctagcgtgccagcagttcttgggcttttagtgactccttatttgatttacaaaatattcccccctgaaataaaggacactcctgaagccccagcattagctgccgagaagctaaagaacatgggtccagtaacaaaaaatgaatgggtcatgattgggacgatgcttcttgcagtctcactatggatttttggggaaactattggcgtatccagcgttgttgctgcaatgattggactctcaatacttcttgtgcttggagtgctaaactgggaggattgtttgaatgagaagtctgcatgggacaccctagcttggtttgctattttagttggtttggctgggcagcttactaaccttgggattgtgtcctggatgtcgaattgtgttgccaaggttcttcaatctttctcattgagctggcctgcagcatttgttgtccttcaggcctcgtacttctttattcactatatatttgcaagccaaactgcacatgttggagctttatactcagcatttcttgcgatgcatttagcagctggtgtgccagctctaatgtcggcacttgctttggcatacaatgcaaacctctttggagcactaacacactatagtagcgggcaatctgcagtatactttggagcggggtatgttgaccttccggatgtattcaagctgggttttataacagccgcaatcaatgctgtaatttggggagttgctggtgcattatggtggaaatttttgggtctttattgagtgtcggggcagtgtaagtacgtgaaaatcgtaccatattatcaaacaagtaattcatgatccagcatcggaggtggccaggtgggttcgtttttcttccgagggcctatgaatgcatcataacagaggaacgctcatctttagaagtttttgagcattatcatcaacctagaaagcagatatgttttcgtaggttcttaaatcgacggtcgttatatatcctttgatttgattgttgtaccctcgtatctcctccccaaggtaaataaaatgcatgagggacttttg

SEQ ID NO: 111 - DNA, 1134 bp, Zea mays
acttggttcgtcttccactcatgagaggcacggcaccagagctccagctccacatcgccagctcccgggccgcacctcgatcgcccaggccggcctcctccctcgccgccggcgccgccatggaccgcaagagcaagtccgccaagggcgccgcgagctcggcagcggcgtccatggccgcgctcgccgcagccgccgtggccggcgacagcagctcgggccccgccgacggcgcgccgccgccgccgccgcacggtgaggagtacagcgtgcctgcgaagatggcggccgtgggagacgcctccagctcgtctcccgtggcgccgaggaggggcgtggcggccgcgttgggaggtggcacctctagctcctccccggccgcggcgaggaggggcgcggcggcggcggcgtctgtcgttgcggcaggcggcggcggcggcgggccgaggtgccaggcggagcggtgcaacgcgaacctgatgaccgaggagaagccgtacaaccggaggcacaaggtgtgcgaggcgcactccaaggcccccgtcgtgctcgtcgccgacctccgccagcgcttctgccagcaatgcagccggttccacgagctgtcggagttcgacgacgtcaagcgcagctgccgcccgcgtctggccggccacaacgagcggcgccggaagagctcggctgacgcgcacgccggcggcggcaataatggattccgccaacacgccgaccagaacggccgcggcgacccggccgggaaccacttccagatcagataaagcatgctctctctcttctgtcatgcagcaggatatgctagcatcatcactaccgatagatatttatgcgtctatcgtctacccgccccgaaaaccctagttatatatatatatatatatatatatatatatatatatatatatatatagacatatgctgattgtaacctaattagcctgcagccagttaagcagggactgcctactctgctaggaggacgtgtgtaatcatgtggcctgcgcaaacagtaatttgtgctggctgctgtgtattcatgctgctctgataatcgtgtcgtggtaataatatatcctatttattctactactagtaatatataccgattctctattg

SEQ ID NO: 112 - DNA, 1517 bp, Zea mays
cgagagaccagcgaccgtttcactccccgcgccacgcgcctgactgggtgcactgcactggtggtgtgcacgcccctcgtcagtcgtcactcactcgctaccccatatcccattccccccgacggcgcctctggcagcaaggaacaatatgtccaatagggccacccattggtgttatgcctgtcagcgcccaattcgtcttcgcgggcaggatatcatatgtcccaactgcagtgatggttttatccaagaaatcagtgagatgggtggcgtactgaacacttatgggctaactgaaccggactttgaagagcgccaggccagaagatttggaatgatggatgccatatcttccctcatgcggcaacggctgtcagaaataggaagggatagtttgtttgatattcacggtagacaagggacaggtactgaatatggaaggaggtcaactgctattcctacgctggtatttggtggcatcccttctcctgcagttggtagcagtgatgtcaatgttgtcatcagggaaggccgcagagctggcgctgcccgtccgaatttcagtagcttagttgttggtcccagtctggaagctctatttgagcagctactactccagaacaaccgtcaaggcccaccacctgctccacagtcagctattgactccatgcctgtggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccatcacagcgatcaggcagtagtaccagcagcgcccgtgtgccttcagcatactacaacgaaacagcttgccctcctgcggtcgccagggcagatttcgatcctgtgccttcagcatactacaacgaaacagcaactgatcctcctgcggtcaccagagcagatttcgatcctgctccaggaaactacggcagcgaaagccaggaaagtcacgaccccttctcctttctctggccatttggcccgtcgagttcttaccaatatgaagaaaatgttgatgaacctgcagtatacgatccaaaccagatagcatattctgcgtggcactatgaccactgactgaaaccctgagttaaaatcaagatatctgcaattcgtgccttgagctctcagctttggtgaggcaaagggctgcttgccgtataaaaaatggatggttattgtgttcagtgcatacccttgctacgcatgtccgttgtggagatatcagctgtgtatagaactgggcgcaataaactctgctgtaatgcccgtatatattccttttcggtatatcaagtctaaagctacataatcctgtatgtgcagtaatcggtgaactgagtgcatccagaatatcatgtcatgataaacatgattataattacatggttgtctttttagactg

SEQ ID NO: 113 - DNA, 773 bp, Zea mays
aaaaaatcgcccatcccgtcctctccagtctctagttctttctctacactcttgcagtgcagctagcagcgcacggagagccaaaaccaaagccatggcagcacatctcgccagcgccttcttcttcgctgccgagcccgtcggcgagcccggcgtgcacgcgctcgacgcgtgcgcgctctgcgccaagccgctggcgcgcgacagcgacatcttcatgtacagaggggacacgcccttctgcagcgaggagtgccgctacgagcagatgcagctcgacgccatccgcgccaggcagccgtacgcgtcagggacggaggcgcggagggggcaccgggaggccagcaaggtgtccgcggtggcgacctgatgaacgcccgccggagggtggcccggagctgcgcctgcacagattgagagactcaagccaacggtttggttggtcgtttgcctcgtgaaggttgggattcggagaaacgtactcttagatcagatcgagcggccctgagccgagcttcgcggtgaatgatgcccgcggatgccggaagtcggagaagacgatctccatcggagttgctctggttgcacgaggcttggcctgcgtgccacagtcagtgccttagtcctagtgtaacatgatttttgtaaattcgatgcatttggaaagcttttgcctccaaattcagagccaatttttggaacaccgtgtgcgcttcaactgttcatgaattggttcgagtaaactgtacttgcataaaaaaaaaaaaaaaaaa

SEQ ID NO: 114 - DNA, 1031 bp, Zea mays
accaccagcagagagcagacccgccgtctccgctatcagcacgcgtgtagccctgcagcgaggaatcaccacacacacacacacgcagagagacagagaagaggagggagatgtcgccgcagtctcagcagcagacggcgatagtcggggaggagtactgcgagggcgaggacagggagctgacggtgcgcaagacgacgctcttcaccccgggggacgggctggaggcgtacgaccaccgcacgggcgcgctggcgttccgcgtcgagacgtacggccgcggcggggcgtgcgggggcggggccgccaggggggacctcgcgctgctgggcgcccagggggagcccgtcctcacggtgcgccgccgccgccccagcctgcacaaccgctgggacggcttcctcggcgacggcgccgcgcacggccagaagaagcccgtcttctccgcgcgccgctcctccatcctcggcgccggcacgggcgccgccgccgtcctcgtcgacctcctcgcccccggcgccgccggggagttccgcgtcgacggctccttcccgcgccgctgctgccgcgtcgtggcctccgccagggcctgggccgcgcccgtcgccaaggaggaggaggaggaggaggaggaggacgtggtggtggcggaggtcaggcggaaggtggacgaggacgcgcacgtcatgatgggccgggacgtcttcgtgctctgggtgcgcgccggcttcgacgccgccttcgccatggggatcgtgctcgtgctcgaccggatcaccggggatgacgtcgacggcgacctgcgggaggacctgctcgaggccgctacatcgccgccggcgtaagcacgcgggaccgacctcccgctcgcgtggggcgtggcttcagtacaattccacaaacaattttctcatggttcttcgatccgatgtactttaccttcgagcatgatgtgaattatcttctcaattccgtgctgtttccccccttccaatctgatgcttgacattggatcaccacgaacaaattcg

SEQ ID NO: 115 - DNA, 885 bp, Zea mays
attactcgaccggcagcccacgcattcactttgccttcgctttagcctttgtgctgctactactaacttgcaagggacgtcggcgacggccaggccggcgcaccgctcggcggcccggccagcccacccagagaccacctagccatggcgtccaggtgcttcttccccagggacgcgtccgccgccgccgacggccggcaccagcagtcgaaggccgcggcggaggccctcgagcagctgcgccacggcggccgcctcctgtcccgggaggacgtgggcggcgcggtgcgcgtcaggatcgtcgtcagcaggcgcgagctcaagcagatggtcgcggcgctcggcgacgacgacggcgctggcgcggcggcggcggcggccagcagcgagcgccgccaccggcagcgtggcgcgggcgcgggcgcgggagcggggccgggcgccgagcagaggctgcagtcgctgcggcggcgcagcgcgcggagggcggccgaggcggcgcgccggacgatgcaggcgggcggggagtgggagcccggcctgcagagcatccccgaggaggtttactagctagtaatctctgcttcactaattatgggttgggttgggtacgttttgatcactgcctcgctgctaagtgctactagtagtagatgcgtgtgtgtgtacagcgctgtttttgctctggaccctcgttatcatgggttccattccaatgcctgcttgacatagtcctctccgcgagtttctgcattttgcttgccctgtgacttttttttggggggtactattatggaccaaaagaggaggaaactaatacatgtgttctggactggaccttggatcacgatacaaagtgctgatggtgattgatgaaccgcatgg

SEQ ID NO: 116 - DNA, 1182 bp, Zea mays
tcactgaaccgacgcgacgggcttgggcttttctctctctctctagcacggcccaaactatctccgtcacaagttcaccgcggaaatcgccagcagtccaccacaattcagaagcgccgacccgcgtcgccttatcgggagcaacggcaacggcagcctctcctccgcgccatcaggcagccatgggtccgggcgcgtccacctccgcgcagccgctgtcccggctcctcctcagcctcccgaagccaggcgccgcgaagcacccccgctcctcctcctcctcctcctctccttcgcagcctcgcccggacgtcgccgcggccaggagccccggcctcgtcctccggcggcgcgaggcagcggccgccctgctgtcgaccgcctttctctcccgcttcgccctccccgcggccgccgcggacggcggggagtgcccgctggaggtggcgccgtccgggctcgccttctgcgaccgcgtcgtcggcaccggcgccgccgcccaggagggacagctcatcagggcgcattacacggggaggctggaggacggcacggtgttcgacagcagctacaagcgcgggaagccgctcaccttccgcgttggcgtcggagaggtgatcaaaggatgggatcagggtattgttggcggcgaagggatcccgccgatgctcgctgggggtaagcggacgctgaagctgccaccggcgctggcctacggcgagaagggtgctgggtgcagagggtgggagcccacctcgtgcgtcatcccgccgaactccacgctcctcttcgacgtcgagtacgtcggcagagccaccggctgaggtctccggaaactctgaaagtctgaatgcgcgaggccaaggttcagactgatccatgtggacaacgatcgtagttgcccgggcactaagaggttttcttcttctcgtcgtatgtttaagagagctatagattgccagagacaagagtctatatagttttcaatgtcgtgaaaggtgtagagaaatgtgccaaaagaagctacaaaaatgctgacccagttctgaaactaacagaagcattttgtttctctgttttccggattctcggtcacaaaaccaggtacccgtcacatctgattttcagagatgttaggctcaaacacgctgttcgtttggctataattcgaaatggtttcta

SEQ ID NO: 117 - DNA, 1851 bp, Zea mays
gactgatggatcactcctgcagctgcagctgcagtgcgtcgccgctactccatcgtctattaattcctcgtgtagctccagcgctcggcttagacaagcctctccaacatgaagctcctgggttggatgcaccggaagttacgacagaacagcaatgatgtgttcaaagagttcaacaacgctggaggtgggacctgcaactgcatcaccgggctggccgcgtcggacccggccactttcctcgccaccgccaacgaatacttcaccgccgacaacgacttcaccaacaaccatccatcgtcgccggccgccgacctcttcacctttggtggcagcggcctcctcaccattggcacgctaggcatcgccgccgtcgcggtgtctgcagacgctgatgaagttgattacgacgtcgacgccgatgctgactccgactttgacgacaacgacgacaccgccggtgatgacgaagaccaggtcgacagcgccgtcacgcccacgttcacatatgcagcgccgcctccgatagaggacgccacggtcgtcgagaaggctgcagttgccgtggttgaggccattgccgagaaggacgacgacaccaccactgaggatgacctcatggtggtgagcgccgagctggagaaggtcctcggtggccgcaacagcggcaccgccggtgatctggtggcgtcggcgcgggtgagctttgccatgggcgtggactgcccgctacagggcttcctgttcggttccccggtgagcgacgccgagtcgcgcctggagcagccgcgggatagcaacggcggccggcgcacctcgctcggcgagctgttcatgcgcacgcgctttgccgaagagaaggtggcgctcgtcgccgtcgaggaaggtgaggacggcggggacattggtgctggcggtgaaagggacgacaggaaagcagggaaaggcggcggcggccacaagacaacgaagaagaggagtgcaaaggatgaaaaggtccccagaggtgacggagcgcaggcgagtgcaacagtgaccaagagcaagtttcacaagatcctccagatcttccacaggaaagtgtaccccgagagcgcggccctggcgcggaacctgaccaagaagagccgcaagcgcggcagcggcgcctaccacaagccggagccggcggcgtccaagctccggtgcctcaaggagcagcgcgcgccggggttcggctgctgcgccagccgggcctccttcggcggcgccgcctctcccatcgacggcgacgacgacgacgagctcaacggcagcaagagcggccactggatcaagaccgacgctgaatacttggtgctggagctgtagaatgagaaataacaagagagagatcaggatctgttggctggtcagcatcaagcatatatagtgagtatattgagcataatgcctgcttatgtttctgtgcttgctcttcacagaaaaaaaaaacccccatcatacatatgtttgttcatgtgattacctgacggatgagttgtacgtgtccgtctatatatctgtataaaggggaaaaggactgcgagtgtatgaacttaatgtatggtttgcgtcaagatgtgatcgctgcctcctctctactcctagttgatagcctcctgttggtgcatgtgggggcttaggcacttggctggccccccaaatcatgctgcttcttgaactcttgttggtggcctgattgcagaggaatatcctgtcacagggactgtgctaacgacagttgccatttcccgcaataggctggatgcagctttgatatgcatcattattcatatagcccgtttaatttaaatcaggaccttttatata

SEQ ID NO: 118 - DNA, 946 bp, Zea mays
agaaaatgttcactccccttcctcggcattggcgtcacattcgcagccgtctcactcctctcgcacagcatccgcttctcctgccaaaccctagcacctccgtcctccgaccccctcagctccggcgatggcctccaccccgcaccctccgccgctcatcggcaagtcgggaaacctcacggtgttcttcacgccatcggcggagcacgagagcccggggtccgagttctctacgcccccgacgagccctcgcgccgaggactcccctgaatcaccaccggcgcagacagcccctccgcccgcgcctgtttactcagtatccacgccgcagcttgtcaagatggtctccccgccgcttcccgccgagaagctctcccgaccctcgctggtccaggtaccgtcgccgcccgtcaagtcggtctcaacgccgctgcaggcaccaaaggtctcttcctgctccttgccaccggtccaggtgccgccattgcagttcgggaaggcttcggcaggatcagatggatcgctgcttgcgttcttctgggacgcggttgcacgcatgcaagaagcacacgcgagcttggacgagcacatctcgagatggttcgggctggaccagtccaagtaccagtgggcgctcaacgactattatgagaggaccgggcaggagatagatttgagcaacgttggcactcgttagcagcacagttgtaaaaattcagaaagcttgaaaaagtggattatttctagtttttatgtgtgtaactaagctggtgccgtgtcaagctgcatatagaatccttttggttgcgtgaagactgagttctctttttctgcacccggaagctcttggttgtaacaaatccatatttagcacctttattgtagcttcgttgtggataaagaaaaaccttgctgaccttttttttattgtaccttcattttcatt

SEQ ID NO: 119 - DNA, 2354 bp, Zea mays
gattattcttttttcctgctcgcgttgtttcgaactcacgcaacgcaagctgagcaaccgctgccggccgcgcacggccgcccacccaccagtccaccactacatcctcacaccgccacagcagctgccgcggccgagccgacgacgaggatgagcggggccgcgctgtgcgcggcgctgacggggctggggttcgacggggaggacccgctggacgcggatgcgctcgagtggccgttccagtatgaggaggcgcgaccgctgcttgcctggatctgctcctgcctccgcccctctaacgtcctctccccgtcccacctggcccagtatgaacaactcgtggaagagggaagactgttagagggtgaagatttggactctgcttttgatagtatttcagccttttcaagcaagaaagacaatcaagaggctgtgtttggatcagaagaaaccattcttgatatccgtgaagcaaaactagcatatagagccgaagtttttgagttacaaaagcagcttgcgcggcagcaagcacaatttgatttgcttgcaggccaggcttcaactcttattcaaggtagaaggtcacgtgtatctgctatgtctgcagttagtagagagcttatatcgctagatgagatactttcttccagaaacttggagatgaattcagttcttggaagaatcactgctactacccaggaactagcccattatcattcaggggatgaggaaagtatatatttggcatattcagacttccactcctatgttgttggtgacttggcttgtacgaaagagctaaataggtggttctcaaagcaatttgagaaggggccatttcgacttgttgctgaggaggggaaatccaaatgttcctgggttagtcttgatgacatcactaattgcttgataagaggagattctgaaaaatcgcatcatcaccaacgtgtcgctgagttgcaacgacttcggtccatatttgcaacaaatgaaagacaatggattgaagcgcaggttgagaatgctaaacagcaggctatactctctatattgaaagcacaagtgtcatccgacgaggctcatatacatagggatatccattctcttaggagaaaaggttctgagcttgctggagagctctcgacactttctcaaaaggtgcaagctttggtatctgagacaataccatgcctgtgttcagaacttgctcaacttcaaggcacatatatcttgcaaggggattatgatttaaaggtcatgcgccaggagtactacattaacaggcaaaaaacgttcatcaatcacttggttaatcagcttgccagacaccagtttctgaagattgcttgccaacttgaaaggaagaatatagctagtgcgtactcattgcttagagtaatagaatctgagttacaaagctacctctcagcagtcaatacccgcttgggtcattataattcattgattcaagctgcatctgaagtacgagaacaaggagctattgatgatcgtgacactttcctccatgcagtgcgagatctcctatgtattcactcaaatgtccaagcaacagtgccaacatacatgtcagcacatgcattggttcagcagatatcagcacttcaatctgacttgctttctcttcagtctgagctggagaacacccttccagctgaccggaaaagatgtatcaatgaattatgtactctgattcaaacagtggaacagcttctatttgcgtcgtcaactactgcagaaccaatattgacgccttggccattgatgcgggcacttgatgatatggaaaatgccaacgctcaagtcgaagtttctgtggaagaagtaaccaaggctcgcacccagaagataaagatctttgaaaatcgtgcccatgaggtggggagggagaggcaaatattcgttgatttcttctgcaaccctgaacgcctcaagaatcaagtcagagagctgacctcccgtgtgaaagctctccaggactaacctgtttctgtaggctggtctcacaggtcgtgatgctttttttttctatgtaaagtttgacttcactccagcgtcaggttggggctgctgtgcagggacggtatggaacaatatacccatcatgtagctcgggggggttcaggctgtaggtccttgtgccacccggaataggatggcattgttgtgatattatttgtagcgatatgtatgttgtaaagtatctcagaaatcacgagccctttctttcgtgtatggttttgcttttgagtaggttgtggtggtacagttgttagcgtccaaaggcacaatcggtactgtagtttggataaatgggatcgatttcctcttca

SEQ ID NO: 120 - DNA, 1898 bp, Zea mays
aaaactccccgtctctactccctactggcctcctcccacgagtcggataccgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgccgcggcggcggctcctcgcggctccggaaacgttttcgagggattgagagcaaaaggctttgcaagcatgtcatcttcgactggcaatgagaatatgtctactggaactggtacactacctcccatgccacccacatcatcatatattggttcacctgttttctggattggagttggtgtagcattgtctgtggcgtttaccacggtctcttccatgttaaagagatatgccatgcaacaagcatttaagtcaatgatgacccagtcagcaccaaactcatttggctccaactcgcctttcccatttagcatgccgccacaggcatctcctactgctccaagcacttacccgtacttggaaccaaagaaagatacttccccgcatgtgtcaactgttgatgtctcagctaatgaagtggaagccactggaacatcgaaagaggtggatgttactgaaacgccaaaaccttcaaagaagtttgcatttgttgatgtttctcccgaagagttgcagcaaaagaacctccaatcttcaccggagacggtagatgtaaaacatgatagtacatacagtgaaagtaaggaggatactgaggaacaagttcccacaattagtacaaacactgaaagtaaggaggatactgaggaaaaagttcccacaaatggagcatcttttaagctgaacgaaggtgctgctcatgggccaactgaatctaataactcggcatctatgctatccgttgagacaattgagaaaatgatggaagatccagctgtgcagaagatggtgtatccctacttgcctgaagagatgcggaacccaaattcattcaagtggatgctgcagaatccaatgtaccgccaacaactacaggatatgctaaataacatgggcgcaactcctgatcaatgggataaccgcatgcttgatcaccttaagaacttcgaccttagcagtccagaagtgcggcagcagtttgcgcaagttggcatgactcctgaggaagtagtatcgaaaataatggcaaacccagatgtagctgttgcattccagaatccaaaaatacagacagccatcatggactgctcgcagaaccctcttaacattgtaaaataccaaaatgacaaggaggtcatggatgttttcatgaagatatcacaaatcttcccccaaattaacggctagctgatcttcgtcgtgggatagcacttctgatttttgtcggcccgtcatctccagtctggagggctgctgcggtagcatctatcaagaaaagggtcgtgacgctccgatataccctccccgtgtcaaggtttttgagtttcttatgtacatcatgtgatgtagcggccttggtttagctatgagtaattgagtatgacccttgccagttcattaagtcaggctattgacatagcagggtccaagtttttattaagccagccaatcagtggaaaggtgcagcagagacggttcgtatcagatcaattttgatatataattgttattattaatctgtaatatattagagacacaatggcaatgcaagtaatctgttacgacatttcctgaccata

SEQ ID NO: 121 - DNA, 2624 bp, Zea mays
caacacccccgctttctttatttatgaaaggttagctagggcgccgctgacaacatgtgagcgtgttcggcattactccacttcactccctccctccctcacctctggctcatcagtgcctgcctcactaacctcaccattactgaaatgcagagctcgcataaataggcaggacccgtggtgctactctcctgtccccttccggccttttccccccttctggagcttggggggaggcactctgcaccttcgtcttcgtcttggcgtcctccagcgctctgccttcctgagctggcttcttgtccgcaggatccatggcgaaggactacccagcttctccgaaagctcagcagctccaggaatccaagaagcagcgcctgacatacatcctcgtcgtaagcgcgctctgcatcgccttctacgtccttggcgcatggcagaacaccacgcttccaaagcccataggcaactcggcgatcacccgggttggctgcgatcccactgccgccacggcacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccgtaggcgcgggcgccggttcgaccgaaacatgctagtgtatcgggagcgccactgtcctggcaaggacgagcaggtccgatgcctcatcccagcaccgcctgggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcaggacggctgttgacacaggttgcggggttgctagttggggagcttacttgctgaagagaaacatcatcgccatgtcatttgcgccgagagacacgcacgaagctcaggtgcaattcgcgctggaaagaggtgtccctgccatcattggcgtcatggcgaagcagcggttgccttacccatctagggcgttcgatatggcacattgctcgcgctgtctgattccttgggatgaacacgatggactgtaccttgctgaagtcgataggattctgaggccaggaggatactggatcctctcgggacctccgatcaattggaagacacaccacagggggtgggagaggacgaaggacgacctcaagcgggagcaggacaagatcgaggatgttgcgaggagcctttgctggaacaaggtggttgagaagggggatctgtccatctggcagaagcccaagaatcaccttgagtgtgccaacattaagaagacatataagacaccccatatctgcaagagtgacaatcctgatgctgcctggtacacacagatggaagcctgtgttactccactgcctgaagtgagcaaccagggagaagtggctgggggagcggtggagaaatggccagagagggcgttcttggttccccccaggatcaaaaggggcatgattccaggactggacgccaagaagtttgacgaggacaagaagctttgggagaagagggtggcctactacaagcgcaccataccaattgcagagaacaggtacagaaatgtgatggacatgaacgccaacatgggtgggttcgctgcttctctagtgaagtaccccgtgtgggtgatgaatgtcgtccctgttaactccgaccgggacaccctcggggcaatatacgagcgagggttcatcggcacgtaccaggactggtgcgaagctttctcgacgtatccaagaacatatgacctcctgcatgctgacaatctgtttagcatctaccaagacaggtgcgatataactggcatcctcttggagatggacagaatattaaggcccgagggcacagctatcatccgcgacacagtcgacgtgctcacgaaggtccaggcaataaccaagcggatgcggtgggagagccgcatcatggaccacgaggacggccccttcaacccggagaaggtcctcatggcggtcaagacgtactggaccgccgaagccgaggaggagcactagcacacgagtgacaccgagctcacttgaaagcgtgaaccaagcctgttctacacttctactaccggtcgagagggatggcgtcagcgttttgcgtctcagtgtagtatgtatgtcccttttcaccttttctctagttctttgtagctagctacaatcagatgggaaggtaagggagagttttgagacggggggggggggggttggttggtcctctagttgagatacaggaagcggttttgtagcaggggaaggtttcgctggtcttgcgtaggttcctggccctgtttcacgaggggttgaactaggttttagtttgtaatgcgatggcaccgggcaggcattgttaatcgtatattggggtgaccataatagtaacaggtatttatttagttttcatct

SEQ ID NO: 122 - DNA, 998 bp, Zea mays
actggagccgaaccaaacaaaaccccacctgcaagtctcgctgcagccccacacgcactgacccacaccccccgcaccgctctctccccacccaggcacccagcctccacgccacagatctctctccctttcccccctctctctctctccgaactctaccccgcagtctcggccgcggccatggcggaggacgcccccaacgccgtcgccgagggcagccagcccgcggcctccgagggatccgccgacgccgccctgccggctgccgcgggcgccaaggccgcggaggcgctgctcccgtcgctcagtatctggccgccgtcgcagcgcacgcgcgacgccgtggtgcgccgcctcgtgcagacgctcgcggcgcccagcgtcctctcccagcgctacggtgccgtcccggagcccgaggccgagcgcgccgccgtggccgtcgaggccgaggccttcgccgccgcctccaagtccgccgccgccgccgccgagtgcccggcctccgtcgaggaggggatagaggtgctccaggcctactccaaggaggtcagccgccgcctcctcgagctcgccaagacccggtccgccgctgctgcggcggcgcccgcgcccgccgaggggagcgcgcaggcgcaggagtccgcggaggcctcgtcggcgactgctccacctaccgaggaggctgccgtaaacgaggagtaaggcgtcggaccgcgctttgatccaccgacaattgctgttattttggcatttcgtcggaatgttatttatcgtcccccctgcctatgtttactagtacatcattatctatctatctattagagatgagatgcttgtgacaagagggactgatgtttgtttcatggatatgatattctcgaatatttatcgctagtttatttttaactaaaccgtgacaataaaaaaacggagggagtaatattgaattattatatatcaaccgtgcatcctttcgacgagctaattgttcttgt

SEQ ID NO: 123 - DNA, 1074 bp, Zea mays
gcagttttcaacgcaccgtgcagccaccggagccactcgcgatccaaccaaagaccctatccaaaaccagaggcaagccaagacgcaagctgcaagcacgcgctcgtgcccgcgccatgaagtgctggtgcgtgcactcgccaaggggagcaatggcgacgccgctctccagccccttggctcccaccgccctccgctcccctctccggcaccgcgccctgctgctgctgctgccgttccctccccgtgcggcctcctccggcgaggacaccgccgcagcagccgaccaggagccagccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagcggctcaacggcgcgctggccgcgctggggctcgccgcggtgctgctcgtggagctgggctccgggcaggccctggtgaagtaccaccagccggccacgctgttcctgcaggcgtacaccgtcgctgcggccgccgcgctgttcgtcaagtacgagaaggagcggatcagcacgtggccggggccgccggcaaagtgagataaatggcgttgtctcggtcgcggatctttacttgtacttttacctcttgatgatgtgcactgcacggatattatatgtgttcgttgtgagaactgggaaattcgaggagagaagaagagcttgattttttacagtccttttaacgcccatagtttcatttcatttctttcgtcacattaggcaggtccagcctccagcggcaggcggtttggtcggttcgagtgttttgctgcgttcgtcggttatcacggagaatatccagacagttgttggttcgagaacatttcgtttgtgaattttggtgttcggaagattgtgtaaagctttgagaagcaagttaaaattgtgcatgcataga

SEQ ID NO: 124 - DNA, 3384 bp, Zea mays
cacgaggttccattccatgtcagtgtcaagttgtcaacggaggtgctggcatctgccatgtggcggaaatgattcttcctgcccagcatctacttcgggtgccagctcatcaattcatcagccgtccacaaacccgcgggcgcaacttctcggcacgtacgcagctgtgcgcgcgcgcgggaggagtggcgccgcacgcaaggtgtttggcggattgcctcttccagatcatctccgccgtgctgcctcctgccttagacagtcgcatgccattgttgaatgaagcccggcgcggctcaacggcaaccgttgcttccacttctgattcctcgttcgcctgctgcacgctcaccactgtacgtccccgatggctgaagccatcagcgcgaccagctcgtgcctggaacccctgtgcggttgtctggaaagcacaggcgtgttcgaggcagtgggccgggaggtggccgcgttccttcgcatcaagtcgaattgtggcgacctcgagaaggcccgggacagcctgcgcgccgtcgagacgacagtcagggcgcgggtcacggcggaggaggacaagctgaacgtctgtgatcctcaggtgcaggcgtggctcaagcgcgtcgacgagcttcgcctggacaccatcgacgaggattacagcagtctgtcggggttctcttgcctctgccagtgcaccgtgcacgctcgtcgccgcgcctcgatcggcaagcgtgttgtggacgcgctggaggaggtgaacaaactgaccgaggaaggaaggcggttcaggacatttgggttcaagccaccgccgagggccgtcagtcagttaccccaaactgagaccgttgggttggagcccatgttggctcgggtccatgatttgcttgagaagggcgagtcgagcataattggtgtgtggggtcaaggaggcatcggcaagacgactctcctgcacgccttcaacaatgatctcgaaatgaaagaccaccactaccaggttgttatttttattgaagtatccaattcagagacactgaacacagtggagatgcagcagactatctccgataggcttaatttgccatggaatgaatcagagacagttgagaaacgggccagattcctattgaaggcactggccaggaaaagatttctattgttacttgatgacgtaaggaagagattccgactggaggatgtcggtatcccaactccggacacaaagagcaaaagcaagctgatcctgacatcacgtttccaagaagtatgcttccagatgggtgcacagaggagccgcattgaaatgaaggttttggatgataatgctgcctggaacctgttcttgagcaagctgagcaacgaggcttttgcagcagttgagtcaccgaatttcaacaaggttgttcgggaccaggccaggaaaatattctccagttgtggaggtctaccacttgcactcaatgtcattgggactgctgtggcagggttggaaggaccaagagaatggatttcagctgctaatgacatcaatatgttcagcaatgaagatgtggatgaaatgttttatcggctgaaatacagctatgacaggctgaaacccactcaacaacagtgctttttgtactgcactcttttcccagaatatggatctattagtaaggaaccattagttgattattggctggctgaaggtttgcttctcaatgatcgtcaaaagggtgatcagataattcagagccttatttcagcatgcttgttgcagaccggtagctcattgtcatcaaaagtaaaaatgcaccatgtaatcaggcatatggggatttggttggttaacaagacagatcaaaagtttctcgttcaagcagggatggctttggatagtgctccaccagcagaagagtggaaggaatcgacaaggatctccatcatgtctaatgatatcaaagagcttcctttctcaccggaatgtgaaaacctcactacgttgttgatccaaaataacccaaatttgaacaagctgagttcagggtttttcaagtttatgccctccttgaaagtgctggatctttctcacactgcaataacaacactcccagaatgtgagacattggttgcattacagcatctcaatttgtcacacacacgtattaggttattacctgagcggctgtggttattgaaagagttgaggcatctggatctcagcgtgactgctgaactcgaagataccttgaacaactgctcaaggttactcaatttaagagttcttaatctctttcgcagtcactatggtattagtgacgtcaacgacctgaatctggattccctgaaggcactgatgttccttggaatcactatttatacagagaaggtgttaaagaaactgaacaagactagtcctttggcaaagtcaacatatcgtctgcatcttaagtactgtagagaaatgcagtcgatcaaaatctccgatctcgaccacttggtgcaactcgaggagctgtatgtcgaatcatgctataatctaaacactcttgttgctgataccgagctgactgcatcagattcaggcctgcagctcctcaccctctcagttcttcctgtgctggagaacgtcattgttgcaccaacgccccaccattttcagcacatccgcaaattgaccatttcgagttgccccaagttgaagaacatcacatgggtcctaaaacttgaaatgctcgagaggctcgtcataacccattgtgatgggttgctgaagattgttgaagaagacagcggtgatgaggcagaaacaacaatgttgggtcagggtcatccttctgaagaacaggaagataaacggattgatggtggtcaaagtgtgtgcaagagcgatgacaatgcgcatgctgagctcctgaacctgagatcaatcgtgctgactgatgtcaagagcctgagaagtatctgcaagccaagaaattttcccagcctcgagaccatccgggtggaggattgcccgaatctgagaagcatcccactgagcagcacgtacaactgtgggaaactgaagcaggtgtgcggttcagttgaatggtgggagaaactggagtgggaggacaaggagggcaaggagagcaagttcttcattccaatctgacaggcccctccgttcagctgttctcggcggttgctgtgtcagttggcaggaagcttcgttcaatgctgccacgaataagcggttcggaatctgtatatgcgacgagttgtttcttttacaggtagtctgtgtatattgcttgtgttcacaaacctgtacatgatctgattcattcatgtattgctgtaaatgcgatcaataaaattccatttgtctacttggataaaaaatagtcctctatgacc

SEQ ID NO: 125 - DNA, 1587 bp, Zea mays
aatcaagttaccactaaagtccaaactacacgacctagaagtgggcagcaagtaatatcacttttgtgtggtttgccacccaataaacatatccacatcgacagccaagcattcatgacacagagaaccatatttatatagtgggctctccgtaagtttctttgagccgggtagctacacagtacgcacacctatcccggctgcagcgcggttccagccactggtgccacgtggtttgtgctcttgtgggcacactggcctccacccatctctctcacgtctccccatccgcagcaaaggcacacagtacagattcggcccatcgttttatagccacaccatggctaggaagtgctcacactgtggcaactgcggccacaactccaggacctgcgggagagaaaccatgctctgcgaagctggcgacaacggcggccatggcggcctaaggctcttcggagtgcaggtccgtatcggcggcggcggcgcaggctcggcgtccatgaagaagagctacagcatggactgcctgcagctcgcggctcctggttgttccctcgtctcgccgtcgacgtcctcctcgtcgtcgtcgctgctgctgatgtcgattgaggagggatcggagaggggggcgccaaatgggtacctttctgacggacctcatggcagagctgtgcaggagaggaaaaaaggagttccatggagcgaggaggagcacaggcagttcctttccggcctggagaagctgggcaagggcgactggcgaggcatctccaggagctacgtgccgacgaggaccccgacgcaggtcgccagccatgcacagaagttcttcctcaggcagagcagcttggggaagaagaagcgccgctccagcctctttgacatggtgccgatttgcgagaacagtgcgagcatctccgatccgctgagcagcgaaggggcctcaacctctctgtcgctgaacgtgccacgccacggcgtcacctccgtctccgagagggcggccttggacctgaattcgacggaggaagacgacagcagggcggacgcgtcgtcggcatcggcatcaggtgcagggaccagaccaccgttcccggcagcgcagacggagccgctgcagccttcgtcgcttggccgtgggcgcggtcaccactgctctccgttggacctggagctggccatgtcgctgcctgccccatccatcggaacatgacgcgccgccgccgccgccgtacttatcgccatggaatcccacgcaggtcgcgccagaattcttcagcgcaggttgccaaggccgaggccgtgcgtgcctgctgtctcgcacaaacgtcccacgtgtaatcagaaccgggtctgctcctgtatgagtatgacatgactatgccatgttccccgcgcaggattgaaaccgtaaggttacgctagttgctagctttttattttgaacccttgtgaatgatattgttacgaaaaatagctcctaacataggttcactgtgatatatgttatatacactgtgatatatgttatgtagaccatatgttcgctttgatattaaatttattttttatggctattaaata

SEQ ID NO: 126 - DNA, 2891 bp, Zea mays
catcatcgcggactggcccggggccgtcgccatcgcgcccacgcacgccccttcctccttcccctccgcccaactatgttccccaaaccgcacgcgcgcgctcgactccccgccgctgtcgtcgtcgtgttcgcggaggagatccaccggggtcgtcgtcaatctccctcctcccttgctcccgcagcctacccctccacgcgtgccctcgctaaaccctagcttgggcactcccccctgccccggcggcgccaccaccgcgccgcaccgaccgcgtgcgctgacacgttggaatgcattgtttgaagtgtgatcattgaggttctggttaaataagcttctagaatcgagtgactcccctcccataaatggataagatacaatctgattgcccttatccgggatgtttcttttgtgttatgaaagaggcgaaccctagtaaacgaagagcaagtgtgctaaagttttttagggaacttccttcccaagatgacgatggtcaagttctccctgtcagcggtctctggaacacagcgatggctcacccaaatgatcccgagttcatcaacttgggcatatttgaatgcatggcagctcttatatggaaagggttgaaaaataggcgttggcttgcacatgatcagaatatttacgtcccatattatgcagctcacataattggatcgtacacgatgaatatggaggaatttgcagagtgtgctgttcgtgctggtgtaatacctccattagtcgaactgttaagaggtaggttgacatgggtcgagcaaagagttgctgttagagctttggggcatttggctacgtatcctagtacattccctgcagttgccgataatggggaagtacttgaacttgccactcaacttgcttcaagctcccttgagattgtgtacactcacttttaccagtttgtggatcgaagacttgactaccattgtggccttcttactcgtggcatgggtggtgtggaaatggaatcccgcaaagctgaggaatgggcaagtcaactacagtgctggtcattgcaactcattaactgctttgcatttaagcctgaattcctccatgatatttgcaagcctgattttctagtcaagttacctggaatgtggggtggacttgtgaatgagaactcgcctgctggtgttggtttgctaagaacaatctgccagagcaaagttggccgaggtgatgctgccaacattcctggtactattgatgctttatgtaacattgctcgctcttcagatgattggcaatacatggcagttgattgtctgatctggttagtgcaggatgcaagtacttgtcataaggttatagacaaagttgcgccaacactgatagatttagcagatatttcgacactgggtgattataaaaagcttggtgacatgattgtcacagtcctccaagaatgtatgcaacaaagcgggaactcacgtggcgcaatcagtgatcagaccaaagcagaaatcgatgagctcttgagatccaagcaaagtttgaaattggaaaagagtatgccaaaggaggatcttcatataaaacaagctgcagcactggttgtcaagttggaaggcaactcactgttctcttcagggaacattgcaggagctgcagagaaatactccgaagcactggcactatgtccaatgaaatctaagaaagagcgggtggttctttacagcaaccgagctcagtgctaccttctcctgcagcagccatcggctgccataagcgatgctactcgagcgctgtgccttcatagccccgtgaatcgtcacgccaagagcctgtggagaagagctcaggcgtacgatatgctcggctttgcgaaggagagcttgctggatacgatccttttcataaacgagtgttcgcagtcgaacgatcctgacctatccctgaagcagaacaaagtccctgattatgccgagcggctggtgaagaagcagatgcgcgccgcttggctgttcagggaagcagccctgaagcacgggggcgtccgtcgcgcgggggatgctagcgacgctgcgtttggccaggaggccgacgactccgagtgggagacagctagcgaaagcgacggcgagaacggtgccgccacggggggagaagcagacggtgagactggatggaagaatggtggccgccaggaagatttctgtgagaaaagctgagcaacagccaaatgtgtattcagagtctcaaactgagctgctacagaagcagatgctgggccttctgcggtcggcacactatgaagcatcaaatctttctaacgaaacgatctggtgacgtttttattgtcctcatcaaagcaaggggggcagaggcccaattaaattagttatccacgtcttctcgctgggtcagttgagctgtgcctgtgaccattcaatatttcctctttgatgctggtcctcctctggtgtttgtaacatatttttggtcagtttgtcaagtccctgaaagaacagaactgtgtgcattgcttgttttgttttattgttttctgaagtttggtgaagaggccgtaatcctggcgctctcccctttccatttgacttgtctggaacgtgaaggccacgtttcctttcttcagggtgtcgtacctggttttcttggtgtactaatgtcaagtaggggtaggggctgtcttaggctcttacgatgaaacagtgtgctccggccctctggataacagcgccacgtcgaaacagtaaggtagcggaccaaacgctccttcgctttcacctttttcagcgcagcagccagcgggctggaggccactggccaccgcaccagcttctgctgcggcatcccccgaccattctgcgccccacccaattccgtagccccgcctg

SEQ ID NO: 127 - DNA, 1716 bp, Zea mays
aaatatacgattgtgtcggctaattatcgcgtcgggggcagggcgtgtcttccatcgctccccaaggccccagcccccaggtacccttcgctccccttcctcgtatgctgtgagcgtcgtggggtcgtggggaggaagacgatttcgagggagagaggcaaaggggagctcgcccgctccaggcacccattcctctcgaacccgacatctctcttgttgtttcgaggtgctggagctcccccgctttccacaaaatctgtggagattattcgaaaccatctcgtcgctcacgaacgcgtcagaggttttgcagaaacggagcgcgtgcggcgttcgtcggcaacgttggcgtccatggagagcaccgcgggtccgaggaagaggcagaaggccgcctcggcctctggatccgtggccccgtacttgccccaggagctcgtacggaacatcctcctccgcctgccttccaggtccgtcctccgcttccgcgccgtttgcaaggactggctccggatcgtctccgaccgcgagttcgcggccgaccacaaccgccaccagccggcgatgcccctcgtctccttcctccgcagcgccgccggtagcaagagggggcagacggactgctgcgtcgacgcatttgacctcagcgccgacagtttccggtccgtcgtccggttcgccgacaaggggacgcggtgcagcagcttcgacatccacggctcctgcgacggtctcctccttctcagcttcgatgcccgcttctacgtttgcaacccggcaacgcaccagtggacgcgcctcccggcgcccctccgcgcctcgtggctcgccggcttctaccgccacgagcccaccggagagtaccgggccttgttctaccggggccagtggcccgggacggactactacatcatggtggcggactccaggaaagggaggggaattggcctgccgtcggagaaatatgggtacaagttcaggagacaaccgtatagcctgccggtcctgctccgcggccacctccactggatggcagccattgaaggctacgactacgagatgttggcgttcaacacgacgactgaaaagttcacggttatgtgccctcctgtggttcggtggcacatgtcgctagctgaggtgggcaacgagctcgcgttgttgagctgcggccaccaggtcccgatgctcgagctctggattctgaaggattacgagaacaagagctgggtctgcacgcactggattcggctgccggagttgaagatgagcaccttcgcgttcgatgacttctcgcgaatgattttcgtgtcagaaaagggagttctgatagccaccccggagcagaagctgttgcgctatgacctgaatgggactctgctggaaagcttcccttgcaataatggcagccatctcaagattactccgtacaccttcaaggagagcctcgttcggcatgcattctttgagacaccggattgcaatgccgatggtcatgaagatgaagatgaaccagaaccaccacctttcttcctggggctgtagacccggacccggtggtgatggatctcatgggaacccttggttggagttgatcagcggttcatgcttcagatcggtattacagcctcggtagatgaactgagagtaagctacatttttcttttgtctctcttttatacccatcattccatcaataatgtcactatgtttgtc

SEQ ID NO: 128 - DNA, 1139 bp, Zea mays
ctttaaaacaagaaagaacgttacatcacgcacacacgcgcaccaaagccaagcgcccaagcccagcactcgacaccaccacagcgcgcagccacgctcacgcacaccgagctgcgggagtggagtagtggaccgatggggagcagcgggggcagcagcgagcacttcctgcggcagctgagttcgagcgacggcggcagcgcgccgcaccatctgctgcagcgagagtgggagtgcggcggcgtcaccggcagcggcagcaggcgcgggtcgcggaagaagaccagggcgcggggacaccgccgccgcggcggcgggttctgcagggcggaggaggctgcgccggggcggaagcgggtaatggtggtggtggaccagagctccggcgccaagcacgccatgttgtgggcgctcacccacgtggccaacaagggcgacttcctcaccctgctccacgtcctgccgccggagagcggccacagcagccgcggtgctgcggaggacgcctccgcgctcgccaactccctcggcgcgctttgcaaggcctgcaagcctgaggtcgaggtggaggcgcttgtgatccaggggcccaagctgccgaccatcctcagccaggtgaagaagctggaggcgtccgtgctggtgctgagccaacgcagcccctcgcctttctgctgcttcccgcggagcagcagcgaggagcttgtggaggagtgcatcgaccgggcggagtgcctgacgctggcggtgcggcggcagagcaagggcgtcggcggctacctcgtcagcacccggtggcagaagaacttctggctcctcgcgtgatccacaaccatatatttccccccttctttggaaggcgttcggtttgagtttgaaagcatgggatggaacggaacgggctgggaaatggcgtttggttcagggatacgaggtttgggaattgggatcgcctacaggtcggagggacgggatagtcctctatatatgaacgtcgtttcttccgtcatcagtcttcttcctcgcgtccgtgtgtcctcttcttcttcctcgccagttgtctctcatcctgtttctctcaacgtcttaatatgctctccaggacgctggaagcaaacgaacttgctttgatgtcaaaa

SEQ ID NO: 129 - DNA, 669 bp, Zea mays
taacaggatctccatctccatccgctagctaggcaagacagtcgagagtcgacaccatggccatggcgacgcaggggcaggccgaccagcagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgccgccgccgcgccggctctggtggtggccagggcaacggcagcggcgtgctgccgtcggacgacccggctgagaagccctctgtggaggtggagctgcaggcgccgccgcccgccctgctggtgtactccgccgccgggacgaagctggcgggcgccgcggcggagtgcgccatctgcctcgccgagttcgcagacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctgcacgcaagtgaattactctaaataaataattgccgttttagtgttgctatttaccattgcttgtactgcctctgtatag

SEQ ID NO: 130 - DNA, 913 bp, Zea mays
acccatttgcttcccctctgcagctctgctctgtttgcttactcttcccttccatggcggcatacgccggaaccctagttccacccttcctcaccgtccgcctcgcggtctcccacctcagatccattaccccggggtcctactccctgagccactgtctcccccgcctcgcggtcgcccgtgcggcctcccgcggaaacggagacggcgacggcgggcctccagcggagggggagaaggagcgccggcgctcgtcactcccagcgctgtcggagatccggtggggggagctgctatccccggaccccaccaacgccgtggctgtggtgctcacgggcgcgctcgtatgggctggcgcctcactgctgctgcagctcgcgctcatctccgcggcaatctttgccgccgctgtcaagtactcgtttgtcgccgcgctcctgttattcgtccttatcgcgctgctgtgatcgatccgccttaaggaaaaaagctgtaaattcgcacgaagcattcggatggaagatcagttttgattggcctcgcagatttaatttgcagaggtggcactcgtggcaaacagacactgactttgctttcctctgaagccgaatacacatgcattgacatggcctgcttttatatagcaatccaccttgtaagaaatatgacctttgggttacttgcatagctgtgggccgccccacatgaaactatgaaagcatctcgctggccactgtacatctttatttaagctctgtaaattcttatgaatattgtaatatgatatagtttgtatacttgtgttatgattaagtgaactcatcttgtaagatcctgttcggctgttcctgcgtgtaaggagaatttgttgttattgcttaccttgaacataacggcatgtgatgtttaatag

SEQ ID NO: 131 - DNA, 3831 bp, Zea mays
ggacactgacatggactgaaggagtagaaagtactgtcattattactggcggtggtggtgtggtgctgtcccctgctcctcctgttcctgcctccggggcgcggcgccttcccgtctcccttcctcctcctccttcctctcccaccgctcggcctcctccaccacacgcgctcggcggtgccctcccctgcgcggcaccgaaatgcaggtggggcctcgtcggcttcccgcggctgcgacgggccggagcagctagcgccgcggccgggctgtgatctggggccgcgccgcattgccgactgccagacgccgggctcgcgcgcgcagttcctgccggtggcgaggggaggcaagatgcggcatctcgctctcctcgcgcttcttctcgctcccgttctcggatccacaggcaccactctgtccccttctccggctgccactgattctcctgcaaaccaaggacaggcttctagtcctcctcaatctgcatttgctcttggtccagtagctgttccaactgcgccgaccactccatcagcgagtccttccccggagaaagccgcggctgtaagtcctgctgctcccacggagccacgaattgccccgggtccagtgactcctcctaaagagtatagtgcacctcctccagttgaggttgcaccccctgatcccaccgatgaggttcctccaccaatagctccaccacaagctgcagttggaaatcccactccaattcttcctgggacacctgcattgctaccttatgttcaggctcctgctccatctgtcgttctcaagcctaatccaccagtcgtggtgtcacctccacctgcgagtaatcaaccaagtatgccggttgggtctgtccctccttatccaccccctgcatcgccccctccggcaaatggcattccaccatacccgccttcaggaaggtttcctgctattcctcctgacacttcagtcccacctccagccacgtcacctgttattgcacaagcaccacagcgacgagcagatcctccaagtagagattataagaacggaaacgcggtgccgccagcaaatacttaccctcctgcaaatctcaagaagcatcatgttccacatgcatcccctccaaagggatccactggtcaaactgcccaaggtcacaaatcaccagttacaggatctgtgcccgcagcaagtcctttgccccagaacacaaacatgccttcaatcccgaagaatgcttcatcagtgccacatgcccaaccctcaccaccaagtgtagctccagaattggcacccacgggtagatctcatgctcagggatggaaatccagtaatcccaataacaaaacaaatagattacctgccccatcttatccaccgcctcgtgctcaagggcccgaggtctcacgaaccccaagacagactgggactaaaaactatactcaccgtgcgcctccaccattccctcaaggacaccctagctttcctgtacactccccatccccttcaccagcctcatcgaggggtcctgcgaacgcgaagaaaagaaatcatatttctcctactcttccttcaatccctcccctaccagagccaaaagcaccgtcagcgcatcctatttggacattacctccaccaccacctaattcagattgcaattccttatcatgcccagagcctctaacagatccacctgcgggagcaccatgtgcatgtgtgctaccaatcagagttggaattcgtctaagcgttgacctttactcattttttccattggtctctgattttgctgaagaggtagcttcaggggtaaacatggcacagagacaggtccgtgtaatgggtgcgaatgttgcaggtgatcaacctgacaaaacaatggttcttgttgatctagttccagtgcaagtgaagttcgacaatgctacagcattttcagcatttgaaagcttgtggagcaaaaaagtttctttaaaaccatcagtctttgggaactatgagattctctatgttgtatatccagggcttcctccttcaccaccttcagggcaaggtgttggggatggggcgtttggcaacaacagaaatgcaagggccgtgaagccccttggggtcgatgtaagaagtcccaagagaaaagtgaatggcagcctcattgctattgttgttttgtctactgttatagcattgattatttgctgtctggctgcatggtcgctgatcctcagattcaagggtccgagccacacggctcggggatttccacatactgtacttccaaaattttctaggtcatctggcacaggtcacacactttcagctggtgctggtcgatatagttcaccttcaggtccatcagattcactaggctcaagcatcgcaacatatgcaggacaggcaaaaacattcaaatttgctgagattgacatggccacaaatggatttgatgattcaaaagtacttggagaaggaggctacggatgtgtataccagggcacacttgaagatggaacgacggttgctgtgaaggttctgaagagatatgatgaccaaggtgagcgagagttcttggctgaggttgagatgctgggacgtttgcatcaccggaatttggttaagttgttaggcatctgcatcgaggagaatgcacggtgtctggtatacgagcttattccaaatggcagcgtagaatcccatttgcatggagcggaccgtgagacagctccacttgattggaattcacgtatgaagatagccctcggggcagcacgagcacttgcatatctacatgaagattctagtccttgtgtgattcatcgcgattttaaggcaagcaacattcttctggagcatgattacacaccaaaagtgtcagactttggacttgccaggactgcaaggggagaggggaaccagcacatctctacgcgtgtcatgggaacattcggctatgttgcgccagagtacgccatgacgggtcatcttcttgtaaagagtgatgtgtacagttacggagttgtattgcttgagctcctcactggtaggaaacctgtggatatgtcacggcccgctgggcaagaaaacctagttgcatgggctcgaccgcttctaacaaatgttctgagtctacgccaagctgtcgatccacttcttggacctaacgttccactggacaatgtagcaaaagcagctgccatcgcatcaatgtgcgtacaacctgaggttgcgcaccgccccagcatgggtgaagtagtgcaggccttgaagcttgtgtgcagcgagggtgacgacggcattgcgtcaggaagattcagccaggagctgcccatgcaaactacagcggtttatgacgctactggcatggaagctgagagagtgctgatatccgacatatttggctccacaccactctttactcgaggtgccgattcagattcttttcgcaagcagtcaagttcaggcccgctgatgacaggcaagaacaggaagttctggcagaggttacgaagcctgtcaagagggagcatgagtgagcatggcatctcaccatactatgaaacccgctcgcaatacagtggtaggtgaggaaacctttgcttggcttcgattagaaaacggattgatactcagactgggaataaaagagttcaaactgagctagtgtaaactacgcatctggaggtgaaagctatagcttcaggatctcattcagagtagcagagtggagcctgagcttcggattgctggaatggaaataacatctgctgtggactgctgggatctacctgcaaacctacgtggccatactccaatcacgaaattctggatccgata

SEQ ID NO: 132 - DNA, 948 bp, Zea mays
aaaaaggcacctgaaatcggcatttgcccggagcattcccacgatcgcctcgtagtggatgtcgtcgtcacccacgtcgtgagcctggggcccgtggccggcagacctggccaagcagtatatgcccagccgtcctgagcctataaaccctgcagccgggtcttcagtcttcacgcttgagctagctttcacaagacaaaacaagaacacaactgcagtgtaagtagcgctacgcggccggggagagatagggaaagcgggaagcaagggcgatggcgtctctgctgagcctgtacggcggcgacggtcggaggaggatgagccgcggtagcggcacggcgccggcgccggtgaggcgtctgctgaggaggctgaggtccagcttcatcagacggagcgcggcgcggccgaggacgagggcggcggcgaggttcgcctacgacctgcgcagctactcccagaacttcgacgacggcgtcatttcgtcgtcagctccggcggccacggctcgtgcgtagctgcgactccaggaggattctgcttcttctgtgtagtaacaagtaactgtagccaagatgttagctactagctagtgtggtttagtgctagtgcttcctcactgagctagagactcataatcgagtccagtgttaatttcctgtgattagctatctcatccagttattgtgtatatatggaagttactttgtctgtttttttcccttctgtcacgctatacacagtaattaatcagctgttggaattaatggatgggtatgcaaattaaaagggaatggaatggatggaaattataatataggggaacggtttttctgtaaccttctaaaccgatacgagacacatgcagacacggcggcgtagaagatttgctggagttgctcagcaaatgcgagtttttaagaaagtaaatcctctatgtgccaaacc

SEQ ID NO: 133 - DNA, 1793 bp, Zea mays
actaaagattagttctatggaaccaaaccgggcctaacgctaatccattactcgtttatttgcttgtttaggtttttttaaaggatatgatccgctacttctgattctgaacagggaaagcagtgtgtgcaaatgtcatctgggcaggccatagtggcccagcctgaaattgagctgtttgtgccacttggcaattcggcccgcccggatcggcccgttaagaactgtccctccgaaacctaaggaggggtcaccctcttcttttttccctcgagaaaaataataaggtcgccgccgtcctctcctcgccggcacttcactgagggcgaagaaaaaagtggcagtatattctgccactcacccaagagccaagatcatggcgtcatcttcctgcgtccgcctccatcacctgccgtccacctctcgccggtcgtccgccccaaccaacctccagttcctcgcggcgagctgccggtggcggcggcgggttctcgttcccggcgcggcacctcctcccctacgcctctgcgccacgggttccccgcagccgcctcttggcagtgacagcaacgctccgttgtcccgcggaacccgggaggagggcgaggaagtggaggagcagcggcagcctccgcccccgccgcggctcaagatcgccgtggtcgggttcggcaacttcgggcagttcctggcgcgcacgctggtggcgcaggggcacacggtcctggcgcactcccggtccgaccactccgccgcggcggcagccatgggcgcgcgcttcttcccggacgcgcacgacctgtgcgagtgccacccggacgtagtgatcctatccacctcgatcctgtcggccgagtccgtggtccggtcgctgccgctgcaccggctccgccgcgacacgctcttcgtcgacgtgttgtccgtgaaggagttcccgaagcggctcctcctaggcgcgctgccggaggagatggacatcatctgcacgcacccgatgttcgggccggagtcggcgcccagcggctggacgggcctcccgttcgtgttcgacagggtgcgcgtgggggactcgtgcccggcgcgccgcgcccgcgccgaggcgttcctcggcgtgttcgcgcgggaagggtgccggatggtggagatgtcctgcgccgagcacgacgcgcacgccgccgagacgcagttcctgacgcacaccgtcgggaggatgctggcggcgctggagctccgcgcgacgcccgtcgacaccagggggtacgagacgctgctccggctggtggacaacacgtgccgcgacagcttcgacctctacaacgccctcttcatgtacaacgacaactccaccgagctgctccaccgcctcgactgggccctgggcgccgtcaagaggaggctcttcgacggcctccacggcgtgctccggaggcagctgttcggcgtcgaggacggggagggcccggcggagcgcacggagctgctggcggtggtgccgggtggtggtccgccggacaccgacgaccagggcggtgacgggcgcgacggcgacggcgacggcgacgagtcgggagagcagaagaatgattgatggcacgggcggcactgcacgagacaccggtgtggcataaatgcacgtcgattcgatctgtcgcggcgcgcgccttgcatgcttgtttgatcttatcctgacggccacgcatggctttcgatcttgctgtcttccttcctaataataactgtgacatgacaagtatatcatcagtgatcgatggcgtcattcattttcgatgggc

SEQ ID NO: 134 - DNA, 3481 bp, Zea mays
aaaaagccctggccgttccctcctcgccccgtgccgccgccgcctccgtgcgcgcccaggcttcctcctgtgacttcgctacaatgggtcatgccgtaatcaaaagaaggactacattttcatgccaacattgaagataccgccttccattattgctgggtaagttggaacagaggagtgcgtattcaagatgatggacatgaggcgccactctgtgtctgtggatgccccactgtcaagaaccttggtgcagctcaagcgagtgaggtcgctgcgggatccagcgacaaactcgatgagcaagtacgcgtctccttccgatcacatgatctgggagactgcttctagcaatggggtgactccggagcttggcaggtcagcacaccatcacctggttggggaagacgaagatgtgggagctgagcctactacaatggggtcagagcggagtttccggggaccaagcgcaaggactgcatcgtataggaaatcttctgctgtcaggatcagaggactgaacccaccaagaagcaagcaggttcaccgtgtccgccaagacggccaccgcaagtcattggattctaaccactcaaaccatagctctatccgtcaattggcagacaatatggtcagcaatgtggatgcagataaggaagagggggaagtgaattcctatgaaagaccaaaacttgcaatgccagataagtctgacgaagaggtgaaaatgccaggctgctccaaatccaggagcaagtcttctgctgcaatgagccgtgttgggagcccctgcatgtcagccagtgaggcacgctcagttgggtcaagaagaagcactttggggcatggaaccgaggatacacgactgaggtcaaatgatgtcgtgggatccaatttcagtggctgtggtataagctactgctggtcaggagcgtcaaagtaccgggagctttattctgacagcgatggtccagaccaacctctcttatccacagatgggattgaggcagcattccaaggcaatgtaccatacactgagacactgaggtgtctaagccagaagttccgccctcgttccttcagtgaactgattggcctaaatgtcgttgcccagtccctcctatattccacttgcaaaggaaaagttgctccaatgtacttgttccatggcccccggggtacaggcaagacatccacggcaaggatttttgccgcggcactgaactgtgtatctcttgaggagcaaaggccgtgtgggttctgtaaagagtgtgtcattcttttctctgggaagagcagagatgtgaaagagcttgacgctgcgaaaatggatcgtctaggccgagtgaaggcacttctcaagagcgcatcgctcgtgccatactcctcgcgcttcaaggtcttcatagtagatgagtgccacctcttgcgagaagatgcatggtcagcaatactgaagagccttgacgagccataccggcacacggtgtacattatgatcacttctgacatagaaagcctgcctcgcgcttccatcacacattgtcagaagttccattttccaaagataaaggtggcggatattgtctacaggttggagaggatctgtatagaagaaggattggaatttgaccatgatgggttgtacttcattgctgcaaagtctaatggttctcttagagattcagaaataatgcttgatcaactcagtttgcttgggaagaaggtcacaatttctcttgtgcatgaacttgtaggatctgtgtctgatgatgagttgattgaattgcttgatctagcgttgtcatccgacacaaccaataccgtaagacgagctcgagaacttatggggtcagcaatcgatcctctgcagctggtgtctcagttggccaaccttattatggacattctctcagggagatgtcaatctgcagtcacggaagtcagcaaaagtttcttgggtagatatgcattatcagaggttggaataaagaaactaagacatgcactgaagatactatcagaaactgaaaaacaattgagaacatcaaggaatcaggctacttgggttacagttgcgcttttgcagtttagcaccaatgaacctaaccctgttgctgaaacaaatgatatgcatgcacattcagtaactggatatacagatgactgggtttccaaggtgcactcaagtgccaatttttgccaggcatgtaacagcagcaagtccaactgttctgagagacactgtaggcggcttaagctcgagaacatatggaggagagccattggaaagtgtcgatctaggtcagctaaaagtttcctcaggaaagaaggcttcttatcgtcggttcacgtcaccgaagagctggccatagcagaagttggttttgaacacccagatcacctgtcaagagcggagaaaatgcaaagcctaatagaatcctctttgcaacacgttcttgggtgcaatgtggagatcagattcaaactcgtgccatgcccagtgagcaaagatgctaggttgaagagacagccgttcagctttctcaactgctctggccggaagcaagagctgtcagattcagtcgtgactgatgaagacgaagctgcgagggggcctggagcaagagagacaccgcttaaaggctacacctctagccagcaggaatcaccatacaccatgcgacgtgtcgattcgaaaccaacaacggtccacggttgcgaggatgacgcccggagtaccttgacgtcaagcagatccacggcagatgacctgacaaggacgtgcaggtcggagactggctacccaaagggtgtgcgtgagcagggccgctctgatggcacgcagcaggagcctgacctacagccgaactgcttctcgcgaacgctcaagcttcagaagaagctgctgtcttctggcgcagcgcacaccatctgtctgagggtccagccacataacaagatggatttcctgcctaagaaagagttcgatacgtacttctgcgcgtatgagccctacgagcagtgtccaagatcagattcaagagctacttacagttcaagagacgatgacttgtggagcaagaattcacgctttggctcgaatctactctgctggagagccccaaaacagtccatgtaatggaggaaagaacgagtgaactgggtggaacaaatcgattctgctacgagattttaccaattttgcccgaagctggagacatggacaccacccgcagctgcggggacaaattttgaagggaagtctaggaggggtctgtgctattcttgatcttggtaggcagctgaggattgaggaactatttagtgatgttttcttggaaatgcagatcctttataatgctagtgggcagttgtacagcgcgccagcgacgaaaccctgtgaattgttctgttattctgaattttgtaggacgatttgatgctctctctctgaatttacatgatctttttattagctgaa

SEQ ID NO: 135 - DNA, 915 bp, Zea mays
accccaactcgctcccttccccgtgcttcccgccgtcgtggagaggtcacgcggctggttcccgccgcttccggacgggttccgagggaggaggatcagctgccgcgatgttcctcaggatctctcgtctcggggcgcggcttctgcgcgagtctggagcggagacgagagctggaaatttgctaagcagtccaggcattttgtatcaagctcatcttaaccagcattcgaccagagtgcggaatgtccttttctcaactgcaacaagtggtgatcaggatgaaagcagtcaggcaaaggataaaatctcggtaacatttgttaacaaggatggctcagaaaagacaatacgtgttccagttggaatgtccatgttagaagctgctcatgaaaatgacatagagcttgaaggagcatgtgagggttcacttgcgtgttctacttgtcatgtaatagtaatggatgtaaactactataacaaattagaagatccagcagatgaagaaaatgatatgcttgaccttgcatttgggctcacagagacatctcgcctcggctgccaagtgatcgcgaagcctgaactcgatggtattcggctggcattacctgtagccacaagaaacttcgcggtagatggctatgtaccgaaaccacactgaagacagttatgtacaccacactgaagacagttatgtacaccacactgaggcagtcatcttggggggcacggattcgtacaagtcaattttgtagtttataacctgtataacctaactacacctttgctacttgtagtcggggtagcttaggactaccttgttgagggagggttcgttcattgatgaacccctccattactcccagataacagtgcttccttcatctgggcgaataaacatctttcgttttgtgcga

SEQ ID NO: 136 - DNA, 1173 bp, Zea mays
ttatacacaaacatggttttctcgttttaagtagtgcttgcggtggttcttgttgaaatacaggtaatcctgcggggcttcattgcacacatgtcaaaaaatgagagaggacagaggagaggaggaggaatcccatgcttctttaaattctgctgccattctgctaccgtgggcgtcgtacagccccgtttccatagaggacagtctgccgcaaccacaagcctagcttcgtccacctctgaatcaagaagcaactaggcatggacgaccgcacctacaagggcggcatcaaggcgtactggaagcgccggggctactaccgcatggacggcgacgccgcgcggcgccgccagccgctccccaccgtggagctcggaaatggcgtctcccaggcccaggcccaggcccagccgccggcgggggatggctcgggccggcgccgccggtgccgcgggtggcgcgtgcgccgcggccagctggggcggcggctgctccgcgcgctgtcccctcgccggtggctcatgcggctccgcgacgcgtacgtgtccgccatgctgcggctggcctcctcccccgccgtcgggtacggcgccggcgcgcccttctgcgccacggcgacccacggcgcggcggcggcggcggccttcgcgcggccggcgcagctcaaggagtacgacgagaaggtgctggtggagatctacaggtccatactcgcgcgcggcgggcctctcgccggcgcgcctgccgccgccacgctgcggctaccgacggctgtttgagcttgagcggcagaagagacgtgtgttcttcttgcttatttttattcttatgtgtcgcgacttgtactgagttgtaacttgcgtgcgccccacaagctagcgtttcttcttcgttcccaattcgatatcatcaagtcttatgttatgggcttggagtccaaagtctggtgcatattttttgcaccgcgggggaaaaaaaacgggctctgtctaaattatcaaatatgaaaactaaaactattaaaccaatacaacttcctagccattcgcactatccatgtcccataaaaaatcatggccgctgatgctttacatctagccgcacgcgtggccgacggccaacgctgcccgcatgctacacgtgtgtttctcaaccgtcccctaaaaaagaaaa

SEQ ID NO: 137 - DNA, 3233 bp, Zea mays
ttcaaatgctccggaatggaaatgagggaatgtccacaatacccggatttagtcagatccaattcgagggattttgtagattcattaatcaaggcttggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaaggaaaccatttctattggaaacattcctataatgaattccttaggaacctttataataaatggaatataccgaattgtgatcaatcaaatattgctaagtcctggtatttactaccgctcggaattagaccataagggaatttctatatataccgggactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaataactacttatgagaccttttttggcacataccccttagctcaagtttttgatcaaaccaatccattgacacaaacggttcatgggcgaaaagtgagttgtttgggtccaggaggattgacggggagaactgcaagttttcggagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgccaaacagctctagattcgagggtttccgttatagcccaacgcgagggaaagatcatttctagtgatagtcacaagatccttttatcaagtagtgggaagaccataagtattcctttagttgcccatcggcgctctaacaaaaatacttgtatgcaccaaaaacctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacgtttggtatatgaggatatttatacttcttttcacatccgaaaatatgaaattcagacggatacgacaagccaaggctccgctgaaaaaatcactaaacaaataccacatctagaagaacatttacttcgcaatttggacagaaatggagttgtaaggttgggatcctgggtagaaactggcgatattttagtaggtaaattaacgcctcagatagcgagcgaatcgtcctatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagctggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaatgctacgatctggggaaaaagagtgcctaatcacgaggatccgccagaatcttttcgagtgctcgttcgagaactacgatctttggctctagaactgaaccatttccttgtatctgagaagaacttccaggttaatagggaggatgtttga

SEQ ID NO: 138 - DNA, 1906 bp, Zea mays
gtgtccacctctgatctcttcatcctcgggtcgggactcctctgtctccttgccctgtccccaaacaacctctgaataaagggtaactaccattacgccattcgcataaaaaaaactgagcctgcccgcccgcccgcccgcgcgctccgctccgtgaactatatctatctatcacctgctgctccaaggaggcggacagaggcaggcaggaaggcactcacttctccaggagcccggagtcggcagcaagagagaatggccgccgacgccgccgccgccgccacccttcgtactgctctctcccaagcaacagggcaagagcagagagcttcactgctgtgcacaccgaagcaccgagttgctgccagcaggagaagcttgagattcaccactagggccagctcgaatgcgggcgccagtgtgagcatccctaagcaatggtataacctcatcgccgacctgccggtgaagccaccgccaccgctgcacccgcagacacaccagcctctgaatcccagcgacctctcccctctgttccccgacgagctgatcaggcaggaggtcaccgacgagcggttcgtcgacatacccgaggaggtcatcgacgtgtacaagctctggcgcccgacgcccctgatcagggccaggaggctggagaagctgctcggcacgccggcgaagatctactacaagtacgaggggaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggcctcaactgcgaggtatggcaggtgcgcgcgtcgttcgaccagaagccgtaccggaggctgatgatggagacgtggggcgccaaggtgcacccgtcgccgtcgacggcgacggaggccggcaagaggatccttgaggcggacccgtccagcccgggcagcctcgggattgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaagatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggtgggcttcggtaccatggaatggcacctctgatctcgcacgtgtacgagctgggcttcatggatgccgttgctatacagcagactgaatgcttccaagctgccttgcaattcgccaggacggagggcatcatcccggcgccggagccgacgcacgcaatcgccgcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggacaagctggaggcctccctcgctgccgtgcccaaagtctgacggcgttggagccaacagcacatgcgactggaatgggacgaataatccattgatatcggcttcttgaatcttgtggtcatccatcgcccatcggcagtgggatacttgtgttccttatgaaatgaatgaataaaatttcaataaaagcattaattttatc

SEQ ID NO: 139 - DNA, 1930 bp, Zea mays
ttaaataatgccccctttgcacgtccccggtagtagtactcctcgcaagttctatcacctggtgctgttccatgtgcacccgttctggatccaagtcctgtacttccttttgatctccgttttgggtttcttgatgctgagagtcctgcccatgaagtccagctccgtgcctaggccctcggctctggacctactcttcacgtcggtgtcggcgacgacagtctccagcatgatcgccgtcgagatggaatccttctctaacgcgcagctcctcctcatgaccctccttatgctcctcgggggcgaggtgttcacaagcatgcttggtctccacttcacctgcaccaagctcagaaacaagagagaaacacctcataataatctccatggtaatagcttagagcagagtcgtcgtcgtcaccgtcccatggagatggaagcccaggccgccgccgtccaaatggagcttgcagggttcaacaaggacggccatggcgatttcgcatccatggctaggttgctaatgtttatcgtgctgggctacatcttggtcgtgcacatcgccggctacgcgctcattctaatctaccttagcgtggtcggcagcgcgagagcagtgcttgttaggaagaggatcagcctgagcaccttctccgtcttcacggtcgtctcgtcgttcgcaaactgtggcttcgtgccaaccaacgaggggatggtgtccttcaagtccttcccgggcatgctcctcctggtcatgccacacatcctgctcgggaacacgctcttccccatcttcctcaggctctccattacggcgctcgagagggtcacaaggtggcgagacctctgcgagctgctgagagacagaggacccggcggcgggccagctgcggctgccgccgccgccgctataggctacgaccacctgctcccgggaccgcgcacatggttccttgctctcaccgtggcggtgttcctggcggtgcagctggtgctctactgcgccatggagtggggctccggtggccttggagggctcaacgcgttccagaagctcgttgcagcggtcttcatgtccgtcaactccaggcactccggcgagatggtcgtcgacctcgccaccgtctcctccgccgtcgtcgtgctgtatgtgctcatgatgtatctaccgccttacactacatttttaccggtagcagtggaagacgaccagcagcagcaaaatgaggcacaaccccacgacaatagcacgagcaagagcagcacaagtattagcatctggcacaatctgctcatgtcgccgctctcgtgcctaaccatcttcatcgtcgtcatctgcatcaccgagaggcggcagattgctcgtgacccaatcaacttcagcgtcctcaacatcgtcgtcgaggtcatcagtgcgtatggcaacgtgggattcagcaccgggtacagctgcagcaggcaggtgacgcccggcggcggctgctgcaaggacgcgtgggttagcttgtccggcaagtggagtgtggaagggaagctcacgctcatggccatcatgttctatggcaggctcaagaagttcagcatgcttgggggtcaggcatggaggctgaactgaaccgaagtactatttcgaaactcgctcgatcaacctgatctccaggactccaagactagtacttgaattctcagtctattcagacggaaccggatcatatgacaaatccatctgcgaggagtttggctgcattctgtaaagtcggtaggggcaaggggttgttcatatcctttttatttaaaaataaaaaatagttttatatctcgacttttgaaaattatattttgaggtgtctgtcacccaggggacggcagggagttaaatgtaatttttaataaataggttctcgtcgctcactcactcattacgggctta

SEQ ID NO: 140 - DNA, 1599 bp, Zea mays
gtcggaggcacctctcatttctcgtcgtctttgtttgtatgttccattagcacagactgaagcgcaactagaggatacagccatccattggtagtacacagggtcccacccacaagagaggcatggcggccacatcgtccctgaagagcagccttctcctcccgtctaccatctccgacttcagtggcgcagccgcagccgtctccatctcaacgcagaagaggagatcacggggggcgagggtgcaggtctcagcggctgcggactccaagaacattctggtcatgggggggactaggttcatcggggtcttcctgtccaggctccttgtcaaggagggccaccaggtcacattgttcaccaggggaaaggcacccataactcagcagctgccaggggagtccgacgcggagtacgcagacttctcctccaaggttctgcacttgaaaggtgacaggcaggacttcgaattcgtgaagacaagcttggctgccaatggatacgatgtggtttacgacatcaatggacgtgaggctgtgcaagttgagcccataattgaggccttgcctaacctgcaacagtacatctattgctcatcggcaggagtgtacctgaaatctgacattcttccgcactgtgaggttgacgcggtggaccccaagagccgtcacaagggcaagctggagacggagagcctgctgacctcgcgcggcgtgaactggacgtccatcaggcccgtgtacatctacggcccgctcaactacaaccccgtcgaggagtggtttttccaccgcctcaaggccggccgccccatccccatccccggcgccggcaaccagatcacgcagctcggccatgtcaaggatctggcaagagccttcaacctggtgctcgggaaccccaaggcgagcaagcagatcttcaacatctccggggccaagtatgtcaccttcgacggccttgcgcgggcatgcgcaaaggctggagggttccctgagccggagctcgtccactacaaccccaaggaattcgacttcggaaagaagaaggccttcccattcagagaccagcacttctttgcgtctgtggagaaggcgacgagcgaactcgggtggacgccggagtttgacctcgtccaggggctcaccaactcgtacaacctcgacttcggccgcggcacgttccggaaggaggcggacttcaccacagacgacatgatcctcgacaagaagcttgccaccgtttgatgcatgtctcgggctagctgtacgtacgtacgattagagaagagataaatgatagcaaatcaaaatttgttgttaagtaaagtgagctcttagcttctatcagggacgattattaaggatacccgaattattcctcccaagaacacactcagagaagtaaggtacctcttaggccgaggcttctcctcgagagtctcccacctcgggcataactccgcctcgccccgagctgatccccgacagataagataaaagcgcctaaaaataggaaggaaacactcgcatttaatgtatactagttgtgtgctcgtgcgttgcaacgggaacatataataccattgatagcttatgt

SEQ ID NO: 141 - DNA, 617 bp, Zea mays
cacttggacgggctcgcgtctcgcgcacgcagctttctactgccatcctccgtgtatgtatatatcgtcacgcgcgagccttgtcacccgtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggatgccacagc

SEQ ID NO: 142 - DNA, 1319 bp, Zea mays
ctgtacgtccaatagggccagatgggtcttggtcgtctcacactgttcggcccagaccacatagtgcccttaactccccagcaaccagcagcagcaaaaatcttcacgatttagaaaccctcacctcttcccttcctccccgccgccgccaccgccggaaggagaaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcaggaaccgggagcgcagggcggtaaagcgccagcgcatccgcgacgagcacaaggtcaccgtaaggcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaaggagcctttccctcttaccagtaacgatctaattgagaaggctcttggagatcacggcatcatatgcttggaagacgttgtgcacgagatcgccacggttgggccgcacttccgagaagcatcgaggttcctcatgcccttcaggctcaagtgtccggagaggaggctgcagatgaagaggaaaccctacaaggatggcggcgactcgggcgaccgtggcgacaagatcaacgaactaatcgagaagctgaactagaagcgcagaccttgcctcctccggctgtcgttttgcgttggagcgatggatctgttattaccttgtcggttttgtaatagcattagctgggtgtaccttcggctttgaaaccttacctgcgcttgtgcgatcaggtcatgaaatagcaggcgcttctttggtcatccccttgcgttctgctccacatgcctcttcggttggtgcgacaatatatcagctgtgttatgaatgatgtagcgtgctagtatagtgcagacgcttataatgtatgcacacttgcaactgtgaacggacatatatgcaaacattacttctatgatcttcgaaggagattgatgaaagtcactttgcttgattta

SEQ ID NO: 143 - DNA, 1175 bp, Zea mays
ttttaattcaataaaaaatattatgttgtgtgttttctgagcgttgaaataaatccgcgtgaattacttaattctgaaatagaaaagctgacgtggctatagcctgaggctgtagcctgctgcagcctgtgcactggagcagcaggggcgagagtggaggcgagagctgacgtggcaggggcgagagggagacggtgcactggactcagcctaataaccactacccagcgggcgtacccgttgccatctggctctcctccgtccatttactcacacggtcacaccgcctcaactcgcgctgcccgtcgcccccaagcctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggcggaggtgacatgggtgcgtgacatgcttcgcggggacgatgcctatgagatgcgggtgaagcttatcaagcaagtcccggaggaatacccctacaaggatgatgactagttctactttagtgcaagattgcttgtttggattttgacatcgttttcgtcgatggtccgtagttctgctataacctgatatcatacgaggaaagctgcgtctgttttgcttgtgtattgtagaaatcatacataatctttcctgagttgcggctttgaattagtctgctggattcagggcgttcgctatgcaaattggtgttatctagaaataaagtattttcgatcttatcagtt

SEQ ID NO: 144 - DNA, 994 bp, Zea mays
ttcgctataaatacccctgcacagacgcaccttgctgcatcaccatttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgcggctacgccggcttcggcagcggcgctgccgcccgtaccaaccgccccggttggaagtctggagactggatctgcaccaggtccggttgcaacgagcacaacttcgctagcaggatggaatgtttcaggtgcaacgcgccacgggactccggtagcgctgccacgacgacctacgaaaactacttgcactgaggtgtaggtagagcaaagtttacagctatagcgcgcgtcgacgaagcaggagcagcagcagcagcatgaattgaagaggagtcctcatcatcacatcataagggagcagcagtagatttaattgcaaaattaaagacacccgcgatgcatgccctatcactagttttgttccaccggtacccctaccgcgcgtttcttttaagatttggttccccatttatctggggacagtagaccccagatgagacctatgtttgctgtttcattttcagttacgttcgtctccgcatgcatgtttgcgcttggatctgatgtaaccccaaaacgcttgcttcacaagtactattaactagttctgttgccttcctatataatatcttg

SEQ ID NO: 145 - DNA, 1008 bp, Zea mays
gtaaactgtaccacgagagagagagagagagagagagagagagagagagtgagagggccgcatcgcatacatacatccgtccggagataagagaggagtggaagaaaagaggagaaggtgagcagctgcctttgcctcccgcgtgtcgttataaaaaggatcggagcgggggtcaccgaaggcgtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaagattaaggtgaagaaagaccacgcatcggtgccgttcgatgaccagtgctctattctagagaaggaggccgtgaacctgtccctggagaacctcaagacctaccccttcgtcaaggaagggctggccaacgggacgctcaagctggtcggcggccactacaacttcgtgtcaggggagttcctcacatgggacaataagcagccatcgtgaatctatatatatacactacatgatgcatgttcgtattcagcatgcagctacatacatatatatataccggatcacccaatgcaatgtgtgaatgtgtattgtgtaataagcaataccatatattctacc

SEQ ID NO: 146 - DNA, 1035 bp, Zea mays
aagcaaagccctcctctcccctctccctcgcggcctcgccttatcccctccgtcactcacctcgaccaccgccatggccatggccttggcctccgcgaccgccgccgcactcttccgctccgccctgtccgcgccacacggcgccggcgcgcgcgtccggccgcagcgccggcagccgttcttggctccgctccacgcggcgaagggccccggctcggcgccggtggtgctggagggcaaggccaagggaaagaagaagaaggggcccagctccgggaaccttcccgcagccctcgacgtcgagatcagggaggcgcaggagtacctcgacagcgaccagcaggaacctgttccagacaacttcccatttgaattaatcgacgaagagggcatgagcgtggttattttgagaagggactacaaggacgagaaggtcgaggttactgtcagcatgcctaatttagaaggaggccccgagtttggtgatgaggatggcgagggcgatggtgagagcgctgtcaaggacgacggagaagcagaagaagatgacgagagtgccggggatagcagcatctctcttaaggtggtagtttccaaagactctggcccaaagctcgagttcacatgcacagccttccgcgaggagatcaccatcgatgatatgctgatagtggagaaaacagacgacgacgacggagaagagaagttcccctacgagggccccgagttcaccgagctccctgtgaatgttcagaaaggcctgttcaagtacctggagcaaagaggggtaacgctgtcggctaccaactatatgcacgattacatggtgactaagcaggctcaggagtacatccggtggatgactaagctgaaggatttcgtggcgcagtgaggaacagcgtcgtgattcggcagcattgtttggttagcctagccttagcatgtgttacagccttacaggaacactacgactacaccgaattggccacactccccaaaaaacaaaaaagggggagcattgtatctgcttcaatg

SEQ ID NO: 147 - DNA, 844 bp, Zea mays
acggatcggagctgtgtgcgtcactacttgcctgccactcgatcagcagtaggcccacagctcactcgcaaccactcaccaagctagcggaagcaaagcagagcagcggtcgccggccgggcacgataccagcgtcgcgagagagagagaggatggcgttcatgcggtaccgcgcgctgccgcggggggagctaacagcggaggagttccgggcgtggctggcgcagttcgacgcggacagcgacgggcggatcagcagggaggagctgcggcacgcgctgcggagcctcaacgtgcggttcgcgtggtggaaggcgaggggcggcgtgcgcgccgccgacgccgaccgcgacggcggcgtgcagctgggggaggacgaggtggcccgcctcttcgccttcgcgcagagccacctccgcgtcaagatcgcccagctcgggtactactagtactgctgatccgtcgtcggccgatcgatcggccaatatggaggcatggagcatatggcatcgatcgatgggtttgtcactactcgatcgtcacttgtttgtcacagctgggtgggttggatgtgttgttgctacttttttttctctcacgtccgggtggatgtgtgttgttacttattgttacgtactgctgtttggtcaaaacacattgaacgcaaacgcaaacgggaagagaaagcagcgagcgctaatgattaacccatcagttgcgtgtacaaagcaacaaaacaaaaacacttttttagtaggcgctgtacgtacgagtgctgctgcttcttgaatgtcttgtggtaacttcaatttgtggatggtttgaagagtgtatgctgcgtata

SEQ ID NO: 148 - DNA, 1760 bp, Oryza sativa
acggctgcttgcttttgcgcaagtttcaagcgatgcgccaccgcgtcggccccgccgccgccgccgcggcggcgctccggcggttctcccacctccgcccgccggccccgccggacccgaggctcgccttccttcgctcagagtttgatggccgtgagcccggccgacagccaccgtcaccggaaacaagagaggagccaaaaggtggcgagcgcgcgcgctcgccggtggccgtggatatcgcgcacccgtggccggagtgggtggcgctgatggagctcctccttcagaggggccacctcgacgcctccgtgttcgccggcggcgcggctggctcgccgtccaaggattccaacgttatccgcaccgcctgcctccggtttgggcgagagcggccggagcttatcaggcatctatcaagatgggatatccaggttgctctccggtatgggtgccccagcattgacaggaaggttgttaattctgggaagcgattacgtgctcatgtaggccttgatgaaggagaggtctgcagccaatgcaatttaaggggtggatgcgagagggcatatgtaaaggctcggaaggaggaaattggaagaactgtggatgttatgcgcatccttttgacttatgggcttgacacagttactggcaatgtggagaacagagcatgtctaaacaaaaccgttaaagaatccattaagagcctacttaatgagattgttgggttcgattccatgggtcctggttccagcactgaaaagcccacacaccgtatgccaaaaggacaatcttctattcctatgaagcagggtgattggaattgtcccaaatgcaacttcttgaactttgcaaagaatataaaatgtttacgctgcaatggagaatttgaagagaggtatcagctgctccatgagaaccaagagcatcttcctctcaaaaagggtgattggatatgcaaaaggtgcaactttttgaattttgcaaagaatacaagatgccttcagtgccatgagaaaccaacaaaccgtcaactcaatccaggggaatgggagtgtgtctcgtgtaattatttgaacttcaagaggaatgcattctgtttgaaatgtggttggaaaagaccaaaatcattgaacaaccaagacagtattgaatcacaacgtgacttagatgataataagcattctgctatttcatttatccaagatggcatccaatcgaggaggcaaattctgcaaaataaggctccattgtctgacgaagattcagacttctggagctccgaggaggaaggggcctaccacagtgacaaaaacattcccccaataaagaaggattacaagttccttgaaagttttcccatcattgggggtaggactgctatgtctcaagatcctcttgagagggagaaatggaaggacgaaatgtccaggagaaacaaagggctcctaacagaagtatcagaagaaagtaatcggccttcgtgccccgttcgtattccgagaagcattgagcagattgaatctggtgacgacgacgacgacgacatttcatcatggttttctggtggtactagtaatattaacatgaaaaaggcatagccagatttctgtaaacgctagtatctgcacaatttcatctgtaatatttacagtgtaggcattcagtaagaaaaaatcatgtctcgcaaagaacttcagtattgtacttctgctatgatctgtcttggcaaataatatactatgattttacaagtt

SEQ ID NO: 149 - DNA, 854 bp, Oryza sativa
acgctcacattcttgctagctcactcctctcctcctcgtctaccttacctagcagcagcagctagctagcttaattagctatagcagccatggcggcgacggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacgaccaggttgccgccggctgggtcctcacctgccacgcctaccccaagtccgacgtcgtcatcgagacccacaaggaggacgacctcatctaatcaatcaagcaagctccatatttataaatctctcgatccatctccatgcgttcttgagtttatcaattaagaatataatgtcgtcgtccctatgctatgcaagcaaagtattacgtacgtatatgttgagcgagataacaaaacacaggcgtgcccgagggttaattgttgttgtttaattaatgtacgttttgctgcacctgcttaatcatatccatatcacattttggtgtcatatatgcatgcattactgtgtcatatatactactgtcaaatacgtactccatgtatttgaaagaacagttaattaataagctatatatcctagttctactcttgtgtcta

SEQ ID NO: 150 - DNA, 6464 bp, Oryza sativa
aactacgcgagagccccaaagcccaatcgtctccttcgcctcgccaccaccaccaaccacgcctccgctgccacacgatggacgacgcgtggcccgcgcggtggcctccgcctccgcctccgcctgctccggcgccggcgacggcgacggcgacaccgctgccgagccagattgacagcgccagtctgcgccacatcctccgccccttcgccgcacagggagcggcgccgccggagcagctggccgcaagccatccgagctcgcagtacggccagcccgcgagagcggcgccgagcacctcgttgcttgctcaggtggctgggaaccatccccatgccacccatgtttcggaccggaaggcgttgtttggcatgctcaatgcaggcaatgctgctaatgtcattgatcttactcgcgcttccccgctcggaggcgcggagcctctgcccaagcatccgaggcacggcttggaagccagcagcagcgttgagcagccctcctgcttggggccgttgtttcagaacacaagtgcaaatgtgcagggtagttttccaggggaatgttcagttaacaatgggatatcccaaggcgccatccagtttcaggactcgagcacatgcgcagtgcagaaattgccatcccaatcaacccctcgccatcatcctgcgcttctaggggatcagatatgcgtctcctgtctgaatgttggtggtgaattctttgtcggtgaagctgggatttttggagttcgttgcttttgtcaccggctgagaatgtctgtggctaagttctgtgagcattcaggaggacccgcagaaaaagctggtgaaattgtcattatggataatggcatgactattgtacaatggctcaagtactgcatgggggttggagcatccatttctgacactaagtgggactggccagaatgggcatatatgagatattcttcagaagaatactggactaaaagtctccttacaacgaacaataacatggaaaaaacagggctattcagtggacatggaaaaagcactggacatataaacaatccagtttattccagtgatatccacaatgaggttggacgattcacttctgttgagaagctagtgaataagccagatgaaacattttatagaaagagtgtcggtttacatgaagctttctcaaagaatccagctatacagcagagttcgaaaataaacttagcaaatcatatgatccatgacatgaacatgaactctattagcaggccaagtgaacgaacatattcaacagcaaacatgggaataacttacagtagaaatcatttggcacatgattatgcaaactttctggagaaaaacttaaataacttgtctcgtagtcctggtcctagttctacaagagttttgagcaatgacagtagggcatgcatgcctgatgtacctcacaaaataattcaagatggttcaggtagagcatcaaacaccgaactgaagctggggcaatcatcttatcatcaatctatggctaccctatttccatcggtgcagtcgacaataatcgaatttcagaaacctcagcaccacctgcaattcacaactccaaatgcttatccgaagcaaactaccaaagccaacaaaactatagaaaacattgagccatcatttggtacaggtaataggaaacgatcacttgatgtttctaatggaaccagccattctgaactcaatgagattacagatgatgcagcaaagaattcatttatttcattatttctttcacatcttgagagaaatagtacatctgagtccattgatgatgttctcaacagtaatgagcattaccttcttaaggctccagatgttgcatatagttccgatcgtttaaaaactgcaagtacacaagttgagacaagggcaaatgataatcagttgaagttggcacctgccattattcacacgaaaaggatatcagatagcaggtctcttccagttccagtggcttccaagggatatgttcatcaagatgtacttcatgcaaatagtcaagagcctttaataaatggggactgcctgccacatttgctgcctagtcaacctaacgccggaatctccaaaatttgcgcagaagtttcttctccagtgaattgcaggtgttgtaatcatgttgctgacaaatcccatcttgcacattctgagactggggctccctgtttttatgatagaacggccaggagatatatttcttttgaatgtgctgatgacttgtgcacacataaaagtttgagagctaccaattatcagtgtggaagagccttttgttctacagctaatgagtttctacctagctttggccaaaatgatcaatcgccaataggaaaatcaatgcatagatgctgttgcaaagctcaagaagattcttccaaacttggttttagagctggcaatttctgccgatctcatttctgtaatgatggcactccagttccagcccataggtctattgttgaagggctagatgaagtgcgcacccgctctactttcataccaagatcctcattatgttctagagagcttatgttgcagtcctgttgccatgcatgtcccattgatgggtactacagaagttctatgggacacacagccaacagcttgactaagaacactctgcttgatgcacctaataatacagaatgtagtccttaccgggatggaaaatgctgctgctctttagccccaaaatgtttggcaggttatggatttacaaagcactgtgttgctagaatcgatcaaactgatcatacagtacaaaagagcaaggatgatggcatgcaagctgctgccagatgttgcacgctaggggagagtgaaaaattaatatgccagtgctcaagcgagataattgctagaaaaagcgactctaaagcttctttccagaatgaggtctctactgaagtattgaaccgaccttgtgttcctacattacagcagctgaagaatgtaacagaagcatcggctgtaggtggccattggccctatgaaactgtaaaagagaaagcgagtgcttgtagagattctggaatatttaaagaactaaaatccggtttctcttctggattctccagcgatgttgtgaccaagttttctgcatcacctgaattgaacaagtatggtcttgaacacaaaaatcttgtgtttgatgaagggtcacgaattgagaaatgttcctcatccagctatttgcctattagtacaggatgtgaagaagcccaaaatagtttttctagatttcacctggagccatctttagtgaagcacaaaaataatcaaatttctgagggaagtacacggaaagaacatgagaatgagggacaatgttctgaaatgtcaaagaaaacacgaacattgaggtgctgtgcaaacaaatcagaatccgatgattgtactaggaaaattgatctgtcatcccgggaaggggattctcaaccgcagcataaggctggtccattttcacgcagagtatcaaaaaccaagaggaaacatcctcccacgcatctgaataaacatgtgaaacggcttcacagcaactgcaaagttctcaatgttgacaatgaacggtcagatgatgagggcatttatgttggagaatcaaattcctctgatagaaaaaagcaagaagataatatgaccactttggatagaacaaaatgccaacagcaagggagtcgattgcttgtccgcaaactgccaaaatatgtgtctctgaattgcattgtaaatgaaactaacagtgaagatgcctgtagtgggagtgccagtattgattctagtttgattgctacaggaataactaatgataatcggaaatctcccaaaattgttccactcaatctgattcttaaaaaggctaagagatgtcatgctatcaaacccctcagtaagacagaaaatatccatttttctgaggaaaagagttcagatggttctgcagataaatcttcctctggtgacagaagtttcagtccacaagatgaactgtggtctcccaaaaagaataggtattcatctaatgtctcgaggccacacgtcaagactgactgccaaagtccctgctgtgtacttgaagaagatgagcctcttagccttgcagatatggggacaagtcagctgtcagcatcaagaagtagaggaagtaagaatcaaagagcatgcatatctcttaataggatggagaggtgtgaagaatttacaaatgaatcagcatgcagtccttgtggcgataaacacgctgcggttcaagcctgtgtaacaaaatttgaaagatatatacaaaggcctagtttagatgcttcatgttgtgtttgtggtatctcaaacctggagccttccaatcagttgatagagtgcagcaagtgctttatcaaggtgcaccaagcttgctatggtgttctaaaagttccaagaggacaatggttctgtaagccctgcaagatcaatacccaggacacagtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgaatgctcaatgtgtaacagaactgggggctcatttatggggtgtcgtgatgttaattgctcagttctctttcatccttggtgtgctcatcagaggggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacagaaggaatatgtccactacaagcagttaaagggatggaagcatttggtagtgtacaaatctagcattcatgggcttggtctctacacatcggagtttattccacgtggctctatggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaaccaaactgtgtcgcaaaaataatctcagtaaggaacgagaagaaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactc

SEQ ID NO: 151 - DNA, 3759 bp, Oryza sativa
aaccccaaattccgctcccctctcttcccgcgttcccctctccctccccctcccccctctccggcgatgagctcaggcggacgcggcggcaagcggcgaggggcgccgcccccggggccatccggggcggcggcgaagcgggcccaccccggtggcaccccgcagccgcctccgcccgccgcgacggcggcggcgcccgtggcggaggaggaggacatgatggacgaggacgtcttcctcgacgagaccatcctggcggaggacgaggaggcgttgctgctgctcgaccgggacgaggccctcgcctcacgcctctcccgctggaggcgccccgcgctccccgccgacctagcgtccggctgctcgcgcaatgttgcttttcagcagctggagatagattatgttattggtgagagccacaaagtactgctccccaactcatctggtcctgcagctatactcaggatatttggcgtaactagagaaggtcacagtgtatgctgccaagtgcatggatttgagccatatttctacatcagttgtccaatggggatgggccctgatgatatttcacgcttccaccaaacactagaggggaggatgaaggattcaaataggaacagcaacgtgccaaggtttgtgaagagaatcgaacttgtgcagaagcagacaatcatgcattaccaaccacagcaatctcagcctttcctcaagatagtggttgctttgccaacaatggttgctagttgtcgcggcatcctggaaaggggcataacaattgaaggccttggttcgaagagttttctgacatatgaaagcaacattctttttgcacttcgcttcatgattgactgcaatattgttggtggtaattggattgaagttcctgccggaaagtatatgaaggcagctcgtatcatgtcctattgtcagctagagttggattgcctatattcggatttggtaagccatgctgctgaaggagaacattctaagatggctccatttcgcatattaagttttgatattgaatgtgccggtcgcaaaggtcacttcccagaaccaactcatgatcccgttattcagatagctaacttggtcacccttcaaggagaaggacaaccttttgtacgcaatgttatgacgcttaaatcatgttctcccattgttggagttgatgttatgtcatttgacacagagagggatgttctacttgcttggagggatttcatacgtgaagtggaccctgatattattattggatacaatatctgcaaatttgacttaccctatcttattgagagagctgaagttcttaagatagtagagtttccaatacttggacgaatcagaaatagtcgtgttcgtgtccgtgacacaactttctcttcaaggcaatatggtatgcgtgaaagtaaagatgtagcagtggaaggaagagtacaatttgatcttctgcaggctatgcaacgggattacaagcttagttcttattcattaaactctgtatctgcacatttcctcggggagcaaaaagaggatgttcatcactcaattatatctgatcttcaaaatgggaattcagagacacgaagacggcttgcggtttattgtttgaaggatgcctatcttccacaacgactgctagataagttgatgtatatctacaactatgtggaaatggcaagagtcactggagttcccatttcatttcttctttcaaggggacagagcattaaggtcctctcacagctactcaggaaagcaaaacagaaaaaccttgttataccaaatataaagggtcaagcgtctggacaggatacctttgaaggtgcaactgttttggaggcaagggctggattttatgagaaacccattgcgactttggactttgcttcgttgtatccatccatcatgatggcatataacctatgctactgtactttggtcccccctgaggatgcccgcaaactcaacctgcctccagaaagtgtcaacaaaaccccatctggtgaaacatttgtgaaaccagatgtgcaaaagggtatacttcctgaaatccttgaagaattgttggctgctcggaaaagggcgaaagcagatttgaaggaagcaaaggatccatttgaaagggccgttcttgatggtcgtcagcttgccctaaaaataagcgcaaactctgtctatggttttactggagcgactgttggtcaattaccttgtttagaaatttcttcaagtgtgaccagctatggtcgacagatgattgaacatacaaaaaagcttgttgaagataaattcacgacacttggaggctatgagcacaatgcagaggtcatctatggagatactgattctgtaatggtacagttcggtgtttctactgttgaggacgcaatgaagctaggaagagaagctgcagactacattagtggaacatttattaagcccatcaagcttgagtttgagaagatctatttcccttatctactgattagcaagaagagatatgctggtttgtactggacaaatcctgagaaatttgacaaaatggacacgaaaggtattgaaacagtgagaagggacaactgtttattagtaaagaacctggttactgagtgccttcataaaatactagtggacagagatgttcctggtgcagttcaatatgtcaagaacaccatttctgatctactaatgaaccgtgtagacttatctcttctagttataacaaagggtttgactaaaacaggagaggattatgctgtcaaagctgcccatgtggagcttgctgagagaatgcgaaagagggacgctgctactgctcctactgttggtgaccgggttccttatgttataatcaaagcagcaaaaggggcaaaggcatatgagaggtcagaagatcctatttatgttttggataataacataccaatagatccccaatactaccttgagaaccaaatcagcaaaccacttttgaggatctttgagccgattctgaagaatgccagtagagagctgcttcatggaagtcacaccagggctgtttcaatctcaactccttcaaatagtggaataatgaaatttgcaaagaaacaattgacatgcctcggatgcaaagcagttataagtggttccaatcaaacgctttgctttcattgcaagggaagagaagcagagttatactgcaaaactgtaggaaacgtttctgagctggagatgctctttgggaggctctggacgcagtgccaggagtgccaaggctcccttcatcaggacgttctctgcacaagccgggattgtcctattttctaccgccgaagaaaggcgcagaaggatatggctgaagctagagtacagcttcaacgttgggacttctgagtcctctcatactgacggagtactactttccccaaatattgcgaaaccattactgtgaggcacgccattgcgggatcatgtgattgcatcttcatgcatgatggctctggcttgtttagttggatcggctgaaatagctttgttctacggtcagtttgttgtatttttaggtggtaggttatctgtacctctagccgctaacagggtaatctagttgcttcccttggtgcattgatgcagccatgtgtaaggtagataaacaattttttttcatcatcttttaacttcatgaggtgattgaggctgagaagcacccattcaagaaatcccaccatgtgaatctttttaacttctaggctattttcacataatgta

SEQ ID NO: 152 - DNA, 2473 bp, Sorghum bicolor
cagcagagcagccagcacccagcaggtagcgcaagaagataaatatacacttcgatcttatccttccagaaactaaaagcttggccatggctatggctaaaaagggagcaagcagccttctcctactcagcctctcctcctacctcctctgtgttgcccatgccgccacctcgcttagcttcagctacaacttctccgacgccggcgtcctaaccggcgccgacctcacgtacatgtccaacgccactgccgccagcgatcggatcgacctgaccaaggacacgacctggagcaccggccgggtggcgtacgggcagcccgtgccgctgtgggacaacagcagcaccggcaattccatggtcgccagcttcacctccaacttcaccttcgccatcacgccacacaacagcactttcggccagggcgacggcatggcgttcttcgtggcgccgtacccgccgtctctgccgcaggactccaacggcggcttcctggggctcttcaacaaccccaacaacacggccaacgcctacttcccgccgaccgtcgccgtggagttcgacgcgttcaggaacacctgggacccggagagcaccgtgaaccacgtcggcgtcgacgtcaacagcatcgtctccgccgcgtacgcggcgctgccggacgcgagcttcaacgggaccatgtcggcgtgggtcaggtacgacgccagcgcgagcacgctctcggcgacgctgcggttcgaccacctgccggagctcggcctctacaacgtcagcgccaccgtcgacttcaaggaagccgggctgccgcagcaagcggcggtcgggttctccggagccaccggagatttcgtcgagcggcatcagatcctttcgtggtcgttcgagtccgctctcgtcagcgtcgccgccggtgacaacacgaccggaaccaaaacatcaaacataggcctaatagccggactggcatgtactgggatcttcatactactcattgtagcagcgtggctcagctacaacaaatacctgaaacaaaggggcgccaaacaaacacaagaaccacctcaaaacacagagactcccctccacctcgatggagaaatggacgacgagttcgagatgggggccgggcctcggagattcacctacaaccagctgtcacaggcgacgcgaggtttctccgacgaggagaagctcggcgagggtggcttcggatcagtctaccgtgggtacctgcaggatcaaggtctccatgtggccatcaagaaggtctccaagacgtcgaagcaggggaggcgagagtacgtctccgaggtcaccatcataagccgcctcaggcaccgtaacctcgtgcagctcgtcgggtggtgccatgacgccgacgagctcctgctcgtctacgagctcatgagcaatggcagccttgacaagcatctctatagcacagacaacattcttacatggcaagtcaggtacgacattatccttggcatggggtctgcgctcctgtaccttcaccaggaatgggagcagtgcgtggtgcacagggacatgaagccgagcaacgtgatgctggactcgtcgttcaacgccaagctaggggacttcggcctggcgcgcctcgtcaaccacagccgcgccgcgcacaccacctggctcgccggcaccatgggctacatggacccagagtgcgtggtcaccagccgcgccagcgtccagtccgacgtctacagcttcggcgtcgtcctcctcgaggtcgcctgcggcaggaagcccgtcgtactggaggaggaagacgagagcagagtgctgctcgtgcagtgggtctgggatctgtacgggaggggcgagctcctcgacgcggcggacccccggctgaacgacggcggcggcggcggtgggttccagccgctggagatggagcgggtgctatgcgtggggctgtggtgcgtgcatccggactacgcgtcccgggcatcgatccggcaggccatgagcgtgctccagttcgaggcgccattgccggagctcccgctggagatgccggtggcgacgtatgggccgcctgttgccaggggtcacaattggtcaagcaccacgtcgtcgtccgcaagtgccaacaccggaggccactcgtcgactagtgaccggacggcggaacactcgttaggctcgtcggacaagagcagcacccatggccttttgtcacttccaagttccaacacgaggagtgcgacgaaataaggagtttttcggtgtatgatactgtgagaagagaaatatgtaaattgcgtatggaacagggttgatcctggacactgaatgcctgacctgtaaagttctaggatgttgcctatagcaagttcgcctaatttagtgactgaaactggtatggccaattggaggatactatttcatcgatggcctttagagtttacaccgagacttgtcctaaattaaccctatcggtttccttg

SEQ ID NO: 153 - DNA, 971 bp, Sorghum bicolor
acgcgagaaaaaaaaaaaaatccaccgatctcgctgaaacaagaaggaatccaatcgagagcaaatgctgtcttccaccacactccggtcgctggttccggctgcggtggcgtcgccgtcgccggcgcacgtcaccgcctgctcatctcccgcggtggggcggcgtgtgccggcggcggtggtggtgcgcgcggtgcggaactacgactccatcccgaagcgggagcccttcagctccagccgcagcatcctcgacgagttcctcaggcaggacaagcccctcgtccagcgcaccaaggaccagatcacagattattgcacgaccactgaaggtgatgaatgttgcagctgttgggatgcttactttgaactgaataaacttgagcaagagctgcccaaagaggaaatctcaaggatggttaaggactcagagggtgacgtgaggtacctgattgagagcatccatcatcgctcaaatttacggaagaagatggcagagaaatctcgtaatttagtaccatcaacctcccaggggcaaactgcaaagccaaggccattccctgtgcctgatgggataccgaaaacacaggaagagcttgctgaagaagaggaggcgttgatgccagagtctccatacacaaggttgctgagaaggatgggtagataccctgattggtacaccccacgccctgatcatgagactgactgaatcaaatcatcccccatccaggtgccccttttggaagttttgcagcatgataatctgaagctctttttatggcctgtggtaagattagcgttgcacctatgcagattaggctgtacttttctacttactaatgaaaatggtgtggttttattatgctgtatgtaaatagctggaacgttcggaatatcttttattggatgttctgtatactgatgcatctctgtatatgtcactggtttttattaaagtttttggttattat

SEQ ID NO: 154 - DNA, 1863 bp, Sorghum bicolor
ctgccgagcgccgggccctggactcacataccacttcgcacttccgcagacggaccacgggcgggggggggctgggctgctgctcctttggcttggaaccaggctaccagccgaggggagagcgagacgagagcgtccctgtcctcctccagcaggcctccaccctccccgtccccgagctcgtcgtcgccacaccaggcgaggccgcggggcttcgctactcggagagggagggcggaatggggccgtcgtccattcaggagatggaggaggcccgaaggaccgcagtgcagagctgccaccgggtgctggcgctcctctccaacccgcacggccagctcgtccccagcaaggacctcatggctgccaccggggaggccgtcgccaagttcggctccctgacggccaagctcaccaactccaactccaactccaacggcaatggcctgcagctgcagggccacgctagggtcaggaagatcaagaagcccctgcccatcttcgacagcaacctcttcctcgagagctctgcggtggccgccgccgccgccgccactgtggccaagacgcccagcccgagcccgatcactggcctccagctgttcccgaggtaccaccagatggagggctcgtcgtctaaggatcctgtcaggatccctacccagttccccaagaggttactgctagagaacccggctgccggtctggaggggctgccgtccaaggcccctccggtccagatggtccagccggtgtcggttgcgcctcctgcagggacgcctaccccggcattgcccgctgctcaccttcatttcctccagcagaaccagagctaccagaggtttcagctcatgcatcagatgaagattcagaacgagatgatgaagaggagcaatcttggtgatcagggtggtagcttaagcggtggtggtggtggtaagggtgtgaatctcaagtttgatagctcgaattgcacagcgtcatcgtctcgctccttcctttcgtctctgagcatggaagggactcttgcgagtttggatggaagccgggccagcaggccattccagctagttagtggctctcagacatctagcacaccggagatgggcctggtgcataggaaaaggtgcgctggtagggaggatgggggtggtcggtgcactaccgggagccggtgccattgttcaaagaaaaggaagcttaggataaggaggtccatcaaggtccctgcaataagcaacaaggttgcagacatcccagctgatgagttctcgtggaggaagtatgggcagaagccaattaagggatccccacatcctaggggttattacaagtgtagcagcgtgagagggtgccccgcgaggaagcatgtcgagaggtgcgtggacgacccctcgatgctgattgttacctatgaaggtgaccacaaccacaaccgagttctagcccaaccagcctgatctttcaggctatcaattcaagatcgcttctatagtcaccctccttcccctagaggaagggaggacaacaacaacaagaagaagagcctagtgtctgtacatattttctgcttctaacagttggggggagagagagtcagttagctagctctttcagaagaatcaaatcaatggtgacagaaggaaacttatcgcgtcgatggagaaagggagagtgcctcatcaaatcaaatactctagttttgtagtttcgatttctcttttgtgttcatcatcctgtgttagggccccatcctgtggttgcagtgtagtaacattgagctgcagttgtatgtctgagaaatggtgttagggggattggatcggagaagaaggcataaggcaggaaagtgcctgtaaaagt

SEQ ID NO: 155 - DNA, 1898 bp, Sorghum bicolor
acaaccacgccgcccaaaccgacaccgtctccagcgccggccgccgctacactctcatctgacccatggacgcgacgcaactgaaccggccaatggacgcgacgcgactcttccttggcgcgctcctcctcctcctccccgccgcgctcctcctcctgctccgcgcgcggggcaggcgccgcctcccaccgggcccgccgtcgctgccgctgctcggcagcgtggtgtggctcaccaactcgcccaccgagatcgagcccctgctgcggcgcctcttcgagcggtacggccccgtcgtggcgctccgcatcggggcgcgcctcttcgtcttcgtcgccgaccgccgcatcgcgcacgaggcgctcgtcgaccgcggcgcggcgctggcggaccgcccggcgctcgcgtcggtcaggctcctcggcgagaacgaaaacagcatcacccgcgccagctacgggcccgtgtggcgcctccttcgccgcaacctcgtcgccgagacgctgcacccgtcgcgggtgaagctcttcacgccggcgcgcgcgtgggtgcgacgcgtgctcgtcgagaagctcggcgagcccgggcccgacgccgcgccgccccgcgtcgtggagacgttccagtacgccatgttctgcctcctcgtgctcatgtgcttcggcgagcgcctcgacgagcccgccgtgcgcgccatcgcttctgcgcagcgggagggactcatctaccgctccaagaacatgcaagtcttctccttcttgccggccgtcaccaagcacctcttccgcgctcggctcgataaagcacgggagctgcggcggcgcgtcaaggagctcttcgttccgctcatcaacgcgcgccgggagtacaagaagcggggaggcgagccgaaaggggaaaccacgttcgagcactcgtacctggacacgctgctcgacatcaagcttcacgaggacggcgatcgcccgctcaccgacgatgagatttgcatcctatgttccgagttcctcgacgccggtacggacaccacgtccacagggctgcagtggatcatggcagagcttgtcaaaaacccagccatccaggagaagctctacaacgaggtaaaggctgccgccgacaacgacaaggaaggggtctcagaggaggacgtccacaagatgccatacctcaaggcggtgatcctcgaggccctccggaagcacccgccggcccacttcgtgctgccgcacaaggcggcggaggacatggaaatcggcgggtacctgatccccaagggcacgacggtgaacttcatggtggccgagatgagccgggacgagcaggaatggaagaacccgatggagttctctccggagaggttccttcccggcggcgacggcgagggcgtggacgtgacgggcaccaaggcgatcaggatgatgccgttcggcgtgggccggaggatctgcgccgggcttggcatcgccatgctgcacctggagtacttcgttgccaacatggtgctagagtacgagtggaaggaggtgcccggcaatgaggtggacttcgccgagaagaacgagttcactgtcgtcatgaagaagccgctacgcccacgccttgtccctaggaggtctcacttgaactagaactattttactgttctattgtatggtttcttgtattgtgatgaaactgttttactgttctattgtatggtttcttgttatgtgatgtatataaacatcagtgtactattcataactggcaaaaattctggttcttcaataattattcggcagagaatgtaaccttcattggatagtttcgtcttcgtgttgaccgtggatggcttgtggatatggaaaatgattatcaaaactatgccaattataaacagcacagctgctcttctg

SEQ ID NO: 156 - DNA, 4156 bp, Sorghum bicolor
gtacctgtaccccccattcatacgcgcgtggccggtaggcaaggctgtacaaccagtaaccactttcttcttctcttccagaagcgcaggggcaccatccctcccaccaggccaccagtgcgtgcgccgtcgacttcttcgcaccttctccgctcgtcgagaacgactccacagcgcaccagcgcggcgacagccagcacgcgaagagaacaaaaaagtagaagaagaggaggagcaggggagagcgattggattcggtccaatccagccggcgcgccggccgcctcgtcgctcccgcgcgcggccgcggcgcgaccaccagccgatcccgagggcgccggccgagtcgatctgcggggggcgcgcgggcccatgaggagggccgccgccggggatcacggtcgccgcgggggatgtgtatgaggagggcgtccggcccgcgaatcttctggattggccggagcccagggggcgcgcaccccggatcggcggcgcgcggcgcgggccgatcgcgtcggtggggctgcggcagtgaccgcgggcgggacgcgggggagtgagaagcggcaagtagcatttcgaggcgagcgagcgagcgggcgggcgcgatggtgagcggccacatcttccactgccggaagaactcgtggccggcggaggagtacgtcggccggaccgcgctgcagctgttggatttcgatggcggggcgccgccggagcaggcgtggcggaggcggctcaacagccacgctaacattctcaaggagttcagtgtcaccttcatggaggcaatgaggatgatgagccttggcctgagactctggtcgtatgttcgggaggaggcgtcacatggacggaaagctccgatcgatccattcacaaaagagcgctgtaaaccgtcagcttctcagggtgtgccacttggtgggatggggagcggtagcatttctagaggtttcaggggagagtttaagaattggcacatcatacctggtctgtgtgagagttcgccggtcatggagaaccagttctctatatttgtatctcgagatggggggaataagaaatactcatcagttttggctcctggacatcatgaaggtctgaagaaaaatagtgactctggaatttcttcatgggactggaatttgagtggtcaacactcgacctatcatgcattgttccctcgggcatggactgtttatgatggtgaaccagatccagaccttaaaatctcatgtcgtcaaatatcacctttcattcctcatgattacaaggatagcagccttccaacatctgtgtttgtgtatactctagtaaacactgggagagaccgtgcaaaagtaagcctgttaatgacatgggcgaattctattggaggtttttcacataattcaggaggccactacaatgagcccttcattgcggaagatggagtatcaggagtgcttctgcatcacaaaacagctaaggataatccaccagtcacttttgctgttgctgcctgcgaaactcagaatgtgaatgtgacagtcttgccagtgtttggcctttctggagaaaaccatgtttctgcaaaggaaatgtggaacaccatgcaacagaatggtcacttcgatcgggaaaatttcagtgctggttctagtatgccttcttctccaggacagaaactctgtgcagccgtctcagcctcaacttgggtagagccacatggtagatgtactgttgtgtttgctctggcttggtcctcacctaaagtaaagtttcaaaagggatgcacatataacaggaggtacacccaattctatggaacttctgagaaatcggctgttaatctggtacatgatgccttaacaaaatataaactttgggaagaagaaatcgagaagtggcaaaaccccatactcaaggatgaaagacttccagaatggtataagttcactctttttaatgagctttactttctggtagctggggggaccgtttggacagatggtcaacccccagcaatcgatgagaaaaacagtcctggttctattcagcagaagtcctcaaagaggggcactaaagacactaaacagggatctgttaaagataaccatgtcaacctgacagtggagcaagtacctcatggtggtcaaatgactaatagtgatgatcacagtgtatcaaagttcgcagcagttcatgggtcacaaatgcaagaacaagtcaatggactcaagtcagaagagccaattccttacttgatctcaaaggatggccctgaacatgttggcaagtttttgtatctagaaggagtggaatacatcatgtggaacacatatgatgtgcatttctatgcatcatttgctctccttgatttgttcccaaaaatagagttgagtatccaacgtgattttgccaatgctgtgctgtatgaagatcgacgcaaagtaaaatttttggctgatggcacatcaggaatccgcaaggttaaaggtgctgtgcctcatgaccttggaacgcatgatccgtggcatgaaatgaatgcatataacatacacgatacaagcaaatggaaagatttgaaccccaaatttgtgctccagatatacagagacttcgctgctacaggtgatatgcaattcggtcgagatgtttggcctgcagtctgtgctgctatggactatatggatcaatttgaccgtgatggtgatggtctcattgagaatgatggatttcctgatcaaacctatgatgcttggactgttcacggaatcagtgcttactgtggttgcctatggcttgctgcacttcaagctgcagctacaatggctcatcgtcttggggatcggcactttgctgaaaagtacaagctcaagttcataaaagccaaagcagtatatgaggcaaagttatggaatgggtcatatttcaattacgacagcggcacaagtagcaacagtagatccattcaagctgatcagctggcaggacagtggtatactgcctcgtcaggcttgcccccgctttttgacgagcacaagataagaactgctctgcagaaaatatttgaattcaatgtgatgaaggttaaaggaggacggatgggagctgtaaatggtatgactccaaagggaaaggtggacgagacatgcatgcaatctcgtgaaatctggactggtgttacatatgctgttgctgcaaatatgctgctccatggaatggagcatcaaggctttacaaccgcagaaggaatttttattgccggatggtcagaagaaggatatgggtattggttccaaacaccagaaggatggaccacagatgggcattatagatccctcgtatacatgcggcctcttgccatttgggcaatccaatatgcagtttctcctccaaaggctattcttgaggccccaaaagttaacctgatggaccgaatacatatatctcctcacatggcccgagcaattagcgagataagcattagaaagatagcacctgacaacagatgtttccctagctctgcctttcattgtgaatgctgatccaaaggtaacatgcagctgctgagcaacttaccaatctattcggcttttcggtttctccttgccctttacaaggtccagtgtgattcaggagttcttttcttgaatcagagggcatacccaaaccaccacaaaacgggactcaaaagagttcatgttgtataattgtacagcaaactgttaatcacataatctttgtttttttttccttcactctaagttttgtgctgccaaggtacattttcacatgaagagagctagaaatcaaagaactggcaatctggtgtctcatacaccatcacttcagaaaatcttcctactgctccgttttggatctggatctaacgttttatgaagtcatttgggtatggatcaattctatatttctgttggctgagtatacggtcggcacgtcaatgtatcattgttcactataggatcatggattgttgcttttcctaaaaggtagtgttgctatttctgctagtctagagcctcatctaatcattttaggttctctcatttcttcgttctttaaaaagcaaccgaactcaaacatatggttggttctgaaagtcgtttgttatgttaatatgatatttgatttccgtatctttgccagc

SEQ ID NO: 157 - DNA, 1840 bp, Sorghum bicolor
aggaccgaattctaaattcgtaaaatcacgcgccttcttcagtgttagttctccacctcctccttggcggaaaaccctaacccctctcagcctcctctcgccgccgatccgacccaaattccgaacccctccggtcctctcccatctcccggcgtccccaccgcgctctccgccatgccggacgtgcagccgctcgtcagcgacttcgtcctcaagctcaagcgccggaaggtggaggggtcgcatgcggttgcccggcagacggcggagctgctacggtcggttgtgtcgcagcatcggatggttagcagcgccaaccaggctgccgcgcttgccgatgccgtacgcgctgtgggggagcagctcatcgccgccaatcccgttgagcttgctgttggaaacatcgtgagacgtgttttgcatataataaaggaggaggatatatcttccacagcagttggtatcgaaggtctttctgttactgttgacagtgatgatgaatatgacagtgaacatgatgatcgccctgcattatctgctgctgttcttgctgcacatgctagaaatgccctccgtgcaccttcattgcagactctgctagaagacattcctgtgagtcctgcagtttcccgcactgcatcatcaactggtgactcagacggaaaaagtaaatcagctggagataagagctcgactaggaaactgaagcatgatgtcatcgcagccattggtgatcttattgatgagattgactcatgctatgagccgatttctgagcaagctgtggaacttattcaccaaaatgaggtaatcctaactctaggtcgttctagaaccgtcaaggagttcctgtatgctgcgaaagagaagaagcgatcttttcgtgtatttgttgctgaaggtgctccaagatatcagggccatgttcttgcaaaagagctggttgagaaaggtgtacaaactacagttataacagattcagcagtttttgctatgatctctcgagttaacatggtcatagttggagcgcatgctatcatggcaaatggtggagtcattgcaccagtagggatgaacatggttgcacttgctgctcaaaggcatgctgtgccttttgttgtggttgctggtagtcacaagctgtgtccattgtatccacacaacccagaagtgttactgaatgaactcaaatcgccgtctgatttgctcgattttggcgagttctcagattgcatgaatttcagtactcaggatggcagccccttgctaaatgttgtcaacccaacatttgactatgtgccaccgaagcttgtgagcctattcatcactgacactgggggccacagtccatcttatatgtatcggctaattgctgagtattactcagctgatgatctggtagtgagacggaaggcaacatcttgaaagaagacaaaaagcactgcagagtccccttggtgctctgatgagcgatgttgctgtcttcagtggattcacctactgtcaaactgcaggaaatcagtgcaagcattctcgcgcattctttgtaagcattgcggcattttgagtgtaaactgttgaggaaatggggcgtgacgtcatggaaaggattgttttactataggagtggttcaaatatatggttgactggttgtgtagagggtggctgtttcttatctggccataggttaatctgtgccttggctggtcgaaattttgtctgttataaattccagcaagctgtttgatatgtgtacgaagtattagcatgcacactgatggaatttgctgagccatttttctttctatatactggtgtatatgctattgctcatttcag

SEQ ID NO: 158 - DNA, 1238 bp, Sorghum bicolor
attcagattgcgactggagcacgagggacactgacatagactgaaggagtagaaaaccgcagctctcaacctcaagcgacatcgcagcagtacgcacgccgtgcccgtgcaggcctctcctccactcactgcacatctctccagctctccactcgatcgaccaccgcgcgtcatggccttgttgcgcgagcacctcgacctcatccgcgcccacctcctcgacgaccaccacgtcgccgtgaccgtgagctccgatgactcggcgtcgttgcagtcgtcatcgccatcgccatcgcaatcgccgccggggcgtagtaggccgctgccagcgctttccgtctcgctgcccccgaggccaccggcggtagacctgcagcagcagcacctgtgggcgccggcgccgccgccgatgcagattcatcggcaggagctgcagcactactgctacccaccggaacccgaggaggaggaggacgatttccggcggtaccgcggcgtgcggcagcggccgtggggcaagtacgcggccgagatccgggaccccgcgcggaagggcgcgcgcgtgtggctgggcacctacgacaccgccgtggaggccgcgcgcgcctacgaccgcgccgcgttccgcctgcgcgggtccaaggccatcctcaacttccccaacgaggtcgcgttcggcgccgccgcacggtgggcggcggcgcctgctgccgctcctcagcccagcgtgaccgtggccgggaacaagaggggccgggcgaggtcgccgcaggagcaggacgccgggtgcttattggtcagggaggtgaagaaggagcgggttcaggagcccgcagcggcggcagcgggttgtggctgggatggcaaggatacggcggcaagcggcggaggggcggactacttctgggaggacgagtcgctgaagggggcgatctgcagcctgccgccgctctcaccgttgtcgccgcacccgcacctggccgtcccgcagctctccgtcagctgagacctgagatgtggcagcaagacagcggacggtggtcgcttaattaactgattagttagtcttagtcttaatctattttttgagttctttgattatgctagagaggagtgtacaggtccaaatgttctttcgttctttaattaggccttggacacacaagcaaggaaacgtgccctggcgtagcaagaggatgctataagaatgtcagactggacaatttaaacatagcata

SEQ ID NO: 159 - DNA, 1268 bp, Sorghum bicolor
ctgctctgcagtctactcccaattcccaaaccagaattattggacggtgcatgccatgacacccctcgactgcgacatgcctcctgcagcttcctgcaagaagcgcctctcgccgtcgcggcctctccctaaccgctgcttgctgatcttgatcgttgcactggcggccgccgccgcggtggccagcgcgcagctgtcgtcggaggactactacgacgcctcctgccccgccgccctcttcaccatccggaccgccgtctcgacggccgtgctcctggaccgccgcatgggggcctcccttctccgcctccacttccacgactgcttcgtgcagggttgtgacgcgtcggtgctgctagacgacacggcgagcttcaccggcgagaagggggcggggccgaacgcggggtcgcttcgcggcttcgacgtgatcgacaacatcaagatgctgctggagctgctgtgcccgcagaccgtctcctgcgccgacatccttgccgtcgccgcccgcgactccgttgcacaactgggaggaccatcgtggtcggttcccttgggcaggagggacgccaccacggcgagcgcgtccctggccaacagcgacctgcccggacctaccagcaacctcaacggccttctcaacgctttctccaacaagggtttgagcagcaccgacatggttgccctctcaggtgcccacaccgtcggccgggcgcagtgcaagaacatccggtcgcggatctacaacgacaccgacattgacgccacctacgcggcgtcgctgcgggcaagctgccccgcgcaggccggcggcgccagcgacggcgcgctcgagccgctcgacgacgccacgccggacgccttcgacaacgcctacttcggcaacctgctctcccagcgcggcctgctccactccgaccaggcgctcttcggcggcggcggcgcgacggacggcctggtcagcacctacgcgtccagcgccgaccagtgggggagcgacttcgccgcggccatggtcaagatgggcaacattagcccgctcaccggcaccgacggcgagatcagggtcaactgccggagagtgaattaattagctagctcacaaacacattgcattgattgcatcgtctgtgtgtatattttgcaaagaggcagagaagaattgaagtggaggtctaagctcatatgtatacaactattgtatactattcaatattatttcgtgcaaatatatacgaagtgacttgatattgttggaaatggtttaa

SEQ ID NO: 160 - DNA, 3487 bp, Sorghum bicolor
cggcctcttcgtcgggcggtgttccttcccttaccctcccctgctccatcgcaagctcctggttacggcggcaaccatccttctgccgcatcgtcctccctctcgcgacgctgcccaaggtccatcgcgcctagggttcgcccagtccggcggcgcccagacaatggctggtcaccgaaacagtcatggaaagcgccactctgattatactgaaaatggaggcggtaagagaagaaatcctggtgatgatacctatgcccctggtcctgatgacactgtgtatcgctacctctgcgcctctagaaaaattgggagtatcattggcaggggtggagaaattgcaaagcagttgaggactgagacccaagctaagatcaggattggcgagagcgtccctggatgtgatgagcgagttattaccatatttagctcaagcaggaaaactaataccatcgatgatgctgaagataaggtttgcccagcacaggatgccctctttagagttcatgagaggcttgccactgatgagagtattgggaacgaagacagcgaagaaatttcacctcaagttactgttcgcttgcttgtgccatcagaccagattggatgcattcttggaaaaggtgggcacatcatccaaggaatccgcagtgagactggtgcacaaatacgcgtgcttagtaatgatcatatccctgcatgtgccattagtggcgatgaacttctccagatatctggagacacggtagttgtcagaaaggctcttcatcaagtgtcatctcgcctccatgacaacccatccaagtcacagcatcatcttgcatccagcttgacccaaccttatccagggagcaccacccaccttggtggttcctctactgcacctgttgtagggatcactccagtaattcctccttatggaggctacaaaggtgatgcggcaggagattggtcctctttataccaaccacgaagggatgagagctctgcaaaggagtttagcttgcgtttactttgtgctgctgcaaatgtggggggtgtaattgggaagggtggtggaattatcaaacagattaggcaggaatctggggctttaatcaaagtggctagctccaattcggaccctgatgatgactgcataattacagtttctgcgaaagagttctttgaagatcctgtatctccaacgattgatgctgcagttcgtttgcagcctagatgcagcgagaaaagtgattcagaatcagccgagcagtcatatacaacacgcttgctggtgtcaacatcacgtattggatgcctaattggcaaaggtggttcaatcattactgagatacgaagaacatccagagcaaatatacgcattctttcaaaagaaaatgttccaaaggtagcagcagaagatgaagagatggttcagatcagtggaggccttgatgttgcaagacatgctcttgtgcaaatagctacaaggctgaaagccaatttctttgaaagagagggctctttatctgcatttccatctgtgatcccttaccatcctttgccttctggtgcttcggatgaaccaaaatatctaagcagagacactaagcctgttgggcattatctatattcaagtgcttttcgtacatcagatgacatgattccttctgacagctatgcaagttatggtggctcccaggcacttggaggaggatatggggcttacagcggatacagtgctcgctcctctggtagtgggttatctggtcatagttctcttcactatggaaagcgtcatggttattaggatttagattgcttgataaagcagctctgctatctgatggacctgttcttttcacctttgtcccccccccttctcccctcccgtactaaaaacagccaagacattgaagtttggagcctgcttattggtgccccttcccaaaccagatgaccaagagagcccatcctggaagctttgattaagaggacctatgtggatgccatagaccacctgatattcctcacactacattactcatgtcttcctctgggcctatgtttttagccctgccgtaaatgtttcgaacctatgtattgaaaggtcgcatttgagactgcatgtatttgcttgtttgaaacctgctccagtttagtggtttttgttcaaaatatttgtttcctatgtgccacccaaaaagccaggaatatgttactcgaagaaaaaacccatagggagctgttacttgcctttccacggaagatgtgggttacttccttctcagtgatatgtgtggctgccatcctaaataaaagtaacactagaaccacattgccattttgaaagtaccatcagaaactaggtataccaaactttgctcctgcctgccaatatttcactgaattgcacattttgctttattcacctaccccgccaccaaacacaatcagtttcaccccccttgcctcaatcttcagggcctgtttggaatccagacagctttgcctggctcttcatgcaatcccaggctttggattttgtgttcctggggtgtagattgttgcctggcaggctttgaaccaaacagactccaagatcattgttgaactgaggttagctagctgaacatacatctgtacttgttcgattacaatgccgttgcaacgcacaggcaagtttaaacataaacttcaaatcattttttttgaatgagaacattaagccaatttgaagttggcgttttaagcatgagctttctaatttaattggttatagatacatgtactttggtgtaagtagctaatatctgagactttaggtagcttgaactttttaactaagctagaagttttttttggtcgtatcgatttattatatcacaatggcccaaaatttgcgatagagcatgctcatgatcttactgaacgctttgacctgatgcacatgttccaatgctttaacgactaaatgagtattggtgactgaagttctgataatgtacttggcaatttgctatgatggggaaaccatatgccaaagactgaatcgtgtgcatgaggccacagccgcaagtgttttgcaggttcactgttcatttcatgtagatttagaaggttctaagttcaccgggcttgatatgagctttttgaccttcatgtctgggagtcttgttacccaggaatgtgcaggaacatgcaaaagtaagcatgcaggtattgtttctggacgaaaatgaattagcttctggagtcgcacaacattgttaacctcgtctaagtgtagttaataacgtcaaaatgttgttagcggaatgactgtactgtttgtttatttaatgttctgtcaagctgttttatgtaaatgctaactgtatcgggttttcaccagcaaatttattttagattatgtttttggcacaataagttccataagatttgattctgagatatcgcgaacactattctattgcaatatctggaacagtgctctttgttgctg

SEQ ID NO: 161 - DNA, 1946 bp, Sorghum bicolor
catcagagagaaacagaggggagctagcgaggatcacatatctcgtagcgtgtgggggctccggcagggagagtgaagcgaagcgaagataatggaggtggccatgactgtgactgtgacgaaggtggtgctgagcctgtgctgcgtgggggcgtgcggcctcgccgtgtacctctaccacatcctctggctcgtgccgcagagggtcctcgccaagttcaaggatcagaggatcggcgggccgcgcccgtcgttcccttacggcaacctcgccgacatgagggcggcggctgctgctgcgaaggctgcgcgcgcgtcggcatgccggagcggcggcggcggcggcggcggcatcgtgcacgactaccggccggccgtgctgccctactacgagaaatggaggaaagagtacggtcccatattcacttactccatggggaacgtcgtattccttcacgtgagccggcccgacgtggtccgggacatcaacctctgcgtgtcgctggaccttggcaagagctcctacctcaaggcaacgcacgagcccctcttcggcgggggcatcctcaagtccaacggcgaggactggctgcaccagaggaaaatcatcgccccggagttcttcctggacaaggtcaagggcatggtggatctgatggtcgattctgcgcaaccactgctgaagtcatgggaagagagagttgatagaaatggtgggatcacagacattaagatcgatgatgacattagggcttactctgcagatgtgatctctagaacatgctttggaagcagctacatcaaaggaaaggaaatctttatgaagatcagagaactccagcaggctgtgtccaagccaaatgtgctagctgaaatgactggcctaaggttctttccttcaatgaggaacaagcaggcatgggagcttcacaaacaagtccgcaaactaattcttgaaatcgtaaaggaaagtggagaagacaggaacttactgagtgcaattcttcacagcgcaagcaccagtagggtgggcattgccgaggcagagaactttatagtggataactgcaagagcatatattttgcaggacatgagagcacagctgttacagctgcttggtgtctaatgctccttggactgcacccagaatggcaggatcgagtacgagcagaggtgcatgaagtctgcggaggccagccagtagactcacggtcacttcagaagatgaaaaatttgacaatggtgatccaggaaacattgaggttgtacccagcaggtgcctttgtatcaaggcaggccctccaggaactgaagctcggtggcgtacatataccaaaaggtgtcaacatctacatccctgtctccacaatgcatcttgaccctgagctatggggccctgatgtgaaagagttcaacccggagcgcttctctgatgttcgaccccagctacattcatacttgccatttggtgctggggcccgaacctgcctagggcaaggatttgctatggctgagctcaagatcctcatctctcttattgtctccaagtttgttttgaaactctcaccacactaccagcattctccaacactgaaactcattgtggagccagagcttggtgtggacctcaccttaacaaaagtgcagagtttctacactaagaggggcactgcaattcaagcacgttaatattagtcatcatacaatgtgatggaaagaaacctgtgctatggtggatgcagcttcccctgaggagaggggacaatttgtacagagacaactcatactatctacacatgatattttccatgtgcatgatcataataagttaatagagaaatggtgccaaatgagccaatcatttatgtcaacattgtataggaaaactatacagctattaaatttagtgatgaaaagagatatatgttggaacgtcattaaggtg

SEQ ID NO: 162 - DNA, 3450 bp, Sorghum bicolor
cttttgtggacgacgccgtcgtcgccagccagctttcatgtggctgtgcgctgccccttccctccctccctctccgcacctccagaaaaatccattctttactccgagtatttagcctcgcctgttgccggtacatctcttcccgcggccgttgtttgcgtggaaccactcctccccaaatctctcctgtcagagttgatacgaaatttcttgttgttcggttttagatcgatttctttacggcgtattttggttgcatcgcggaccggctccggagccatccggtcctaagaccgtaccagcgaatttgtttggcttgaggtgcgggcgctgagcggtcctgtgccgtagattcaaaggcgcgggaaatctctggtcgctgggttgagttgaatcgatctggatccgtttatcgctagtttgggcgtccttgatctgaaaggtggaagctttggttgggttttctcctccagagcatttgcgtttctgaggggctaagatgctctatttgaagcagccgacgaggagctgagtctttctttttttaatcacaatttctctcgtcgtttgttgatctgatccgatggaggctatgacgggtggcaaattccttgaaaagtttcggctctacgaaaccagatcgaaattttatcttattggaagagacaagagcagaatacactggagggtgctaaaaattgatcggttggagtccactgagctgggtgtcgaggaggatccaactatttacacggaggatgaatgccaagaactgctttgccggattcatgtggggaacatgttgactggtggactgaaatttgtcacaaaatgttacggaatagttggttttgtaaagtttcttggtccttattacatggttataataaccaggagaaggaaaattggcacaatatgtggccatgaaatttactccgttggcaagagcgaaatgatcgcaattccaagtgttatagtctggcccaacgtggcttattctagggatgagaacaggtataagcgcctgctttgttcagttgatctttcgaaggatttcttcttcagctactcttacaacatcatgcgcagccttcagaagaacatatccgagaagaatactgggcaggttgtttatgaaacaatgtgtgtatggaatgaatttctgacgagagcaattcggaatcatctcaagaatacctgttggactgttgccttagtccatggattttttaaacagtcgaagctctctgtatctggcaaggatttttggttgacccttatagctaggcgctcgcgacattttgctggaaccagattcttgaaacgtggagttaatgaaaagggcagggtagccaatgatgttgagactgaacagattgtttttgaagacacatctgatggaatcccaactcagatagcttctgttgtacaacatagaggatcgatacctcttgtctggtttcaggagacttcaaggcttaatattagaccagatattatattaaaacctgatgtggactacaaggcgactcgccttcattttgagaaccttgcacttagatatgggaatccaataatcatcttgaacttaataaagacccgcgagaagaagccccgtgaatctctgctccgtgcagaatttgcaaaggctatccattacattaacaagagcctacctgatgacaagcgtctaaaatttttacacatggatctgagtaagctttctcgaaggaaaggaaccaatgtgcttgcactgttgaacaaggtggcatcagatgtgttggatctaactgaattcctccactgcgaaataagtacatcaacaaaacctgatgacacctcaagtggagaagaaactgttggcagaccacttgatgacagaagtagcagagatcaaactgaatgtgcagctaagttggcacctcttttattacagaagggtgtcctcaggacaaattgcatagactgcttggatcgcacaaatgttgcacaatttgcatatggtttagttgctttagggcgtcaacttcatgtattggggcttattgaagcacagaaaattgaattgcatgatcctctggctgatgatctgatggatttctatgaacggatgggtgatacattagctattcagtatggtggttctgctgctcacaacaagatcttctgtgagcaaaggggccaatggaaggcagcaacccaatctcaggagttccttcgaacccttcaacgctactacaataatgcctacactgatcacgagaagcaggatgctataaacatgttcttaggtcatttccaacctcagcaagggaaacctgcattgtggaagctggactcagatcagcattacaacattgggaggcaaggaactttaaaagaagagattggaagatcattcataaagaggtcgctatcagatggtaacatattgttggagaacagcttgcctataactaactgtaacaatgaaacaaacagcacagaattgctcccaatgcaacagctggatgatattagagaaccttctgattctgcgccagagatctccatatgcgaacctaacccgtgctccagtatgaactatggcacagtgcctggaagacactccatgtcagaagagcggcagagttatttgaaaagattaggttaccctgaattgcattcttcaaatttccttgaccttgatttgttgtcatcttcagggaattcgtgtgatgaggaagtttttgagaggtcatcactgatcaattcacctatggatgtgatcagtgttgaatcatctacgtcatacagtgaacaaggacacatagatgagggcagggatgacacagatctttcccgttctagcagccagctctcagacgttcgggactattctgatcgctttgcgcactgggtcgcaaatggaggcatgctttgctactaggccctgggttttgtcttggtgaccgaatttgtgacacagcaagaaatggatgtctagcggatagagcagacgaaaattgctgacggctagccggctaggtgcatctgcctgcagaggcggcgtagcggaagagattgtggacatgggagaagtctcgcatcggcatggctgtgatcacttgaaggcttgaacctgatattcgtcgaatggagattttggtggttggattgggtataggattcaatttgctatggtgaaaaattttgaccatagtttagacaataaataggcaaaatatatctgattcttttagtttagcttaccctacgttccccttcatagaaaattatcaaaaagaaaaaaaatggaaaatctattagaaaaaggagaaaaaaccttagataaagaatacttttgatgtaaatagttagtatgttattacagaagtataaatatttggtacttgttcggtttcctggcggtgtctttataattgtttttgtgcgctcttcgtctacgct

SEQ ID NO: 163 - DNA, 1507 bp, Sorghum bicolor
cggagtggcattattcggcagcacgtccctgcctgctcagctgcacacacacggcgcggcacgggaagcgagcgagcagccgccgtccggcgggccgggcgcgcgcggcgctgccccccctgcttcgccggtgcgctcacgcaggtacgcccccgtacgggtcggcaagagctcgtcgtagtcgtagcacggagacggctttattttcttgttgccgtcgtgttcctctccctcgccggcttttcgagcggtggacggccgctctgctatctttctctgctcctcgcctcctcccggtcggcgtctatcctcctcctgtcatctctctatcttttctctgctcgcgtcttccgtgtccttccgtcggtgcgacggtgtctcacgtctggtcggcggcgacgcccggcgaggtcctgaagctgacgcatagaaggtgcatgcacagcacaacaacgaaggggaaaggtgcgagcaatggacgctgacgccggaccagagcgatacgggtgcgtgcactacaggaggaaatgcaagatacgggcgccgtgctgcggcgaggtatttgattgcaggcactgccacaacgaagctaaggattcactcgaggtcagcatccaagaccgccacgtggttccacgtcacgacatcaagctggttatctgctctctctgcaataaagaacaggatgtacagcaagattgttcaaattgtggagcatgtctcggtaaatacttctgcgcgaaatgcaacttcttcgatgatgatgtatcaaagaaccaatttcactgtgatggatgcggcatatgtagaactggtggtgcagaaaatttctatcactgtgataaatgcggttgctgctatacctctctattgaaggattctcaccgttgcgtggacagagctatgcataacaactgccccgtatgcattgagtatctattcgactcgacgaaagctatcagtgtgcttcattgtggacacacgattcacctggaatgcctgtacgagatgagagcgcatcagcagttctcatgcccggtttgcctgaggtctgcctgcaacatgtccgacatatggcaaaagctggatcaagaggttgcagcgtccccgatgccggcgatctatcagaagaagatgatatggatcctgtgcaacgactgtggcatgacggcgaacgtgcagttccacatattggcgcacaagtgccctggatgcagctcttacaacacccggcagacgaggggcgatccagctgcatgctccagagtttaagaacaagtcacgaaaagcaaagaaacgagactgcagtgcgcagaggcgctcgtgtgtgatcgatcaataagctctaggcccgtagtagctgtaggaagggaagaaggccctgcacatgaacacgatcggtgccggtcatttatattgttagctgatatgtatatgctccgagcaaataagcatttgccgcatcggacacaatacaaatttctttagttttttttatttgagatgg

SEQ ID NO: 164 - DNA, 1892 bp, Sorghum bicolor
ggtggtggccaggcaggggcgcgtgaatcgtgccacccggtggccggcgcccgtggtggccaggggcgcgtgaatggtgccaccagagggcgcccagacctgctggcgctggcgtccgcctccctataaaaaggtggagtggaggcacacttggaccacaccaaaccaaaccgttctcggcgtctccctccctccggcggcctccagagcccacccaaaaccacctcggtctccctgtctgtctccctctcgccccccgtttgcgtttgcccatcccatggcgacccacggcggcgagaacggcagcgggcacgcggcggcggagtggcggttcgcgcgggcggcggcggccaaggacgtggccggggcggacaagatgagcatccgggcggcgcggttcaagatcagcgcgagcgtggacgcgcgcgacccgcggcccgtgctgccgctggcgcacggggacccctccgtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagccattgaggttgtcgtctcagtccttgcccaaccgggcaccaacatattgctcccaagaccaggctatccaaattatgaggcgcgtgcagggctgcacaacttagaagttcgtcgtttcgatctgattcctgaaagaggctgggaaatcgatatcgactctctggagtcgattgctgacaagaacaccaccgcaatggtcatcataaaccccaacaatccttgcgggagtgtctatacccatgaacatttagcaaaggtcgcggaggtagcaaggaagcttggaatactagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatccatcacaaacttccttaacatttcaactgacccagcaacttttgttcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttttggaagggatcaatgatgatattgatttttgctgcaagctggcaaaagaagagtccgtgattttgtgtccagggagtgtattgggaatggaaaattggatccgtatcactttcgccattgattcatcttctcttcttgatggtcttgagaggatcaaatctttctgccgaaggcataagaagaagaatttgcttaatggccattaactgtatgagttcaaagttgttacccagttccatagttttccattgtatcatcaacaaatgtggaactttgaaatccctcagaattaataaagttaatgtttgcatatcagcatatgcaagttagtgtacatttttagtcaccttaaccatctgtgttgagatcttttgattttgtgtttgtttcagtttgcaattgcaatgttcttttcttttaatttgacatcatttatatgtgtggtaatggtgaaccgtgaaatacctagtcccatctattatgtactatgtcagttgtgaagctttttgtatt

SEQ ID NO: 165 - DNA, 2475 bp, Sorghum bicolor
aaaaacggctactccctccccccaccgccttctttcagaaccttccgccgcccgcccgcccgcgacgatgccgccggcgccggctgcgcggaagaagcgcctggtccgcgcgggcctcctaaccgccgcggtcgggtacttcgccttcgtgctcctcttcgagctccccttgctgcccttcctggcgtcgtcgtcctcccccgccgccacctcctcctcctcgtcgctccccttccagcacccgcgccggcgggagctagaggccgcggcggcggcgttcacgtcgccgtactcccccgcccgcccctccaagccagccttccccgccgccgcaccgggcccgagctcaacgccccggctcccgatcttctcgtccctcctcctcctcccgcggcccaacgccacggccaccccgttcgacaccaccgccgccgacgccttcgccgcggccaagccgcacctcgcccacctccagtccatccccaaccccgcctccgcctccacctccgcgtccgcgcccgcgtcgtcgccgccgccgccgacatgccccgcgtccatctccgtgcaccgggagcagctgccctacgacggcgtgcgcgtggtggagctcccctgcgggctcgccgtgggctcgcacgttaccgtggtggcccggccccgacccgccaggcccgagtacgaccccaagatcgccgagcgcaaggacggggaggccgccgtcatggtgtcgcagttcatggtcgagctggtcggcaccaaggccgtcgacggcgaggcgccgcccaggatcctgcacttcaaccccaggatccgcggggactacagccggaagcccgtcatcgagatgaacagctgctaccggatgcagtgggggcagtcgcagcgctgcgagggattcgcctcccgccccgccgaggacaccgttgacgggcaactcaagtgtgagaaatggattcacgacgatgacaacaagtcagaggaatcaaagatgaaatggtgggtgaaacgattgattggcagaccaaaggatgtccacatcagttggccatacccgttcacagaaggcaagctatttgttatgactttaacagctggtttggaaggttaccatgtcaatgttgatgggcggcatgttgcttcatttccttaccgcactggttactctcttgaggatgcaactgcgttgtctctgaatggagacattgatatcgagtcaatttttgctagttctctacccaattcacatcctagttttgctcccgagcgataccttgagatgtctgaacagtggaaagccccaccgctgcccactgaacctgttgagcttttcataggcattctctctgcagccagccattttgctgagcgtatggctgtaaggaaatcatggatgatgtatacaaggaaatcatccaatattgtagctcggttctttgtggctctgaatggaaaaaaggaagttaatgcagagctcaagaaggaggcagagttcttccaggacattgttatagtgccttttattgatagctatgaccttgttgtgttgaagaccgttgccattgctgagtatggggtgcgcgttgtccctgcaaagtacgtaatgaaatgtgatgatgatacattcgtcaggatcgattcagtactggatcaagtgaagaaaggtcgaaatgataaaagcgtttatgtcggaagtataaactacttccatcgaccactaagatctggcaagtgggcagtaacttatgaggaatggccggaagaagtgtacccgaattatgcgaatggacctggctatgtaatttcatctgatattgctcactacatcgtgtctgaattcgacaatcagacacttcggctgtttaagatggaggatgtgagcatgggcatgtgggtggagaagttcaacaagacgcggcggccggtggagatccggcacgacgtgcggttctaccagtcgggctgctacaacggctacttcacggcgcactaccagtccccgcagcacatgatctgcctgtggcggaagctgcagtctgggagtgcccggtgctgcaatgtgagatgacgatggcgaaaacctgatctttgtggctaattccacttttgaggttcaaagaggacagacagatggtggacgacgggtcgacagcccgtaagaacagctcgcttatgaggaacgacggctgacgacccggtggtggtggggatgagtttggaggagtttgctcctcttgactttgtgatacgatcgatgattcgttcattcttttgatcggtggcccgtttcagctgctgattctgacagtcctgatcgatgttcttggtcagggattcttttatacactactactacctgttgatagtgtagctgcgtcaaacttttttgacctagaaattttgacttgggcgagttgggttagtatactggcggtgtttgtgtataaaaaggattttgtgagttgggatttatatatt

SEQ ID NO: 166 - DNA, 1054 bp, Sorghum bicolor
ccttccccatttcctcgcatcgcatccgccctcttgcttgcttcacacgagcgacgcgattaccaaatttttttccttttccgggggagtggttgttcgtcctgtcggcggcgggcggcggagggatggagacggcggccgcggcgatgctagaggccggggtagggcggttctcgcgggcgccggcgatggccacggcgctgctggcggagatgtgggcgccgctggccgtggcgctggcggcgctggccacgctgcccagcctgctgcgccgcctgcaggtcatcgtgctccgcctccggtcccgcgggaaggaggtcgtccagtcgcacatcgggacctactactcgccctgcgccgaggaggatggctccgccgacgaagacgagagctccgacgaagaggcggaggacgccagctcatccgacgacgacggggagggggaggatctgaagcggatcgggttctacgagggggcctcggacggcgtcttcccctggggcggcgccgtggtccgcacctggcagggcctcccgcgccgcttctccggctgcgcctcgggtatcggaggaggtttcggcggcgccaccggaggagcgttccctggagctgtcaggctgtggggcgccagcacggccagcggcggcgagccgtggtgggccgccgtctgcagcgccgatgaaggcggctgccgtcgcgacggcggcgcggccgcggccgcggaggcggaccaggtcgtcgtcgggtggcggcgcgagcacgcgtcgcagcagcagcagcagcggcggcgccggcggcgtgccgttcccctcgctcacacgggccagtgaaacggaacggcacggcaacgggggtggtgggtgtcggatgtgaatatgccacaggggcgaccagctggagatgccgatcccgtgctgggggcccacctgtaagtgggtgggagggagggacgagggggcgggggtgatttattagtgtgggggatgggggaagactggttaggcgccgcgccggattggttggtgacaacattaaattttttttattagtagga

SEQ ID NO: 167 - DNA, 2357 bp, Sorghum bicolor
cctccttaaaaaatcggccacggttatttatctccctcgctccgctccgctccgctttcctaatccgcgagctggggggagatcgagacctaaagcggagggcgggcgggcggcgccgagggccttaggcgaatggcggtggaggaggccgcggagagctgcggcagtcacgccgcggccgccgccgcgtccggcggccgcgcggcggggcccgcgacgtcctcgtcatcggccgccgcggcggcggcgctggcgcggaagcagcagcagcagcagcgccacaagctcgaggtgtacacggaggttctccggcgcctccaggacgccggcccgcccgacgcgcgggcgcccgggttcgacgacgagctctggaaccacttcaaccgcctcccagcccgctacgccatggatgtgaacgtggagagggcggaggacgtgctcacgcacaagcgacttctggagcaggccaaggatccggctcagcgcccggctttcgcggtgcgggccgtgcaggtatctccaattcttgatgggaatcagactgatgctgattcgaacactgcaggggaggaagtcgcttcaagactgaacaggcagcaaagcatacatcctcctgctttcggttcttctacaaatcttgaagcccttgctcttgaagctagcaagtctcatcaagatcatgatagcacttctgataatggtcgatctctgtacaggcccatgcatgaaatcaccttttcaaccattgacaagccaaaacttctcagtgagctgacatctctgctcggtgagcttggtctaaacattcaagaagcacatgcattttcaacaaatgatggctactcacttgatgtctttgttgttgtcggttggcatgacgaggaaacagaggatttagtagaagcagtgcagaaggaaattggcaggattgaagagacacaagcatggtcttcatctcattcatggtctactccagttgaaaacatacagattgctgagaattcagcagctgaccatgttgagataccaacagatggtgctagtgaatgggaaattgatgtaaaactgctcaagtttgggaataaagtagcatcaggatcatatggtgacctttaccggggtacatattgcagtcaagatgttgctattaaagtgctgaaacctgagagaataaatgcagacatgcagcgcgaatttgctcaggaagtatatattatgaggaaggtccgtcacaagaatgttgtgcaatttattggtgcttccactaaacccccaaatctttgtataatcacagaatttatgtccagtggaagtgtgtatgattacctccataaacataaaggtgttttcaaacttcctgctttagttggagttgcaatggatgtgtcaaaaggcatgaactacttacaccagaataatattattcaccgtgatttgaaaactgcaaaccttctgatggatgaaaatgggactgttaaagttgctgattttggtgttgcacgtgttaaagctcaatctggagttatgactgcagaaactggtacttaccgttggatggccccagaggtcatagagcacaaaccctatgatcacaaggctgatgtttttagttttggaattttgttgtgggaactactcacagggaagattccttatgagtacctgactccactacaagcagctgttggtgtggtgcagaagggattacggcctacaattccaaaacatactcatgcaaggctttctgagcttcttcagaaatgttggcagcaggaccctgcccaaagaccagacttctccgaaattttagaaacccttcagagaatagcagaggaggtcggagatgagcacgaggggaagcacaaggacagaacactgggtggtttcttttcagctttcagggggcggagccattgagacacggttgaagaatgaagacttgtaatgtacatggtcccggtccatccttgaaggacctacaaccagcgcctgttcctcgcacgtcagcaccagtacacagaaatacagacctgctgcagctgcagttgactgaagtggcaatttttagctgcagccatcgctttccgcctatctgcttgttattcctgagttccattattacacaatgtaacataaggagaggaagcttgggaactgtacatcatcatctgtctgatttctctaacagagtgtaatcttgctgtagatgaaaataataaagccagattcaggccgtggcatgattcttttaagattccatcatttagtatcttttcttttaggtgtcgtcattcttttctggacatgctccatccctccatggtgtggtatggagtgaaacatcgccgcaagctcga

SEQ ID NO: 168 - DNA, 4061 bp, Sorghum bicolor
cagcgtttcagagctttgctctcgtcagactctggagcgacggccggagccggctactccggcggaaatcgcctcccgaatcacctccgtggacgggagtggccagaaccatctttttccactcctgccttttcctctcccgactactttgcttgcgcgcggggggcgctctcgtggcgcaactaggcgaccgcggccggctgctctgcgccacgtgcttgggtctatcctcatcggttccttcgcgttcaggcccttcgccggcgaccaatacccactagtttactggaggtgtggaaccacttctgatgctgtctttgtaaatattgatggagctagctgagtagaaatggactgtagtcaagattcccaagaagaaagccatcaaagaagggagaatggtgaagaagctgaaaaggcggctgactatggaaatgctttgagccgtaaggaggcaacagaagagcttcttggttgtgttgttcatagtgaggaagaggcatacaggctgtactgtgattatgggcatcgaatcggtttcagcgtgcggaagggcaaacagtcttacttcattggtaccaagaatattcgaacaaaggattactactgctcaaaggaagggcttaaatatgatgagcctgttacagaagcaaattttaatcgaccagacacaagaactaattgcaaagcaatgatccgctttagagttgacgagaaggggcgatggacagttatacgctttgttcctgtacataatcaccagttggcgaaacctggagaaaggcacatgctgagatcagctaaatcgcttgctgttggcaaatcaggtgttatagatccatcagcatctacagagtcacatccaatcaatggtttctctaatatgacaggtgatatagctgagaattcagggtatactataagggaatgttacaatcaagtgtgcatgcagaatataacgataattgaggcaggggatagccaaagtcttgtcagctatttcaagcgtagaactaatgaggaaggcatgttctattgggatgtccaagttgatcaagaagggcgcatgactaacttcttctacagagatggtaaaagtagaaatgattatggctgctttggagatgccattatattcgacacaacctaccgcacaaacaaatataacttgatatgtgccccatttgttggtgttgaccaccattggcagaatgttgttttcggctgcgcattcttgttagacgagtctgtaacttcctatgcctgggtatttaaatcattcttggagtcaatgggaggccgatcgccaaaatcaatattcactgatcaggatgaagctattatgcaggcagttgaacaggttttccctaacacacaacattgcttttcctactggcatattgtgaagaatgcacaatctcatttaggctcactaaatacatctcaagcatttcaaagtatgtttaccaagtgtatgcaaggatccgactcagaagaggattttaaggaatcatggactgcaatgatccaggaatacaagctacaggataatagctggttgattgacctttatgcattccatcgtaaatggtgttcagcatttaacaaagacacatttgatggtggaattaattcttctcagtggggggaggtttcaagtaatattttcaatggaatttctgatgaaaatacctctcttacacgttttgcccttttgctagaaaaggttgtcaaggatctacgtagaaatgaatctgaagaggattttcgctgtagccaaactgctccagtccgtgcaattaagcacagtacagttctgaagcaagctgcagaatcatatacacataggatctacaaattatttgaagcagaatttctggatgggtgtggagcaacttcttgccacgaaacttcgagtggtggaaatttattgaggtttggaattacaatgcagggaaggggttcaaaagtatgggatgttgttcttgacacttccactatggagatcagttgtggttgtagaaagtttgaaaggatgggtcttctttgttcgcatgccctcaaagtcttcaccctgcagaatgtggacacaattccagaaaagtatgttttgaaacgctggacaaaagatgccaggagaagcatgtatacacttgctcaggatgattcaacccaacaggaatgcacagaggctgaacttgcatatcgcaatcgggcaatgcagtatgcatataacctaattataaagagccaggaattggaagaatcaagaaaaatattctgggattcccttgaaactggagagaaggcactggaagtattctttgaaatgagaaacatgcgcactcaagcagcaaaggatgctaataagaatgagaaaaagaagaagaaaacatcaaaaggaccaaacccaaaaaaagcaaaacaagccccaggagtttcctcaactgatctggagctgatagtccaaactaatgagcatcaatttcaatcttcacaagatgctcagggtaatgcaaccattggaagaccatattactatcaggttccgcagacttttccaaatgcccctatccaaccaaaccagatgtacatgcatccaaatatgcacacagtgcccctttgcacaccgcaggatctgtctgcatttgcaatacgccccaattcaacttttggtggtgccaagaacatctgaacttctgaaggatattaaggtccaggttcctctggatgtcattggaaaaccttattcagggattgtgagttgtgactatcaactccgcttttgagctctgtcgacctatttatgtaggcctggcggcacttcttcatgtttggttggttcaggggttctttcttctgatcttagggaagcagctattctggctgttgcagtgcagccccttatccagatagcagtggcttgctattaatatcactcaggcaattttaggtttgtaaactgtaaggtagaaggtagaaggtagtgagaggagacgatcattctacagatccagaatccagttgcatactatactgatgtagggattgatttgcttgtgctaaggcctccatccgctttgggtgtgagtgtccagcatgggttcagcttgagttgagcagatgagtcactgtacatggaagcaagcaaagcagctgggagcctgggagtggaggagctggcgaccagcgctagctggggaactactcagtcctagacgtctgtcgatccaaagtgacactgacgggctgatggctgacctattttttttgggtatggtttctcttctgagttgtgcgtatcagtttatattatgtaatgtatattgtactcctggttgacgaagagatgatgaatggacatattctaggaaaattcaacgttatttggatttttggaagcggtgttggtcagtacatactgaattgctgatgactgatggcacaggctccacctcgcaactgccatggctgggcgggtctcgacacagtgcctgctgctggagctagaactggacctggaccagcggaccccctgcgagacgccaacgccgatgaccgagtgacagccgctcccggcgggctggccacctccgactgcccacatatgaacggcagtctgaaactctgtttgcttgacagcctgctctgaattggggaaacataaagggtactggattgtagattgagagaaattgggggatggagctgttgattgggttcagtggtgaaggaagccgctagctgctgcttgggttgattcaagagagattagagaaggattggaaatgttgctgttggttcgcttgaactttgagtttctgattgtttgcttgttctcagaatgtagtgtcatgtagaactttaggttgccaacaccttggttctgagatgtgacaataaaaaaattgcgactgttgtgatggtatttttgaaatttcagttggtaagaaatgctgaaagaagaaatgtcatcatacgatcgttgcattgctttgcctatttccatgtttacccaaatagcatcatcgttgtatggcacttcactctgaatgcgagtt

SEQ ID NO: 169 - DNA, 1819 bp, Sorghum bicolor
tacataaatacgagcacggccgcggcggcaaagcccccaactcagactgcccaccagctaagccacccagcagcacgaccgcgatcaccggccagtgagacggtacggtacaggaaaaattcccccgtcgcgcccggccggccattacgacggcgccagccgagcagacgccgccgccacgatgccgcccgccaccggcgccgtcgcatctccccccgccgctgccgggaccgtgctccttggcaggtacgagctcggcgacctcctgggccgcggcgcgtccgccaaggtgtacctggcgcgagacctgctcacgggccggtccgtggccatcaagtcgttcccgaacccgcgcgccgccgccgctggtgaccggcccgtggccatcgagcgggaggccggcatcctccgtcgcctgcggcaccgccacgtggtgcggctccacgagatcctcgcgacgcgcaagaaggtccacttcgtgctggacctcgccgccggcggcgagctgttctcgcttgtcgacgcgtcgggccgcatgacggaggaccttgcgcggcactacttccggcagctggtgtccgccgtgcggtactgccacgcgcgcggcgtgtaccaccgcgacatcaagcccgagaacctcctcctcgacgagtccggcgcgctgatggtggccgacttcgggctcggcgccgtggccggcaccgccgacggaggcggcagtctcctccggcacacgatgtgcggcaccccggcgtacgtggccccggagatcctgtcgcggaaagggtacgagccggcgaaggtggacatctggtcgtgcggcgtggtgctgttcgtgctggcggcgggttacctccccttcaacgacgcgagcctcgtgaacatgtaccgcaagatctacgcgggccggttccggtgccccgggtggttctcgccggcgctgcgcgacctgctgcggcgcgtgctggacccggacccgtcggcgcgcattgacgcggacggcatcgtggcgcacccgtggttccgccacggcgccagcgacgaggagctgggccgcctgatgcacggcggcggcggtgagcaggaggaggaggaggaggcgtggtttgggccggttggggagtcgaaggcggacgaggaggacagggagccgaccgcgttcgacatcctgagcttctccccgggctccgacctgtcggcgctgttcctcggcgccgggaaggagcgggtgttcgtgggcgagcccgtggcggccgtggtggcccgcgtggaggctgccgggaggaaaggagggtaccgcgtgcggagggacgggaagagggccaccgccgtgtacgtggaggaagaggagagcggcgtggtggttgcgaaagtgagcgtgtttaggatcgccgacgccgtgtccgtggtggaggtggtaaaaggcgacggccccgacgccgtggtgttctggagcgagctgctggagccggccgtgaagcccccggcgctgagctgctgaggaggtgaagccgtgcccgcgcgcggcggggagctgtgcgatgtgattattttgtttgtttgtttgttgttgtcggtccgcctcggcgaaatcatcatctgtaaaaccattatgctatgcatcgaatcaaatcaaagcaaggacgaagaagaatccttgcgatgttgattgagacaacaaatttgaggtggtactgacgacgctttggattgacgggaaatagagtaggccaccatgatccgtgaattcctttggtttggcaacacaagtcaagaactagtgctgtgtactccagccgggaaaatcgtgaagattgac

SEQ ID NO: 170 - DNA, 2058 bp, Sorghum bicolor
ctcctctcctctgctcctctcctctcctctcccgggaagggaaccccggccgctactccgatttgcaccgccacccgcgcaatctcgggatcccagccgtccgcacctcgccgcggccacgaatggtggcctctgcctattgtcttcttccaagcacctaacccaacccaaggcggtcggtagggtaggtgccaggtaaactctgaaggcgaccaccgggaccgggcggcgatggcgaccgccgcgagggacaggcgcctgccgccggcgctgcccctggccacgctcatcggccgcgagctccgcgcggggggctccgagcgcccggcgctgcgctatggccacgccggcttcgccaagcgcggcgaggattacttcctcgtcaagcccgactgcctccgcgtccccggggaccccgcatccgccttctccgtcttcgccgtgttcgatggccacaacggcgtgtcggcggcggtctacagcaaggagcatctgctcgagcacgtcatgagcgcgctgccgccggacatcggccgcgaagactggctgcaggcgctgccgcgcgcgctcgtcgccggctttgtcaaggccgacatcgattttcagcgcaagggggaagtgtctggaaccacggcgacactggtggtcatcgatgggttcacggtcacagtggcgtcggtgggcgactcgcgctgcatcctggacacgcagggcggcgagttgcagctgctgaccgtggaccaccgcctggaggagaatgcagaggagcgggagcgcgtcacggccagcggtggggaagtaggtcggctcaatctcttcggtgggcaggaggtcggtcctctccggtgctggcctggtggcttgtgcctttcaagatccattggggacatggatgttggggagttcattgtgcccattccacatgtcaagcaagtcaagctatcaaacaccggaggaaggctgataatagcatcagatggcatatgggatgcgttatccaatgaagcagctgcacaagcatgcagaggattgcctgcagaactggcagccaagcttgtcgttaagcaagctctgaaaacaagcgggctaaaggatgataccacctgtgtcgtagttgacatcatcccatccgatcatttgacatcaccgcaattgtctccaaagaaaaatcagaacaagttgaagtcactttttcgtagaaggtcgcatagttcagttggaaagcttggaggaaagtctgcctccattggttctgtggaggagttatttgaagaaggctctgcaatgttagaagaaaggttgggtaggaatttgtccttgaaagcagcttcaccaccttttcgctgtgcaatctgccaagtggaccaagagccattcgaagatttgatgacagataatggaggtggttactgctcttccccatacgctccatggggtggtccacatctctgtttggactgtcggaagaagaaagatgcaatggaaggtaagagatctagccgctctacagcatgcaggtgaaacaatcaagactctgtttaagtcaagcctgcggcctgcctgcttcacagagaaaagaagcaatgagaggacaataagttgctggatccaagtataattgtttgctgaaactaactgtattgccagcccggtacaaaacatatttggttggtgagcgctaactagtctgttacctgcgtacaacccatatggaaaagtttgatgttgcggaaatagctccaatgacgaggttgtagttttgacggtaccctgtagtgtgcctcttgtgcagggaaacattgacctgcctattgctgcctgtgattccccccccccccccctcccccttctatataatagctactgagggttctctttgtattattcgtggaacatatttttggtgggattgaagtaagtacgaagcaatgtacttatgtgtaaaatattccttgagtaatgacctgttattgatgaattggcttccagatatgcctttcttgcatttgagttttgaactattcaattcaatgtcgacagatgcagagtatagttgat

SEQ ID NO: 171 - DNA, 1702 bp, Sorghum bicolor
cccccattcccattttaagcagagccgaggcccagatgcagtgcaaacatccatccatcttcttcttcccccctcacaaacatcttatccctccatccaggtcgggaccgatcgaggccatagaattccagtccgttcctcgtccgtttcctcctccggggccaggcttcaccgcacctagctagctttctttcttgtcgttcgccgccgtgtgccgtgccgtgccgtccatggctaggaagtgctctagctgtgggaacaatggccacaactcgaggacctgcagcgggcacggcaggacgacggtcttcgtaggccacggcggcatcggcggcggcggcgtgaggctgttcggggtgcagctgcacgtggccgggtcctcgcccatggccatgaagaagtgcttcagcatggagtgcctgtcgtcgtcgacgttgtcgtccgccgtgacgccgacgtactacgctgccgctctcgccgccaccaccaacagcaactcgccgtcggcgtcgtcctcgtcgtcgctcgtgtcggtggaggaggctcctgagaagatgaccaacgggtacctctccgacgggctcatgggcagggcgcaggagcggaagaagggcgttccatggacggaggacgagcaccggcgattcctggcgggcctggagaagctcgggaagggcgactggcgaggcatctcccgtcacttcgtgacgacgcggacaccgacgcaggtggccagccacgcccagaagtacttcctccggcagagcagcctgacgcacaagaagcgcaggtccagcctcttcgacgtggtggagaacgctgacagggcggcgacgagctccattaaggacagggagcaggagcagcgcctgaggctcaaggatgctgcgatcgcgacgaccgcctctgcagcagcacccggaacgacgacgccgacagagctcccggcgctgtcgctcggcatcatcagccggccagcaaggaggcctgagcacgtcgtcctgcctccgaccagcctgtcgctgcagctgccgcggtgctcggcggcaatgggcagcctggccctggccgcgccgaaacacacacacccttcgtcgaccctgacgccggcggcaacggctagtagtagccaggcgctgccggacctggagctgaagatctcgatcgcccggccgcagagcgacgtccaccaggtccagactgggtcgtcgccgccgccgccgaggacgccctttctgggcaccatcagggtcacataaccgaaaagacgtcgccgacgacgacgcgggaatatcctgctggtagatgaagagcagcttttgctcatctgaagaagggttggttcaacgacgggacgaggtttgggaaaactgaaaaggaggagcttttggcagtggtgtatgagcgtgtgtgttggtggcagccgtgacgacgacgacgatggcgtcgtttatcatgtgggtgtagtgtaatatcatcatcagaaagatggaaactttactggcctaatttagtctatgttgatttgtttgtttttcttgcaaataaagaacggctgccattgccatgcactactctactctctctcccgtctcgctcgatacctttatgttgacacaaaggtaggtcgatggtgagagatgagctcaccatattcagctcagttttttgaaagaatatattcagctcagttgcttgcctc

SEQ ID NO: 172 - DNA, 3693 bp, Sorghum bicolor
tttttttctaggactgttttatcaattcatttttattccatttcgacccctgcgaaattcgaactttcgtcgaaatcgtctctattcatatgtatgaaatacatatatgaaatacgtatgtggagttccctagaatttcatgtgattcagtaaacagaatatggattccatgattgctagattgatccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggattggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataagggaatttctatatacaccggtactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaatcactacttatgagaccttttttggcacataccccttagctcaagtttttgatcaaaccaatccattgacacaaacggttcatgggcgaaaagtgagttgtttgggtcctggaggattgacggggagaactgcaagttttcgtagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgacaaacagctctagattcgagggtttccgttatagccgaacgcgagggaaagatcatttctagtgatagtcacaagatccttttatcaagtagtgggaagaccataagtattcctttagttgcccatcggcgctctaacaaaaatacttgtatgcaccaaaaacctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacgtttggtatatgaggatatttatacttcttttcacatccgaaaatatgaaattcagacggatacgacaagccaaggctccgctgaaaaaatcactaaacaaataccacatctagaagaacatttactccgcaatttggacagaaatggagttgtgaggttgggatcctgggtagaaactggcgatattttagtaggtaaattaacgcctcagatagcgagcgaatcgtcgtatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagccggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaatgctacgatctggggaaaaagagtgcctaatcacgaggatccgccagaatcttttcgagtgctcgttcgagaactacgatctttggctctagaactgaaccatttccttgtatctgagaagaacttccgggttaatagggaggatgtttgatcggaataaatataaatttttttcttatttctattttatgattgaccaatataaacataaacaacttcaaattggactcgtttcccctcaacaaataaaggcttgggctaaaaaaatcctacctaatggggaagtcgttggcgaagtcacaaggccctccacttttcattataaaaccgataaaccagaaaaagatggattgttttgcg

SEQ ID NO: 173 - DNA, 2284 bp, Sorghum bicolor
atggcctcggtgtccgccgtgcttctacagcgctcctactcgcgcgcccgagaatatttacggctccagcgcaccgccagctgctactcagttcagttgcgctgcatttggaaggcgagggcctgcactggtggtggagcaagagcaacagccgcggccgcggcgggaggtttggcgcgagagcagcgcaccgtatggcgggatcaggggaggggggaaacggcggcgtgccggcgggaggtgaagtcgcgatggcgccgggcgtggtgactggcggcgaggaggacgcctacggcgaggatcgcgccaccgaggaccagcctgtcactccgtgggccgtctgcatagcaagtggtcactccctgctgagggatccaaggcacaataaagggctctcgttcacggagaaagagcgggaagcgcactacctgcgaggattattgcctccggtagtgctatctcaggacctccaggagaagaggatgttgcagaatgtgcggcaattccaggtcccgttgcagcgctactctgcgctaatggaccttcaggagagaaatgagaggctgttttacaagctcctgattgacaatgtagaagaactacttcctgttgtgtatacaccaacagtgggggaagcttgccagaagtatgggtcgatcttcagacgaccgcagggcttatatgtcagcctgaaggataaggggaggatcttggaggtactgagaaactggccagagaagagtattcaggttattgtggtcactgatggtgagcgtattttaggcctgggagatcttggttgccagggcatgggaattcctgtggggaagcttgcgctgtatactgctcttggaggtgtacggccatccgcttgcctgcctattaccattgatgtgggaacaaataatgaagatctactaaaggatgaattctacattgggttaaagcaaagaagagcaactggccaggaatactctgagcttctggatgagtttatggctgcagttaggcagaactatggacaaaaagttcttgtccagtttgaggacttcgcaaaccacaatgcatttacacttcttgagaagtacaggacaaaccatcttgtatttaatgatgatatccagggcacagctgctgtagtacttgcagggcttattgctgctctgaagtctgttggtgggactctagctgatcatacattcttgttctttggtgcaggagaggctggtacgggcattgctgaactagttgctctggagatatccagacaggcaaaggtttctgtagaagaggctcgcaaaaagatctggctggttgattcaaagggactgattgtgacctcacgtaaagagacactccagccgtttaagaagcgatatgcacatgagcatgaacctgtcaaagatctcttgggtgctgttaaggctatcagaccgactgcactaataggatcagctggtgtgggtcaaagtttcacgaaagaggtgattgaggctatgtcttcgatcaatgagagaccgattatccttgctctatcaaacccaacatcacagtctgaatgtactgctgaacaagcatatacatggagtcaggggcgtgccatatttgggagtggaagcccgtttgatccagtgaaatataatgacaaactatttgtgcctgcccaggcaaacaatgcatacattttcccggggtttggactaggggtggtgatctcaggagcagtccgggtgtcagatgatatggtccttgctgctgctgaaggactagctgaacaggtaacaccggaacatattgagaaaggcctgatctacccgcccttttccatcatcaggaagatttcagctaacatagctgcccgtgtcgcggcaaaagcttatgatctcggaatggctagccagctccctcggccaaaagacctggtgaagtatgctgagagttgcatgtacagccccgtctaccgaacgtacaggtgatgtgaagagcgaacagtgacattggatacacggatgggtgtgtatacaacttcacctgaagattgcatatgcctatacattaacatctactgctgagctttgtacatatcttccctgtgaccgtgttgtaaaacgtgtggcgaagtccgctgctgtggagctgatactgcacgttcgtactttatgttgtgtaataaaagttcaggggacggactaagttttgacatgttcctatgtactatagtctactcatgcatgtcctcatgcgtgtcggggatttcttgtacatgatttgcatgggcgacgac

SEQ ID NO: 174 - DNA, 1929 bp, Sorghum bicolor
gtccatcaaaaaggccggatcacactgatcacaagcctcaaaacttttccaaaccaagttagctgcggagtgggtgctctaaagctaacgctctctgcagtctggactctggttcgcggtggccgcagctgcagcgtcccctccctttttttgccaccgagcatcacctgtgccgccggcgcgtaactgcaccgcggtcaccgcttaagaggcagaggaggaggaggacggcagcggcgttggggggtctagtctcgtcgtgcgggtggccatgggcgtgcacgccaagtcgatgagctggtacatgagcccgccggggtcgccgccggcgccggggagcgccgccaccgaggcgcagcacgcgctgagcagcagccccgggggcagcagcgacgccagcttcgacaccaacatggtcatcatcctggccgcgctgctgttcgcgctcctcttcgcgctgggcctcaactcgctcgcgcgctgcctcatccgctgggcgcgccgcgcgtcggagggggaggacggcggcgccggcgccggcgcgggcgggctcaagaagcgcgcgctccggagcatccccgtcgaggtgtacggcgcgtgcggcgccgacggagccgccgtcgacgccgacgtctgcgccatctgcctcggcgagttcgcggacggcgagaaggtgcgcgtgctgccgcgctgcgcccacggctaccacgtccgctgcgtcgacacctggctcctgtcgcacgactcctgccccacgtgccggggctccgtgctcgacggcgcgaaggccgccgccgccgccgctcccgctcccgccgcagggggcagccggcggcagggcagcgaggctgctgccatcgccgttgtcatcggatgacgtggacgggagggaggcgggccccgtgtgcgcgcccactggtggtggagccacacggcaggtatgcgagagcttcgttccgtggtccgtgagatattttgctgtgagaggccgacgagtggggccagcactctttgtaggtcacagtctagtcaaagattgcagcatgtccttcacgatattatcccttgggtctgtactttagcttggcttgctcgtacacgtcgcagcagctggctgtttgtgtatactgggagtcgatgacggcgacggggtacgcctctataggcagttaggcttgcaataatacagtttagtttgtacatgttcgatttggcacagttttggagcaccgagcagagcacggaggtttgcaggtcactagattttggaaactattttccccttttctttcctcatattacgggcctgtttggtacagctcacaacagcttcatgaagctgttgtgagctgtttttttgccaaacacttatttccaaaacagcttcatggatgaagctgttttttccctcctctcacaaagacataagttggatgaagctgaaaaaaagtagcttattgcagcttctccctcatttctctctctcaactatacatgaagtagttagtgaagctattttgccaaacactttctccaaaacagctcagcttcatctagaaagtcactcatgaagctattttgtaaaaaaacagctttactagtgaagttgagctgtgccaaacaagacctacatattcgattttggcactagtatattaccgaaatgattttggcacgtcgaaaccgaaatgattccatcaatcgtgtgctctggactcctccacgcatggctgtggactgagatgctgtcgtgataataacgctgagagtaacgaccgagaccgacagcgatattgcggccttgttcagttcgcaaaaaatgttgaaaaacggcactgtagcactttcgtttttatttgacaaacattgtccaattatagagtaactagactcaaaagattcatctcgcggtttacagatgaactgtgc

SEQ ID NO: 175 - DNA, 977 bp, Sorghum bicolor
caccgcactctcttgcctgatggcgtcgccggcggcgggcactccgccgttcctgacgaagacgtacgccatggtcgaggacccgaccacggacgagacgatctcctggaacgacaccggcacggcgttcgtggtgtggcgccccgccgagttcgcacgcgacctcctccccaagcacttcaagcacagcaacttctcctcgttcgtccgccagctcaacacctacggattcaagaaggtagtggcggacagatgggagttcgccaacgacggcttccggagaggcgagaagcaccttctcggcgggatacagaggcggaaggggaccggcgccgtggcggcggtaccgacgccgggcataccgacggggataccgatctcgtccccgcccacgagctccggcggggagccggcggtctcgtcgtcgccgccgcgtggctcgacggctggagtgagcggcgcggtggccgagctggaggaggagaacgcgcggctgcggcgcgagaatgcgaggctggcgcgggagctggcccgcgcgcggcgcctctgcgacggcgtgcgccacctcgtggcgcggtacgaccaaggcagaggcggggatgaggatctggcggacggcgacgaagggcacggcggcggtggggaacgccccagcggcccgggagtgaagccaatgctgttcggcgtcccaatcggggccaagcggctacgcggcgcggatggagatggagacgatgttgatgacggcgaggacggggccgccgaggaaaatggcgagggcaacgacgaggaacaagacgaggacgaggagaggcacgcggcgcgggagcggggggttaaggcggccaggaggaacgagacgtcggatctggatgtgctgacgctgtccgtgcgggcggccgcggcggcgaggacgggtggagggtcacgtgaccgctaagagctacccgcccgcgccgctacgactgaaatcactg

SEQ ID NO: 176 - DNA, 1292 bp, Sorghum bicolor
cacgcttctcgcttcccctcgttcaccgctgccgggacagctcttcttccgcaacggcaaggccacacgctcctggccgcggctgttcgcagcgcaaaccctaacggagccaacggaggcgcgcgagcggaagcatccatggacggcggccgcaagagggggaaggccgacggcgccaaaggggcctccgccggcgcgaagcggtcgcgagaatcggagtcatttcaaagtggcgtaggaagcaaatcgaagccatgcaccaattttttcagtacttctggttgtccctttggtgagggctgccattttctccattacttccccggtggctaccaggcagtttcaaaaatgaccaatctgggtggcacaacaattgcatctcctggaagaatgacgatggacgggccacctacacccaccgtgaagactcgcttgtgcaacaagtacaacactgcagagggatgcaaatggggtgacaaatgccactttgcacatggtgaaaaggagcttggcaagcctaagttgatgggcagctatatgccacctcccatggggccaagacccactggtcattttgcacctccaccaatggccagccctggcttggccactccagctagcttcggcgcttctgccacagccaagatcagtgttgatgcatcccttgcaggtggcatcatcgggaggggtggagtaaacacaaaacagatatcccgagtcaccggggcaaagctggccatccgggaccatgaatcagacaccagcttgaaaaacattgagcttgagggcacctttgatcagatcaggaatgctagtgctatggtcagtgagcttattgtcagcatcagtggcaatgcccctccacaggccaagaacccagctggcggtactcatcgtggtggacgcacaggaagcaacttcaagaccaagatgtgtgagaacttcgcaaaaggatcgtgttcgtttggcgacaagtgtcactttgcccatggtgacaatgagctgcgcaagcctgctgctgcttgagatccatgccctgtttcatacctcagtagtcattagtcaatgtaactctaaacatcgtctctgatgatggatttgctgacttctttaggcctgcgctactgatttactgacttcagggctactactgaatttgcggacttctttaggccctcgctattgccaactgaatttgttttcagcattcttcttgaatgttatgttatgaactacttaggtagtatgttactaggacccgttcaagaagaaaagtgtttgatgctgctgat

SEQ ID NO: 177 - DNA, 3370 bp, Sorghum bicolor
ctccgctctcgccgtctcggcgagctcgctcctcgtctcccggtccaggaggaggtgggtgtgagggatggagaggctggagagctacctgaaggagcacttcgaagtgccggcgaagaacccctccgaagaggcgcagcggcgatggcgctccgccgtgggcctcgtcaagaaccgccgccgccgcttccgcatggtgcccgacctcgaccgccgcagccaggacgaggcccagcgacaatccgtccaggaaaaaattcggcttgccctggttgtgcagaaggctgccatcaccttcattgatggtgccaagcataaagaatatcggataacagaggatatcataaaagctggattttccattaatccagacgaactggcatcgatcacaagcaaacatgacgtgaaagctttgaagatgcacggtggggcagacggtatatccaaaaaaatccgatcgtcattcgaccatggcatatctgctaatgacctagacacaaggcaaaacatctacggcgtcaatcgctatgcggagaagccttcaagaagtttctggatgtttgtctgggatgcgttgcaggacatgactcttatcattcttatggtttgtgctttggtatctgctgttgtcggtctggcgtctgaaggttggcccaagggtatgtatgatggtttgggaataatactcagcattttgctggttgtgatggttactgctatcagtgactacaggcagtcgcttcagttcaaggagctagataatgagaagaagaagatatttatccatgtgaccagagatggctctcggcagaagatctctatatatgacttggcagttggtgatatcgtgcatctatcaattggagaccaagtacctgccgatggactgtacattcatggatactcccttttgattgatgagtccagcttgtcaggtgagagcgatccagtttatatttctcaagataagccgttcatcttggcaggaactaaggttcaggatggatcagctaagatgatggtaaccgctgttggtatgcgcacggaatggggaaggttgatgagcacattgagtgaaggaggagaggacgagacgccactgcaggttaagctaaacggagttgcaaccatcattggcaagattggcctgatgtttgccacattaacatttgtggtcctgatggttagattccttattgaaaaaggtttaacagttggtttgtccaaatggtattctaccgatgcactgactatagtaaactactttgcaacggcagtcactattattgtcgttgctgttcctgaagggctgcctctagctgttactttgagtcttgcatttgcaatgaaacagctaatgaatgataaagcacttgtaaggcatctttcagcatgcgaaacaatgggatctgctggtaccatctgcacagataaaacgggtactctgactacaaaccatatggtggttgagaagatatggatatctgaggtctcaaagtcggttaccagtaacaatagtttggaagatctgacctctgccatttctccagctacattgagcctacttttgcagggcatttttgagaacaccagtgcagagttagtcactgagaaggatggtaagcaaactgttttaggaactccaacagaaagggcaatatttgaatttggcttgaaattggaaggtcttgatgctgaggataggacctgtaccaaggttaaggttgagcctttcaattcggttaagaagaagatggcagtgttggtctcattacagaatggcatgtaccgttggttcaccaagggtgcatcagagattattgtgcagatgtgtgacatgatgatagatggcgatggaaacagtgttcccttatcagaagctcagagaaagaacatcttggatacaatcaactcctttgcttcggatgctttaaggacactgtgcttggcgtataaggaagtggatgatttcgaagatgatgcagatagcccaacaagtggttttactctagtatccatttttggcatcaaggatcctttgcgcccaggagtcaaggatgctgtgaaggcctgtatgtctgctggcatcattgtgagaatggtgactggtgataatatcaatacagctaaagctatagccaaagagtgtggaatactaactgatggtgacgtagcaatagaaggaccagaattccgcagcaagagcccagaagagatgagggacataatacctaagattcgggtcatggctcgttctttaccattggacaagcatacccttgtgacaaacttgcgaggtatgtttcgtgaggtggttgctgtgacaggtgacggcacaaatgatgctccagcattacatgaagcagatattggccttgctatgggcatagcaggaacagaggttgccaaggagagtgcagatgtgatagttcttgatgacaattttacaactataataaatgttgcaaggtggggtcgtgcggtttacataaacatccaaaagtttgtgcagtttcagttgactgtcaatattgttgctttggtcatcaactttgtttcagcatgtattacagggagtgctcctctcacagcggtgcaactgttgtgggtcaatatgattatggatacattgggagctttagctctagcaacagagcctccaaatgatgacatgatgaagaggccgcctgttgggcgaggggaaagtttcattaccaaagtcatgtggagaaatatcattgggcaaagtttatatcagttggttgtacttggagttctcatgtttgcaggggaacagtttctgagtatcaagggtgcagattccaaatctgttatcaatacactcatattcaactcctttgtgttctgccaggtgttcaacgaaataaacagcagggaaatggagaagattaatgtttttcgtggtatggtcaccaactggatctttattgcaatcatagctgtgacagtcgtatttcaagtggtgatcatagaattcctcggcacttttgcaagtactgttccacttaactggcagcattggctgctaagcattggccttggatcggtcagcttgattatcggtgccatcttgaagtgcataccagttaccaaatcaaatgaagttcctgcaagtccaaatggctatgcgccgcttcccagcggtcctgatgacatatagctgaagaagagtgatggaaaaggaattgcatttggtagcaagaaacccttgtcccgcaattacacgtttttcccccctgtttgctgttgctgctatgtaaaaaagatggtgatgagcacaatgcagagcaatattttcatgggtcatggccctcatggaaacgaagttttcttgactgatccaagcaca

SEQ ID NO: 178 - DNA, 2745 bp, Sorghum bicolor
cgggacggccggagttcaacgtctgatgcgtttcctacatggcgctgacgaggctgctcatgatggcctcgcgcccgccgtgctcgctttcgctctcgctcccgtcgccgtcgtataagacatcgcggtgctgctgctgccactgccaccgcggtcgccgactcctccgcagcgcaatgcgggtaggagcctgccatgacctcagcaccgtcacgcccacgccgcggcagcagagtatggcggcgcagctcgagcgcgggtccctactggttggcgggcgcgagctcctcgtccgcgccccgcctaacgtcaccctacggcctgccggtgaggccgccgccgccgccgactcgggcgccgcgttcctcggagccacggcggcggcggcgtccagccgccacgtgttctccgtcggaaacctggcaagtgggtggaggtggctgtcactgttcaggttcaagatctggtggatgatcccggccacgggcgccggcgcggcggctatgccggcggagacgcagatgctgcttctggagtacaggagcgaggccaggacggagcgtggctcactgtacgcgctgatgctgccggttcttgacggcggcttccgggccagcctccaggggagccccgaggacgagctccagttctgcttcgagagcggtgatcctgatgtccagacgatggaagcagttgatgcagtgtttatcaactcaggggacaaccccttcaagcttctgaaggaatccatcaagatggtgtccaagatcaaaggaactttcagtcatatagaggacaaggagattccttcaaatttggactggtttgggtggtgcacttgggatgcattttacaaagctgttaacccaagtgggattgaggagggccttcaaagtctgcgtgaaggtggtgtgccaccaaggtttctgattatagatgatggctggcaagaaacagttgacgaattcaaggaaggggacgaagccatccgtgagcaggccgtatttgcgcataggctgagtgatctgaaggagaaccataagttcaggggagaaacctgcaagaatcttgaggacctcattaagaagataaaagaaaaacatggagtcaagtacatctacatgtggcatgctctacttggatattggggaggcgtcttagcaacatctgatgcgatgaagaagtataatccaaagcttctttacccagtccaatcaccgggtaatgttgcgaatctgagggatattgccatggacagcttggagaaatttggagtgggcatcgttgatcctgacaagatatatgagttctacaatgatcagcacagctacctttctagtgtgggtgtggatggagtgaaggttgatgttcagaacgtgttggaaactcttggacgcggacttggtggacgtgttgcagtaactcaaaagtatcagcaggctcttgaggaatccattgcccagaacttcaaaacaaacaacctaatctgctgcatgagtcacaattcagacagcatctttagtgccttgaagagtgcagttgctagagcctcagaagatttcatgcctagggaaccaacactgcaaactctgcacatcgcttctgtggcattcaatagcctattgttgggagagatcttcatacctgactgggatatgttccatagcaagcatgaatcagcggaatttcacggagctgctagagccctgagtggtggtggggtttatgtcagcgataaacctggggtgcatgatttcaatgttctaaaaaagcttgttctaccagacggctcgattctaagagcaaggtatgctggtcgtcctacacgcgattgtctgttcactgacccagtcatggatggcaaaagtctgctgaagatatggaacttgaacaatttcactggtgtcattggagtgttcaattgtcagggagctggacagtgggtttggccagtgaaagaaactgcttatgttcctatcaacgtaaacatcattggtcagctctcaccgtccgatgtagagtctctcgaggagatagctggtgatgattgggatggagagactgcagtatatgctttcggttcatgttctctttcaaggcttcagaagcacaaaagtttggaggtttcattgtctactatggcatgtgagatttacaacatttcaccaataaagattttcagcgaagccgtttggtttgcgcctcttggactgatcgacatgttcaactccggtggtgcacttcacaatgtttcaagtgttgcagattcttcagctacgaccgttcatatcagatgccgaggaccagggtggtttggggcgtattcagccaccaggccagagctttgcagagttgatgaacacgaagtggagttcactcatgcagaggatggcctgctgaccttttatctccccctttcttcctcccaggacaacctgagacacattgaaattgtctacagagctttatgaacgacatttacccttatgattcttacgctcaagcatgcaatttctgccgtgttcttcagtaaccataacacgtgcacattgaggtaatgttccaaagaaacattgttcttgttggatttgattgtgtagcagtatgctgtcctgcaaatatctgttgtatatgattgtcatgccttctgggctgctgtaatgtgatggacatggtatatataaactatgatgaagagagatttttgacatggcgccttactaaatgctgtcaggctgtcccaac

SEQ ID NO: 179 - DNA, 1470 bp, Sorghum bicolor
atcacctgtgagaggcaccgcctatggcaaccccgaccgtcgtcttgctgccggtctggggcgccggccatctcatgcccatggtagaagccggcaagcggctgctcgctagcggcagtaggcgggcgctctcggtcacggtgctcgtcatgcggccgccgacggagcagcacgcgtccgagctcgagggcgacatacgccgggcggaggaggccgccgccggcctcgacgtccgcttccaccgcctgcccgccgtcaagccgccgacggaccacgctggccccgtcgagttcatctcccgagtcgtgcagctgcacgcgccccacgtcagggcggccgtctcgagcctgtcatgcccggtggccgcgctcgtcctcgacctgttctgcaccccgttcgtcgacgtggcccgcgagctcgccgtgccggcgtatgtgtacttcacctgcaacgccgcggcgctctccttcttcctgcgcctgccggcgctgtgcgaggaggtggccggcgagttcggggagatggacggcgcggcggacatccccgggctgcccccggtgcccgcactctcgctcccgacgccaatcatggaaaggaagaagcctgattgcgcgtggtacgcgtgccacggcaggcgcttcatggacgccgacggcatcatcgtcaacacagccgccgagctcgagcagggcgtcctctccgccatcgccaagggccggtgcacgcgcgggaccgggagccggcctgctccgacgctgtacccgatcggcccggtgatctcgttccccccgccggccgcagagccgccgcacgagtgcctacggtggctggagtcccagcctccggcgtccgtggtcttcctctgcttcgggagcggagggttcttcaccgcgccgcgggcgcacgaggccgcccacggcctggagcgcagcgggcaccggttcctctgggtgctgcgcggcgcaccggcgcccgacacgaggagccccacggacgcggacctggcggagctgctcccggagggcttcgtcgagcggacgaggaacagggggctcgtgtggccgacggcagtgccgcagaaggagatcctcgcgcacgcggccgtgggcggcttcgtgacgcactgcgggtggaactcagtcctggagagcctgtggttcggcgtgcccatggcgccgtggccgctgtacgccgagcagcacctgaacgcgttcgcgctggtggccgccatgggcgtcgccgtggcgatggaggtggacaggaagagggacaacttcgtggaggcggcggagctggagcgggctgtgaaggcgctgatgggtgacggcgaggaggggaggaaggcgagggagaaggccgcggtggtgcaggcggcgtgccggaatgccgtcgacgatggcgggtcgtcgaccgctacgctgtcaaagctctgcaacgatatctgtcgacagtgactgtggaggtcgcttt

SEQ ID NO: 180 - DNA, 1372 bp, Sorghum bicolor
ctgctcttcccttccctgatccccagatgtccccgggccggcccccctcttcacccgtccgttcttaaaccctgcgtaagcctcgtctcgtcctcgttccccaacacaggcccctcctccttcggcaggtcgctgcctccctgcagcctcttcgttctcctctttccgtgtggtggcgcggctccggccgggggaaaaggaaggcgtgggtgcacgtacgccgggaaggagaagaagcgcacgccccgctcgctctgccgctggttcggtcttccccgccggtgacacagacagctcgtgccgtctccaccgcaatcgatccccctgttgctcgatcgctctccttccgcacgcagtggactgtcgccgttgatcctgcaggaaaaaccgggtgggcaaggaagctagtgagcccagggtgaagaagatgatgatggctgaggtggccaaccacagcaaaaggaaccacaccgacagctacttcagtggcaaagccgccgccgtcgccgtcgcggccaccggcccagaggagttcgcaagcatgtcctcgaagaagccgaggaataccagcccgagaatcgcgcccgtatcaccaaaggagaagaaggacaagatcggcgagagagtcgcggcgctccagcagctagtgtcaccatttggaaagaccgatacggcttctgttctgcaggaagcatcgggctacatcaagttcctgcaccagcaactcgaggtcctgagctccccttacatgcgtgctcctccggctcccggcgctgtgcctgaggaccccgagcactacagcctccggaaccgcgggctgtgcctggtgccggtggacctgacgctgcagctgacccagagcaatggggccgacctgtgggcgccggcgaacacgaccaggcgcaggtgaggagaagcctgtcggcctcgctccttcaccatcaccaggaggagccggcctgggcctggtctgcccggaggaaaccaagcaagtactactgcatctgcatgtgcgccgtggagtagaatttccaagcgcctgacccgattcgatctcctaacaagaaactaagcaaagcgtcatcgtccgtatcagccaccttgtattatactcctgtactagtgacctgtctggtctctctctccttgtcgccgtatatgtgtgatcatcagctgatcacatgtggaaatggcccagaactgcatgcgtctctgtgtggtactagtactatgtaactatgtgtttagtgacatgtgaattttagcagtctgtggctgtcagcaagtaaagcggcagtttaatgcctgttccttgagatgcctagtgttaccgatttcggtttgccatgtgtctgctgtatgctctctctct

SEQ ID NO: 181 - DNA, 1757 bp, Sorghum bicolor
tggagctttaccctggatatctccaagaccatttcaacatccacaaactcagtcgcctggcgacgagcggcgccgcaccgggccgctacgtgacctcgggacccgccgtcggcggcggggccacggccatggggatctacgagcggcagcgccacctggtggcggccggcgtgtccgtgtggggggagccgttccggcccgacgccgacgccctgcccctgtccgcggtcgtccccacggtcaccctggcgacgccgccggcgccgccgcttgacgtcgtcgaagcagaggaagtcaagttcggcaaacaccagctgttacaggcacagcagtacgacttcccgccgcaggtggaagaagaagcgccgccgccgtcgtcggatagcttcggccacgaccacgacgacgacgccgcccggccaagagacaagattcagagacgcctcgcgcagaacagagaggcagctcggaagagccggctccggaagaaggcgtacatccagaatctcgagacgagccggatgaagctggcgcagctggagcaggagctcaccatggccaggcgccagcagcagcagcagcagcacggcgcgtacggcgttggaggaggaggaggaggagtcgcggcggcggcgggcgcggacccgcgggtggccgcgttcgagctggagtacgcgcgctgggtggaggagcaggggaggcaggcgacggagctgcgggcggcgctgcagtcgcacgcgccggaggtgcagctgcgggtgctcgtcgacgccgggctggcgcactacggcgcgctgttccaggccaaggcgcaggcggcgcggtccgacgccttcttcgtgctgtcgggggtgtggcgggcccccgcggagcggttcttcctctggatcggcgggttccgcccctccgagctgctcaaggtgctggcgccgcggctgaacccgctcatggaccaccaggcggccgaggtgcgcaagctgcagaacacggcgaggcagctggaggacgcgctgtcgcagggcatgagcaagctgcagcagacgctcgtcgacgccctcatgaccgtcgacgtcgcctcgccgctcggcgccggcggcgggtacgcggcgcagcagatggccagcgccgtcggcaagctcgccgacctcgtcgacttcgtggacaaggcggaccatctccggcagcagacgctgcggaacatgcacaagatcctgacgccgcggcaggcggcgcggggcctgctcgcgctcgcggactacggccagcggctgcgcgcgctcagctcgctctgggcggcgcgcccgcgggagccggcgtaagtgtaacggaacacccccgcgacggcgacggcgacggcgacggagaagaggaagcggcattacaggcacgtgcgcgcgtggttggctttggctgccgccccggacggccggcggagcaaggctgcggcggtcagtgcctcagtctcctctccttccagctctgcatctggtattctggtacgggcaaccggcgtgttcttctgttggctctcaggatgaaacctgaatcttctaatggtgttacagttacagcagtgaattaggctttgaatttgattgacagatcaaagaagttaattacaagtgtaaatacagtatacaaagttgtttgggtaggagtaggacaggcttttattgttcagttgctcttgtctcggtcaacctgtaaacagatcatgcgaaagatgtacaatgaacaatctatggagtgttaacaca

SEQ ID NO: 182 - DNA, 1486 bp, Sorghum bicolor
taaatcggaacgcgacgccacaatcccgcactgcgccgccgccaccgccaccgctctgccctgtccgctgctcgccgctctcttgcccgctccctttcccaacgttattaacccacgcaatcggaccggcgcacacgacgccgccctcccatctctcgaatcccaccgtgctcagcgcgatggacggctcatccaagcggatcgacggtggcggcgccgacaagcccagccccgacaacgaccagaaccagaacgctagccccaacgtaccggcggcgtccgccgccggagacgacggcgcctcggtcgctgctgcggcggcggcggctgccgcgccgcccgccgacgggaggcggccgttcaccagcctcagccaagaggaggccgacctcgccctcgcccgcgttctccaggagcaggagcgggcgtacatgatgctgaccggcggcgagtacgcgatctcggacgccgggagctacgactacgacgaggaggagggggaagatgacgacgatgggagcgactacgaggaggaaggggaggcgctcgacgaggacgagcaggttggggacgcggaagcggagggggccgagggggaccaggacctggaccttgaccctgcgcagtacgaggacgacgaggccttcgcgcgcgccctgcaggacgccgaggagcgcgacgtcgccgacaggctcatggcgctcgttgggatcggtgattggcgagccatggagcaggatgatgctggggaccacgaggaggacgaagatgatggggttcatacacaggatgcatgggaagatgttgatccagacgaatactcttatgaggagctaattgcattgggtgaagttgtcggtacagaaagcaaaggccttgctgctgatactattgcttcattaccttcggtaacttaccatgcacaagacaagcaagatggcaacatggaacaatgtgttatttgtcgtgtggagtttgacgaaggcgagtcattagttgcacttccttgcaaacatccttatcattctgagtgcataaaccagtggctgcagttaaacaaggtatgcccgatgtgcagtgctgaagtttccacctctgcgaacaatgtgaacaagcaggcatgactattcagttggaagaaaatagcggcggcttgatttatctgccattgctgaaatgaaagtagtgccaactgttgaattgttctgataagcaagggaaatggatgggtctgtttccctgttttctttagttcaacaggcttagtcccccctgtacctgctgctaattttatggccctgccgctggttatttatgcattccattagacttattcattcatgattcattgcttgtagatgtaaaacaacaatcataccaatagccagtagccattgttttaatatttgtctgatctttccatgttcaaaacggtcgcatccccccccccctaatttgagacggggcaattgttcctgaagctgcc

SEQ ID NO: 183 - DNA, 2419 bp, Sorghum bicolor
accatccccccctctccctcccactccgaggcccgacccgacccggcccgccggaaccctagcctccccgccccccgcctccgcccgatctcccgatcgccggattcgtgccgccgcgggatggactcggacgtggagatgaacgccgccagcgacgaggaggtgatggacgacgaggactactacgactactgcgacagcgacatgggcgatgacggcgacggcgggagcgaggaggaagaggagctggtggccggggactacgacgagggcatcgaggccgaggggaccgacgaggtggtgtctaggcgtgagcagacatttgtggttttaaacgaagaagttatatctgagcgtcaagcggaagatgtaagcaaggtatctgccgtgttgttgatcacaagggaagaggcgtgtgccctcctgcatcactataaatggaacatcagcaagttgagtgacgaatggtttgcagatgaagaaaaagtccgccatactgttggcttacttttgaatggaaatcatgatccctgctctaggaagctaacttgtggaatatgttttgaagggtattcttctgatatgatgagctccgctggttgtgctcatttttattgccatgaatgctgggaaggctacattagtgctgcaataggtggtggtccaggatgtttgtcattgagatgccctgatccatcatgtagtgctatggttcttcaagggatgattaataaattagctaaagatgaggataaagaaaaatatgcacgatttctcttacgtgcatatgttgaaggtagcaagaagactaaatggtgtccagctcctgactgtacatgtgctgtggagtttcttggtgatgaaaactatgatgtctcatgcaattgcaagttcagcttttgctggaattgcactgaggaagctcatcgaccagtgaactgcgagactgtttctaagtggatattaaagaacagtgcagaatctgaaaacatgaactggatactggctaattctaagccctgtccgaagtgcaaacggccaatagagaaaaaccagggatgcatgcatatgacatgcacccctccttgcaaattcgaattttgctggttatgtctgggcgcatggtcagatcatggagagagaacaggtggcttttatgcttgcaatcgttatgaatcagcaaagaaagagggagtttatgatgagactgaagcaaggagggaaagagctaagaactctcttgagagatatatgcattactatgaacgctgggcatccaatcagacatcgaggcagaaggcccaagcagatctgctaaaagcggaaaaggatcagcttgcaaatttaactgacatttttgggataccagagacccagcttaagttcataattgaagcttggtcacagattatagaatgcaggcgagtgctgaaatggacatatgcttatggctactatctggatgataaggtcaagagtgaattttttgagtatctgcaaggtgaggctgagtctggcttggaacgtcttcatcagtgcgctgagaaagacttgcaaaaatttttgccttctgtgaaatctgacagcactgaaacgacggcaccaacaccggatgaatttagtgaattccgcgtaaagcttgctgggctcacaagcgttactcgtaattactttgagaaccttgttcaagctttggaagctgggttggaggatgtccgtgccactgcccaggctgctggtacatccagcgctgccaccagctccaagaaaggaggaactaaatccaagaagaagcagcccactaagccatcatctgaccacactgatgatgggtggccctgcgagcgctgcacatttcttaaccctccctcagtggatgcgtgcagcgtctgcgaaaagagtaggtactagatgatggaatagctcaaagggaggcaccccaagaaaagctcaaagttcatgagaaggaggggcgctttagatccagcatcagatgctgagcttccagcagctgcaatggtgtacagagagttatttaagggcctcaaatggttggaaacggagtgaaggctcaaatgtttacgtgtgtgtggtggttgggtggggttcatttggtttcctagttcgtttctgttgttccttgtaaatattagttgtgaagtggtaacctgtgtgttatgtggtgggttttgcttctgaccaatctgtgaaattgaactttcacaaaactgatgggaggtagctctgtttattccctcgtaattgcgggcagggcctttgtctgttatctaatgactggttacttgccatctgctagtgctggtaaatattactccaaaccgaacatcgcctgatttctgttttcccatatatagaacataaactgtaacctcaaccttatgtccgcatctctttcttc

SEQ ID NO: 184 - DNA, 1769 bp, Sorghum bicolor
ctctcgcctggtcgcttctttcctacgactcgcagcttcgccgtcgccgctcttcttctccttcccctacagataaagcgggtggctggcttggaagccttgcggtggagacggcggtctcggatccaacggaggcacccagatttgctgccatggcgaggtgggcggagatggtggaggacgacgacgacgacgagtacgctaagctggtcagaaggatgaacccaccaagagtggtcatcgacaatgacgcgtgtgacaacgcaactgtcatccgggttgatagggtcaagaagcatggcattttactggaagcagttcaagtccttgtcgatctcaacctcgtcatcaccaaggcatacatttcttcggacggcaattggttcatggatgtgttcaatgtgaccgatcaggacgggagtaagcttcagaacagggaggtcattgaccatattcagaaatgcctggaatcagacggctacctgcctcctccggcaaacggcggctttgtgccaccggaagaccagttcacctccattgagctgaccggcgcggaccgcccgggcctcctctcggaggtgtgtgcagtgctcgccgccctgagctgcaacatcgtgaaggccgaggtgtggacgcatgacaggcgcgccgccgccgtgatccagatcaccgacgaggccacagggctcgccatccacgacgtgggccggctgtccagggcgcaggagcttctcagcaacttgatgcagagcgacggcaggtgcaaccgcggcgccacgggcgtgtccgtgggcaccgcacgcacggagaggcgcctgcacaagatgatgctggatgaccgcgtcggcggtggcgaggaggctgttggtggtggcgaggagaggggcggctgtggcaaggctaggcacaaggctgccaaggtggtggtgatggactgcacggagaggcagtacacggtggtgatcctgcggtgcagggaccggccgaagctgctcttcgacacgctgtgcgcgctcaacgacctgcagtacgtcgtgttccacggcacggtcgacgccgagggtgccagcaaggaggcctaccaagagtactacatccggcacgtcgacggccacccggtgcgcgccgacgccgagcggacccgcctcgtccggtgcctggaggccgccgtcgagaggcgcgcgtccaacgggctggagcttgagctggaggtgaggacggaggacagggtgggcctgctgtcggagatcacgcgcgtgttccgggagaacagcctctccatcatccgggcggcgatcacgaccaaggacggcaaggcggaggacacgttctacgtgtcggacacgtacggcaaccccgtcgacggcaggaccatagacgcggtgggcgagcagctcgggcacgccgtgctgagggtgaagcgccgcggccacgacgcgtcggtcaagcacgaggccgagggcggcgcagtgtccgtcctgggcagcctgctcaagggctccttccagggtctcaggctcatcagatcctactcataaaccgtaatccaagaagtctgactagttacacaagatctgggcattgtacatagctttgattagttacacaagacctgggcatgggcattgtacataataactctgattagttacacaagacctggccattgtacatatataaatctgatgtaggttaggaaatagtgcagcagcagaacatggttcctgctttgtgcatttgcagtcaatcacataccattacaagtgcaa

SEQ ID NO: 185 - DNA, 527 bp, Sorghum bicolor
aaagaatgacaaaagatgagactctactagtcttcactcttgtggtttcctcggtttctattttcttattcgggatcttgcttttcagggttctcatctctgcaactcgcgattttcgcgagagaaccaaatccaagttggtgaagatcatgatttgggctggcatagtagttattacctttgcaattgcggttcgaatctatccgatctttatctttttgctcaaagaacgaataaaaccccttgttgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttag

SEQ ID NO: 186 - DNA, 2259 bp, Sorghum bicolor
cctcctctgccaattccccatcgtcgtcttgtcttgtgtatccttttcgtcctgtcctctgccccttctccgggttaactcttcatcctcaccaagaaaaaagaaatcgatcgtcatcgtcctcgttcctgccgtcgttctttcctcgccattaccggcgtataaaagcaccaactctcggccagcctgatcacacaacgaacagtcggccacaaagcaggagtccctatttgtctatctgtctgtctgactgcctgccgctctcgtcatcgtcgccgggcatgggcctgttcagctcgccgccgaaggtgtacaagccggccgccgacgtggacctcggcgccggcagcgacgagttctacatcagccccaatgtcaaagctcctcgggtcgccgggctcctggtgaagatcttcgtgtggatcctggagatgcccatcgtcggcccgatcgtcctctacatcctcaagaaggacaacctcatcaacaagctggtctctgacgccgacatcccggagccgccgctgttcacggcaacgcacagctgggaagacatcccggagcagaacgtgcggctgacgaagccggacctgtcggcggcggagcgggtgcaggaggccgtcggctgcctcccggcgcggctggaagccacgctggccgccgacgcgccgtcggtggggctcaggcgctggaccgtccgggacttccacgacgcgtacaggtccggcgagacgacgcccgtgcaggtggccacgaggttcctcgcggcggtgagggagagctcgagctcggcgggacctgctgggatgaacatggctttcttcatcagctgcgaccacgacgacgtcatgcggcaggccgaggaatccaccctccggtaccagagaggggcgccgctgtcggcgctggacggcgtgctggtgggcgtgaaggacgagatcgactgcgtgccgtacccgaccaccggcggcacgcggtggctgggcgcggcgcggcgctgcgaggcggacgcggcgtgcgtggcgcagctgcgggcctgcggcgccgtcctcgccggcaaggccaacatgcacgagctcggcgccggcaccagcggcatcaacccgcaccacgggtcgacgaggaacccgtacaacgccagcaaggtcgccggcggctcctccagcggctccgccgccgtcgtctgcgccggcctctgccccgtcgcgctcggcgtcgacggaggcggctccgtccggatgccggcggcgctgtgcggcgtggtcgggttcaagcccaccgccgggcgcctctccaacgccggcgtcctcccgctcaactggaccgtcgggatgccgggcatcctggccgggaccgtcgaggacgccctcatcgcctactcggcgatcgtcgatcagtcccagccatcctacttgcggccggaactgaatcttcctcagctcagctccacgccctccatcggcaacatcaagctcgccaaatacggaaagtggttcaatgacagcgctgaggacatcaggagctgctgcgacaaggctctgcaggcgctgcacgcgcactacggctggcagacggtggacgtgacgatcccggagatcgaggagatgcggctggcgcactatgtcaccatcggctccgagtgcaccacgtcgctcgccaaatacctcgacaacctgaagaggtctgagatcgggtgggacgcgagggtggcgctcagcgtctacggctccttcagcagcagggcgtacctcaactcgcagcgactccggaaccgtcagatgtacttccacaagcagatcttcaagaccgctgacgtcatcgtctcgcccatgaccggtgtgactgcctacacgctgcaagacgacgcactcaacaccggcgagctcgactacataaacggagcggcgctggtccggtactccatagccggcaacttcctgggcctgccggcgatcaccgtgaaggtcgggtacgacaggggcggcctccccatcgggctgcagttcatcggcaggccgtggtccgaggccaccctgctccacgtcgccttcgccacgcagcaggcctgcgccgacggctacaagaagcccgcggtcttctacgacctcctcaccaaacaacaccagtgaaaagcatgatcagcgatcgccgccgccggcgagccagagaggacgtgttttgatcacaggcgtagtgggatatgccggccggacgattcatcggagacgaagattagaagattcgtagctggaaaactag

SEQ ID NO: 187 - DNA, 2484 bp, Sorghum bicolor
gtgacaaaaaaaaaatattgtgaggtataccaaataggcccataaagctggcaatggaagaagtggtctcgtgacaaaaaaaaaaaaaatcccttttcccacccccgcgtgcgctagctttctctcaatccgcctcgctcgcggcgacggctgggcgtctgcccccgccgccgccgtcgccctactccaggtgcgtaggtcatctccgggcccatcaccggcgacgagcacccgccaggggcgtggaagcctggagtcctatctgatcggaaaatggttaagatcgaagaccatgccgaggacggcggcatagatgctgatgtcaggggcctcggggaggctgctgtggatccgctgcctggctcggtgcatgccaccttcaaggaggaggagggtgaaccgagttcttcatctggtaaactaagatcagagttcattggaatgggtttctcatccaagctggtagacaaggttctccagagacatggtgatgatgattctaacacaattttggaatctcttctgtcctattctgaccttaagcaatctggatccgagtcatcgggttctcttggaagtttatttgattctgataatgaagagaacaattcttctttagagtctaggaaagtaatcaaccaagacatcaagccagagcttgattctttctcagagaagtggtcatttttactcagaacaatgaacttttcacaacaagaagttgatttagccttcaagcaactaggtgatgaagcgccattagaacagctcgtggacttcattgtcaatgctcaatcaggagtatcgtctggaggaccggaaaatggtgatgctacaaatgaggggaagactgaattactctatggtgtgatggaaaaaacacttagcttgcttcagatgggctttaccgaggaagaggtatcatcagtgcttgagaattctgaccagagagcaactattcaggagctggctgactcaattttggcaaggcgaatagccaatagcattgagcagaaagaggtaaaaattgaatctgactttctaggcgaggcagaacctgattattcttcataccagccctcatactctgctgcaagctattatgacgatgacaacaacaatatacgggttaaaagggctaagcatgtatttatcgatgacacaggtgcctccagtagtcaccttggcaatccatggtctatggggacaagtgatatgcctgttaaggtagaacttgaggcaatgacaccaggccgccgtgcaaatgtacaaggtgaccttgctaaacccccatttttcttgtatggaaatatggtagacatcccaaaagacacatggtatcaactcacacagttcttatacaatgtggagcctgagtttgtgaacagtcagtccttctctgctctgactcgaaaggaaggttacattcacaaccttccagtggagaaaagacgtgtcgtggttccaaagtctccaatgactattgaagaagcacttccgttcaccagacagtggtggccctcttgggatacaaggaaacatatcagtgtagttactatagaggttggagagattgagcagacatgtgaaagattggggagcatggttagagagtcaagaggtgtgctttcagaagcaagacagatgcagattatacaccagtgcagggtttcaaaccttatttgggttggccagaacaagttaggccctttggagcctcgtcaagtggaaaggatactaggctacccacataaccatacaaatctgtttgaattaaaccaatctgatagatttggtgccatgaaatttgcatttcagactgatacattgtcatattttctatcagtcctgaaaggcatgtatccagatggaataagagtgctatccatctacagtggcattggaggtgcagaagtaacacttcatcggctaggcattcctttaaaatgtgtaatatctgttgaggaatctgaggtgaataggaaaattctaagaaggtggtggtcaaaaactgaacaaactggagtgctaaggcagcatccgggaatctggaagctcaaaacacacgtgattgaagacttggtgaaagagtttggtggttttgatctgattatcggtgggaattatacttcttgcaaaggtggtaatacagtaaatacgacaatgggcttggattccaaccgcttctatgagtatgcccgtgttgttaaaagagtaaggactgcagttggactcagttgatgagtccatctttgatgaagagcgcacatcttcataaaactagcctgtaggaggatgtagaatcatctgatgtgtaaatgtaggatgctatgagtaaactttgacaagaggatggtacaagtaaacttgacaagtcttgggacttgattattgcaagtgattgacttatccttcattctggtttgtgtttgttggtcacttctaatctttgataattattctttgttgctcctttcaaaatct

SEQ ID NO: 188 - DNA, 2550 bp, Sorghum bicolor
gctgctgctgctgctgccgcctggcggtggtctccctcacttgacgcctcagctaacaccaccctcgtttctctctctctctctctctctttcccccccactccatgtgggtggcctcgagctctgcttagatcacagctgtgcgcgctggttgggtgatccactgatccgcccccttccccccttgtcggctctcctttctttcagcccgagagctccgggacagggagatctgcgctgtcgccgcgctcgcctcgcctttcttgcgcgcgcgcgtgtgggctgggcagcagtgagcttcccccgtcttcctcagcctcgcttcccttcttcctgctggatctggctcgcaagatccgacgtttcgtgccccgtttgctcaaagatcctcgcttgggtggtggttcctggagatttctgggaggatgcagcacgaccagaagaagaaggcaccttcagagatggattttttcacggagtatggcgagggaagcaggtacaagatagaggaggtcataggcaaaggcagctacggcgtggtttgctctgccatggacactcatactggcgaaaaggtggctataaagaagataaacgacatcttcgagcacgtgtctgatgcgacgcggatacttcgggagatcaagctgcttaggctcctgcggcatccggatattgtggagataaagcatatcctgctccctccgtcgaggagggagttcagggatatatatgttgtttttgaactcatggagtctgatttgcaccaagttataaaggctaacgatgacttgaccccggagcattatcagtttttcttgtatcagctgcttcgaggattgaaatacatacatacagcaaatgtatttcatcgagatctcaaaccaaaaaatattctggcaaatgctgattgtaagcttaaaatatgcgactttggcctagcaagagtagctttcaatgatactccaactgccatcttttggacggattatgttgcaacaaggtggtaccgagcaccagagctgtgcggatctttcttctccaagtatacaccggcgatagatatatggagtattggttgtatatttgcagaattgttaactggaaaacctcttttcccggggaaaaatgtggtacatcaacttgatataattacagatctcctgggaacaccttctccagaagcaatatcgaggattcgtaatgaaaaggccaggcgctacttgagcagtatgaggcggaaaaagccgattccgtttacacaaaagttcccaaatgcagatccacttgcactaagtttgttagagcgaatgctagcttttgagccaaaagacaggccaagtgctgaagaggctcttgctgatccttatttcaagaacatagccaatgtagatagagagccttctgcacaggctgtcacaaagcttgaatttgaattcgagaggcggagagttacaaaggaagacataagggaactcatatatagggaaattcttgagtatcatccaaagatgctgagggagtttcttgagggaactgagtcaagtggtttcatgtacccaagtgcagtagaccattttaaaaagcagtttgcgtaccttgaagaacattatgccaagggatctacaggaactccacctgagaggcaacataattcattgccacggccttctgttgtctattcggacaaccgatcacaaaccacagccaacatcaccgaggatctttccaagtgtataatcagagaaaatacacaaaagccacatcaacattctgcttatgttgcaagtaaatttccaccccatgttcctcaaggtgttgttgcaaggcctggtaaagcggttggttcggtgatgcagtacaacccctatccagcatctgctgccgagcaatatgagcaacgaagaattgctaggcacccagcagttgccccaaacaatatcccttctggaagctcatacccgagaagaagtcagacctgcaagagtgagacaggtgatgctgaaaggatggatgtgaaccaagctgggcagccaaagccatatgcagcgaacaaattaccagctacggttgatggtcgtggtggccactggtagaatttctgcagtgcaccagcaaaccatttcaatccatttcttaacatgttatcagtatcgactacttatgctaagcgctacattattctgacaaaattcagaaatgtagttctgtacagatttatattctttgtcaggatacctgaatacccaaagactgtagaactgtactctttattgctgatttctactccttgttgctattcaatcacaaaaagatacgtgcctggtggagaggatttgccagactgaagtatagtgggaactcactggcagcagtgggatctcagtgcagagttcttgcctgacgttgtcatggacttgttcttcaatctggtagccctgaagagtaactaaatagctagtatttcctgttaatcatctacagtcaggcgcggaatgttttgggagttaggagctgctaggtctgaatatgaagtaattgctgtaatct

SEQ ID NO: 189 - DNA, 1743 bp, Sorghum bicolor
agcagcaaagacggcgagacagaggagatcaatcaatgtattaccagccgagctgagctgagctgagctgagctgatcaccctctctccttcccccaccgtccccgttctctctcacaagaatcactctcctctcagatctcacagccaaaaagagaggagctttaaccgccgggtacggtgggctcaaaggtagccatggccaggcggcggccaccaccattccacgcccgtgtcgccgccgccgtgttcctgctgctgctgctgacccccgccccgacctcccagctcggcctgggcgccgccattgccgcctggatccacggctcgccgcctgctcctcctagccctagcactgacgacgacaccgccaccgcctcctcctcgggcgcgccggccagcagcccacggagccaggagtacgcggcgctgcaggcgctgaaggcggccgtcaccgaggaccccaatggcgcgctgtcctcgtggcagggcgccaatgtgtgcgcctacaagggcgtgtactgctccgcgccgcccgacggcgcagccgccgccgcggccggcgcgttgtccacggtggtcgccggcatcgacctcaaccgcgccaacctgaggggcacgctccccgacgcgatgtccctgctcgcgcacctcacgttcctgcacctcaacagcaaccgcctcggtggcgccgtccccgacacgctccgggacctgcagtacctgacggagctggacctcagcaacaacctcttctccggcccgttcccgtcctccacgctgctcatcccgtcgctggtgtacctcgacctccgcttcaacgccttctccggggaggtcccgccggaggtcttcgccaaagagctagacgccgtgttcctcaacgacaaccagttcgaaggccagatcccggacacgctatggggttccccggcgacggtcatcacgctggccaacaaccacttcaccggcgccgtcccggccgcctacgagttcggcgccggcggcggcggccgggtccgcgaggtgctgttcctcaacaacaacctgacggggtgcgtgccggaggcgctggggttcctccccagcatcgaggtgctggacctgagctacaacgcgctgtcgggccacgtccccgggacgctgtcgtgcctgtccgggatcgaggtgctcaacctcgcgcacaaccagctgaccggcgagctcccggacctgctgtgcgacctgcggcggatcaccaacctgtccgtgtccttcaacttcttctccgggatcagccagcggtgcgaccggcagctcgggagccgcggcgtgtttgacttcgtggggaactgcgtgccggggagggacatgcagcggccgcagcccgagtgcgacgagttcccgggggaaggaggactcagctgcctccacatccccggggcgcgcccagccgggtgcgacggcggcggcggcggcggcgtgactattggcgtcggcgttggagttggtgttggcgggctgccgttcggcctgcctggcgccgccgccggaggcgtggtcaccgtcaccgtgccgtgatctgccgccgggggcggggccggccaccttgcacctcgatctttctttgggtttcgtttcttccttttgctttcgggaggcaatttattaacctcgatcatcggctttggcgtaacgtacacatcgatggtaatggggtgaatattggttggttctcggctggttaatactcccatttttcgcc

SEQ ID NO: 190 - DNA, 2399 bp, Sorghum bicolor
acagcagcagtaacaatggctagcggcgcgacgagcgacgcgtggccatcctccccctactcctcgtcggcgcccgacggggaggtcctacgctccctgcaccgcctggcgcgggacctgtctgcagccgaggcaccggcgccgttcctccgggcggtcttcgcggcggtggcgaggcgggcgcgcctgctggcggccgtgttcgacgacctcctcctctgcggcgctgccgcgggcccgctgctcctacttccgcggtccgcgtcgctgtgcctccgggagctcctgctggtgctgcagcggttcaaggcgctggtggccgactgcgccgcgcgcagccgcacgcgcctgctgctccagtcggacgaggtggcggcccgggcgcgggagctccagcacgacctcgccacgctcctcgacctgctccccgtcgccgacctcggcctcgccgacgacgtgtcggacctcctggcgctcgcgtcgcggcagtgccgccgcgcggtcgcggcaccggagctggagctcaaggcgggcgtgctcgcgctcatccaggaggtggagcgggagatcgtgccggggcgggagaggctggagggcgtactggaggacgtgggcatcaatgatccggctagctgtagcgacgagatcgagaccctggagcgagagatcggcgaccgtgtcgctgagaggtggacgtcgtcgatgatcgccctcgtcggcctcctccgctacgccaagtgcgtcctcttcagtgccgccacgccgcggcccgtggactccaacaaggtggatctcgacgacggcgacggcgacgacggcgcggagccaccgtcgccaccgctggatttcaggtgccccatctccctcgagctgatggccgatcccgtcgtggcttctagcggtcagacgtacgaccgcgactccatcacgcggtggttcggctccggcaaatccacgtgccccaagaccgggcaggtgctgccgaatctggagctcgtgcccaacaaggcgctcaagaacttgatatcgcggtggtgccgggagaacggcatccccatggagagcagcgagtctgggaaatccgagccggcgccggtggtggtaggcgcgaacaaggccgcgcagaaggcggcgcggatgaccgcgtcgttcctggtgaagaagctgtcggcctcgttctcccccgaggcgaccaagcgcgtggtgcaggagatccggcagctggccaagtccgggtccgacaaccgcgccttcatcggggaggccggcgccgcggggctcctcgtgccgctgctccggtccgaggactcggctctgcagctcaacgccgtcacggcgctgctcaacctctccatcctggaggccaacaagaagcgcatcatgcacgccgagggcgccgtggacgcgctctgccacgtgatgtgctcgggcgccacgtggcgcgccaaggagaacgccgcggccacggtcctcagccttgcggccgtgcacgcgtaccgccgccggctcggccggaacccgcgcgtcgtcgacagcgtggtgcagctcgcgcgcacgggccccgccagcaccaagaaggacgccctcgcggcgctcctgtgcctgtccgccgagcgcgagaacgtcccgaggatcgtcgaggccggcgccgcggaggcggcgctgtcggcgatcggcgacgcggaggcagccgcggccgtgctggcgtccctggcgaagcgcggcggcgcggaggcgatcgtggcgctggacggcgccgtggcgcggctggtggccgagatgcggcgcggcacggagtggtcgcgggagtgcgcggccgccgcgctggtgctgctgtgccggcgcgcgggcgccgccgccgcgtcacaggtgatggccgtcccgggcgtggagtgggccatctgggagctgctgggcaccggcacggagcgcgcgcgtcgcaaggccgcgtcgctcggcagggcgtgccgacggtgggccgctgccgccaacgcggagcagggcaccgagtgccccacctccggcgacgcgtcggggctcacggtggcgtcgtgaaatccactactacacgatcagtatagtagatagaagctcaaaaaaagaagcgaagccattttttttttaccacgattcttgtacaaaatttgttgttggccgtcaaggccttcacgattctttggtccgtgatttgggccgtgggtaattgatcaactgtgaatacaagatactagtactgtagtacgttttttttccctttttcatcaaacatttgttacctattgtcatgtctcaagaaaatacaaaggaaagcaacaaaatcgctcgaaccagtgacttgagctccattgttgtgacgtccgcattccaaacaagcgcaattaacgttgtcgtctgttccc

SEQ ID NO: 191 - DNA, 1741 bp, Sorghum bicolor
gccctccacaacaccgttctccattccatatcccccatatatcaagaactcgggctaccccccagatccaattccccagcatcagaagcaactgcatgtacttctgcacaggtagccacgagagaccaaaaactaagctgcgatgaagaagaccgtcgtcctgtaccccggcctcgccgtcagccacttcgtccccatgctgcagctcgccgacgtccttctggaggagggctacgccgtcgtggtcccgttcatcgaccccactgagaaaggagatatcgccttggccgccgtcatcgaccgtgtcgccgcctccaagccgtccgtggtcttccacgtgttgccaaggaccgaggactctccatgcacctttgtccacgactcggagttcatcgtcaggtacttggaaatcgtgggccgctacagccagcacctccacgacttcctcctctccatgcctcctggcagcgtccacgccctgatcgtcgacatgctgtctatcgaggtgctcgacgtcaccaccaagctcggcatcccggcttacgccttcttccccccgaatgcctccgcccttgccgtgtccgtccaggctgcatcacttcattcagaagggcagcagccaagtttcggggagctaggagacgcgcctctaaacatccatggcgtgccacctatgccagcttcccatctcaatgctgaaatgctcgacgatccagggagtgccactctcaaggcaacggtgaacatgtttcgcagaatacaagaagccaatggaatactagtgaacacgtttgcatccatcgagcctcgtgcggtgtcagccctcagcgatccacggagtttcccgaaaatgcctccggtgtactgcatcgggccgttggtcaccggtaagggcagccagggaacagagaagaagcacgagtgcctggcatggctcgacgagcagccggagcagagcgtagtgtttctctgttttggaagcacaggcgccggcaaccattcagaggagcagctaaaggagatagccactggcctggagaggtccggccaccggttcctgtgggtggtgcgcgcgcctccccacgacgacccggagaagccgttcgactcccgcgcggacccggacctcgacgcgcttctgcccgcgggtttcttggagaggaccggcggtcgcggccgcgtcgtcaagctgtgggcgccgcaggtggaggtgctccaccacgcggcgacaggggcgttcgtgacgcattgtgggtggaactcggtgctggaggggatcatcgcgggggtgccgatgctctgctggcctctgtacgcggagcagaagatgaacaaggtgttcatggtggaggaatatggagtcggggtggagctggtcggttggcagcagggactggtgaaggccgaggaggtggaggccaaggtgacgttggtgatggagtcggaagaaggcaagctgctcagggcacgggtgtccaagcacaaggaaggtgcggcaatggcatggaaggatggcggttcgtcgcgcgctgcgtttgcccagttcctgtcgcacgcaggcaacgccacgggcaggggctgagcctgacacgcccttgatgccggaggtcagcaccaaattggtggtagctttcctatctttcatctttgtatcttggaccaagacaaataatatagctcgctactggttgtgtgaacgaatccacctattagctcacacatacggtagttagctcacatg

SEQ ID NO: 192 - DNA, 1987 bp, Sorghum bicolor
cattgctgtgcgctctccggctctccgctcctctctgttgtgtcctcgccgtcagatttcgcaagaaccttcgttccctgcgatctctcgtcggtttggtcggccgagatggttgatctgtagagcgagacgccgagcccggagagagagagaggaaggagtgcaccggcaattgtagaaaccagcaccggcggaggatttgaggacgccgattcgatgcgcggctccgcggacgccgtcgcggttgctcgggacgtggcctcgtcgagcccgtcgaagcccccgtcggcattggacatgatgagatacccgaggccgagctcagacggcctcccgctgcccaatggcatcggcagcggcgtgagcaagaagcctgcagcggcggcggctccggctccaccggcacccagatcgagcaaggatgacgtggcgccgccgaccgtcgccaccgacagctcccgcctcgcggcgttccttgccacgacgtcgctcgagtccaagccgcgccctcgcgtgccgcaggtgcagccacagccacagccgccggcacaggccgcacctacctcggcgcccactgccgccgccgcggtgaccaagagccccgcgcgcgaccagggccacggcggcagcggccaacacccctcctccgaccactccgaccccgcctccccgagctccaccggagccggcgaattgctgctccagtggggacagaacaagcgcatgcggtgccgccgcgactccgcgtccgcgtccgcgtcgccgcagcgccggcaggcgggcggcaacaagatccagcgccggtcgtcgtccccactgccggcggcggacaagctgatgccgcccccgagcacggcgccctacacccgcgcgtccaacctccgctccgcctcgcctctcccgccgcgctccggctccggctcttctggcggcgccagcgacgcgcaccacccccgcccccaccccttcagatcggcggaggaccgtgccgcggggaagttctcggcggcggcggcgagggccgagaagcagcgtgcggtgtcgccgcacaaggtgggcccgggctccgtgatgggcctgggcgtcccggacccgaagcagcaccagcagtacaaccaggggggcagcggcagtggccagcatcagcagcagcaggccggcgcggtggcggcggcggcgtcgacgaagccggcgccgaagctggaggtgccgcggatctacaccacgctgtcccggaaggagaaggaggatgacttcatggccatgaagggcaccaagctgccgcagcgccccaagcggcggcccaagaacgtcgagaagaccatcaatttgatctgccccgggatgtggctgacggatgtgaccaggagcaggtacgaggtgcgcgagaagaagtgccccaagaagcaacagaagaaccgaggcctcaaggggattgagatggagagcagcagcgactccgactgaccgcccgacgacagcctgcgttgccaggccgaagggcggtggcggcagcggcggcggcggcggaagaggaagaagagtcggcgacagtgacgggagacgaggggagcgtgtcaaacagcacgcgctcttagacatgatggtcgcgctgggttcagggaagccaaagaaaaaagaaaggttggattcagagaaaaaaacgaaaaaaaacttttttttgagttaatcatagcggcgccgtgctatttatatagcctcgattccattttgtatatctggcgaggatgtcgtagccggcgtctttgttttatctttttttggtcgacaatcggtggtttgcccgctgcgtttgtggtgggtttgtgcatagcgccggtcaactagactatctcagcaagaggaaacaactagactttaagactccctccctctctgctctggttaattgtgcagtggttaatgtttatatactcttgttcatgttcgatcattaggtcagaaggttactgttaggccttgttta

SEQ ID NO: 193 - DNA, 1375 bp, Sorghum bicolor
accgcacgtctcctcgggcctcagccctcctaccaccctcgccgcggccgcgccacacaaaagcgtcacgccgtctgtcacaaaagctcacgagttgcgtcgcgtcgcggccatggaggagagaattccccaacgaccaagagaggcacaagcacccaccgtcgctcagccggcgccgacgaccggcaagccctgcgatgacggcgatgctctagctcccgccatccagctgctttcgtcgtcgtcctcaggcgaggagtcgtccgacgacgagggggagctcgagttcgagttcccgttcgtcagcagggactcccccgcgggcacggccgccccggccgacgagctcttcgccgacggccggatcaggactttctacccggtgttcggccgcggcgccagcagccacggcggctgcacgacgcgtccggctgctccggcggctgccccgccgcgggtgaggggccagctgggaaagttgttcctggaggaaacccgggagcgcaactcctccactagctccacgtcgtcgtcgtcgtcgtcgtcaggggccgccacggacgacgacggcctggaaggcgtggcgccggagagctactgcgtgtggcgtccgggctcgtccgcgtcgccctccccgccgacgccgcccaggaagagcgggtccacggggtccatggcgcgatggctccgcatcagcgacctcgcggtgggccgcagccacagcgacggcagggagaagttcctctttctcgccgccgcgccggcgcacgacgcgcccaggcggagcaagaagcctgcccctgtccctgcccggcctgcaggcgccaggaagcctgcgccctccgccgccgtcgccgccgcagacgccgacaccgccgccgcccaccggatagcgcacctcgccagaggcggactcggcgtccccgtcccaccaggcggcacgccgcggcgcacgttcctgccgtaccgcgaggagctcgtgggcttcttcgccaacgtgaatggcatcagccggagccaccaccatccgttctgacgtcttgtcacaggcgaacaaactattcgatcagttacacaccctgattaattattcagttttcagggcttggattggattgcggcaaaaaaaaaaaatcaaattctactgtatgtgattatcgctttttttactagtgcgtaagtaggcggttatagctaatgatttcgggttagaaattgatcacgcgactggtggtggtgaggtgaagcatactccctccataccagatttaagtgacgttctgggcacttgtatagatttcgtaaaacatgacgttgtagctctgaagaagtccggaggactggaatgcccctgccgcttcgttagtatgatttc

SEQ ID NO: 194 - DNA, 1483 bp, Sorghum bicolor
aaagaatttccagcagcagcagcagctctctcactccctcctcttccctcttccactctcgaagcgcagctctcttcagcttcccttccaaaacccaagcaaagccaaagccccggagcaccaccaggtggtagcagccagcaggccggtgcccccaagctgcgaggctacagctagtacatctgacagagcccgaccacagccatggcagccgccggagcagcgctgcggctgcgcctgctgtaccggatgctgcgcgtgggggagctcctcgcgctggtggcgttcctctcctggtcgtcgtcccgcgtcccgtccgccgccgccgccgcgctgcggctcgcggggtcgctcctcctcaacgcccgcttcgtcttcgtcctcgggaacgccatcgtgctcctcctcctcgcgctgtcgcggcacgacctctccgcctcctcctcctccagcggccagcagacgagcacggcggcggcgacgagcacgtccgctgccccgccaccgcaggatgccgcgccggccgctgcaagcgacagcttcccttcctcgttcgccggtactccgataactccaccgcctcccgccacctcgctggaagccttcagcgcgctgccggcggctccagcgacggagccagcggcagccgctttgaacacgggcacggcgttcgacgacaggccactgcaggcggcgtcggcggcggtggcgcgggtgagcaagcaggcgcgcgcgccgaggcggagcaggtcggagaagatgggcccgcgggtgctacagctgaggcgcgcggcgtccccgccgccgacccccgagctgcggcggtccgagtcggagaacgggcggcggcggtcgtccgtgtcggcgcgcgacgctcgggcgtgcggatggggcgcggacgacgccgacgagttccggcgcaccgtggaggcgttcatcgacaagcacaagcgattccaccgccaggagtccatgacgatggccgtcgtcgccggctccggctccagcgggcactgcgaggcggccccggccttcaccggcgccctcgccgtcgtcgaataataagtcttcaccggcgcagttggcagcagagtacatagcggaggcggagaagcttccctggctgaacttgtcgtctcgtgttcatagtttgcctcccaaggctccttcgtgttcttcacaggggggatgccaccttttttttttctgtgtttttttttattttctcggcgcgtgcgtttcttcgtttcgccataggaacccgcagctgcgactacgaacgggggtttagagagccgttcaggtctgccgttggatcgcggcgtggatcggatccaacagaacgatctttaacctgtgctctgatctggcaacgaagggaaatggacgaaaattgcatgcatgctggatgtttcgttcgttcgtctctggtgctgccgaatttcttgtgctcggctgcagtggatgaatggagagtgaaccg

SEQ ID NO: 195 - DNA, 1517 bp, Sorghum bicolor
agctaggccactctcccctgcctccgtcctcctcctcatcagcagcagcggcagccgccatgggcgtggggaagctgatgaacgacgtgaagccgtacctggcgatggtgctcctccaggttgggttctccgggatgtacatcgtctccgtcgcctccctcaagcgcggcatgaaccatttcgtcctcgtcgtctaccgcaacctcgtcgccaccgtcgtcatggcccccttcgccctcatcttcgagaggggtgtccgccccaagatgactcctctcatcttcctcaagatcatggggcttgccgtgctcgagcctgtgctggaccagaacatgtactacctgggcgcgaagctgacctcggccaccttcgggtcggccctcgtcaacatcctcccggccatcacgttcctgctggcgctcgtcatgaggatggagaagctgaggctccggagcctccacagccaggccaaggtcgtcggcacagtctgcaccgtcgccggagccgtgctgatgatcctctaccacggccccgtcgtgccgttcccgtggtccgcggccggccaccaccacgcctccgccgccgcggcggcggcggcgagccagagcagcgcctcctggctctacggcaccgtcatgatcattggtagctgcctgtgctggtccggcttcttcatcctccagtccaacacgctgcagagctaccctgcggagctgacgctggcgacgctgatctgcttcctgggctccgtgctcaccggcggtgtggcgctggtggcggagcgccacgacatgagcgcctgggtcattggcttcgacacccgcctcttcaccgccgtctactccgggatcgtgtgctccggcgtggccttctacgtgcaggggatcgtgacgcaggcgcgcggcccggtgttcgtgacggcgttccagcccctgtgcatgatcatcaccaccgtcctgggctccaccatactcaaagaggagaccaccctcggaagcgtgattggcgcggtgatcatagtggtggggctctactgcctcatctggggcaagagcaaggaccacctcggcagcaacggcaagcccggcgccgcggccgtcgccggcgagctgcccctgacctcggctcccacggccaacaacggtagttacggcaagcacgccgcgctcggcggcggccaccatgtcgtcaccggcgtcgagacgacgccgccgccgccgccgtgtgtgcccaagtgcgttcactgacgacgccgggccgggatcgacctccatctccatgatgcatgactactccttctccggactgttcactgcacacgtactagtagtgcattgccggtggctgtaagccacatatgatcttgaaggaacttggatcatcgctctgctctcgtagaggcgcgtccgatgccccgattgttgcgttttaaccactttaattttgatgtagctctgctgtaccaccagtccaccaccactaatacttgaagctttgttcagtttctgcgacaagaa

SEQ ID NO: 196 - DNA, 1615 bp, Sorghum bicolor
aaaacatccgcggcgaacgggcgaagtggcgaactgaatcgcgcgatggcgacggtgtcgatggacatcccgaagccctcggcgctgacggcggctggacacgaggctgccacggcgaagacgaggggcggcggcgaggggctggggaagtactacaatcagcacatccaggacctactcctcgcagtccagcagaggatcagtgacctaagccgcctagaggcccagaggaacgatctcaactcccaagttaaaatgtgcagggaagagttgcatctgcttcaggaaccaggttcacatgttggtgaggttgtgaaggtgatgagcaagtcaaaggttctagtgaaggtgcatccagaaggcaaatatattgttgatgttgataaaagtatagatattgcaaagctcacaccttccacacgagttgctcttcgaagcgggagctatatgcttcatgttattctgcccagcaaagtcgatccattagttaaccttatgaaggttgagaaagttcctaattctacatatgatatgattggtggtcttgatcagcaaattaaagagatcaaagaggtaatcgagcttccaataaagcatcctgagttgtttgagagtcttgggattgcccaaccaaagggtgtcattctctatggccctccaggtactggaaaaacattacttgctcgtgcagttgctcatcacacagactgtaccttcattagggtgtctggttctgagctggttcagaagtacattggagagggttcccggatggttcgtgaactttttgtgatggctagggaacatgcaccatccattatatttatggatgaaatagactccattggatcggctaggatggagtcaagtggcagtggtgatagtgaggttcagcgcaccatgcttgagcttctaaaccaacttgatggttttgaagcaacgaacaagattaaggttctcatggcaacaaacaggatagacattttggatcaagccctcctgaggcctggacgtattgacaggaaaattgaatttccaaatccaagtgaaacttcccgctttgatattttgaagattcattcaagaagaatgaacttgatgcgcggcattgatctgaagaagatagctacgaagatgaatggagcctctggggcagagctgaaggctatttgcacagaagcaggaatgtttgcccttcgggaaagaagggtgcacgtcacccaggaggatttcgagatggcagtggcaaaggtgatgaagaaggatacagagaagaacatgtctctgcggaagctctggaagtgaggggctcgtgtctctgcgccaggcttacactgccatgtccaaacagctgaagccccggctgcgcgttgccggattttctgttagactctggaaaaacatttctggagctcggaagctgaaacttaacaatgtcgttgtgtagcagctttattagaagttaaattattgatttattgaatcattattaaagaggcttgagatggagatcagccatgctaatgtgcttcgccgtgctgtcactttttatagtccaaactaaatggtatggaaagtaaaatgatcaaatagagatatgttctcttattcaaac

SEQ ID NO: 197 - DNA, 1876 bp, Sorghum bicolor
ctagctatctataaacacccccgcacctcgcgcctcatctccttcccctccttcccccatctctcgttctcgccatcggcagacacggcggcagcagcgtctcttctctctctctctgtctatctcgggacaagtttgggatatttatatacaaatattcgatcttgcgttgatcggtgcgcgcggtggccatggccgtctgagccattgatgagagcaccaccagtaccgttggttgcggcggcggcggccggacgcgatgtccgttgtggcggccgtggggcctggcgccgccgcggcggcggcggcggcggcgggggcttacgggcacgggcagccgctgtgcggtggcggcggcggcggggcgaggaagaggaaggacgtgggcgtggtccaggaccaggaggcggggttgcggggtagtcacgtcggcgccgcggcgccgcggcgtggcgccgggctgttcgtgctggagacggtggaggaggaggcggaggcggagaggttgtcgtccatcggcgcggtgtccgaggacgaggaagaggacggggaggaggtgaacagcggcgggacgtcgtcgtcgacgacgaagggcgccgcgctcgcgtccatggacatggacgccctcgacgacgcgctccccatcaagaggggcctgtccaacttcttctccggcaagtcgcgttcgttcgcgaacctgcaggacgcggcgtcggcggtgaccagcgcccgggacctggccaagccggagaacccgttcaacaagcgccggcgggtgctgcggtgctgctccatccggagggtcgcgtccacctcgctcaccgagctgccgccctttttcctgccgcccaccacggaccccggcagcaccggggacgacgacgacggctgtggcgccggcggtcgtcgccacagtggctgatgaagaacgggccggacgccgggtatacagtacagaccaaggaggactactactatatatacactgcaagcaggacggatgaaatatatgaaacgcgcgcgccatggatcccttgtcctttgtagtaaatagtttgcattgggatccatcgtctcaccatttcatctttcatcagcatcaaccaagcatgcatgatatactatggtaggcgttaatttcttcatttagctagcaatcaaacactccatccatcatcgtagattgatgtgcatcgcatgcattgacctgagtaccagatcaaatacgcactgtgatccatgcattcccggcctagctagcagctgctcctggctggcctcctgctgtgtgatgccattagaaagagagcttgctagctagcgagctcagggggctcagccaacaacaaattaattagaggcagcgagctaaccttttttttttgaagatcacaaggcgtgcagatgatgcactaatttatacattgagcaagtttcatcacacaatctgttcatttatttgatatactcttatgataggagcatatatatattctactagtgcactttggatatatatgctctgatggcatgcatggattatggaaagttttatatactctactcatcactagctctcgccaacaaaccacacttggaagcaccttgctgtatgctgcggtgcatgcagtaggttgatcgatgatgccttttgccaaagagcaaagatatcgatgaagtgcatgcatgcaatttgtactttaatgtcctcctttttgtttacttctttttaagaaactcctcctttttaattattttacttattagtacttacttatctgctctaggctatactaacggtttcatttacaacattctgttcatttgagtttatctactaaatttattggccatttaataataatatttctttttt

SEQ ID NO: 198 - DNA, 1245 bp, Sorghum bicolor
caagataaggagatcgcagcctctcggggccacccccaatctccaacgacgccgtcccccgcacttgtccccaactcgccactcatggccatggccttccacttccacccgctggccgccacgcgcgtccacctctccccactcccgttcgccgccgccgccgccgcgggggcgccctccccctcgtcctcctccgtcgccatcgcggcgccccaccaccaccacggccgccgccgcttctccgccgtcgtggccacggcggccgcctccgcggcggccaccacggagttcgacttcaaggcgtacatgggggagcgcgcggtcgcggtgaaccgtgcgctggacgcggccatccccgccggggaaccccccgccgcgctgcacgacgcgatgcggtacgcgctgctggcgggcgggaagcgcgtgcgcccggcgctgtgcctggccgcgtgcgccgtggtgggtgggcccgaggcctgggcgatgcccgccgccgcggccgtcgagatggtgcacaccatgtcgctcgtccacgacgacctcccctgcatggacgacgacgacctccgccgcggcaagcccacctgccacgtcgtctacggcgagcccatcgcggtcctcgccggggacgcgctgctctcgctctccttccaccacatggccagcgtcgggtcctaccctccggacgtagacccggagaagcatcccgcccgcgtcgtccgagccattggcgagctcgcgcgctgcatcggatcggagggactcgtcgccggccaggttgtcgatcttgagatgacgggcacatctgaacctgtgccccttgaacgccttgagtacatccatctccacaagactgccgcattgcttgaggcctcagtggtgattggggcaatcattggaggcggcacggatgagcaaattgagcggctgcgaaaatatgcgaggtcaatcgggctgctgttccaggtggtcgatgacattcttgatgtcaccaagtcgtcagaggagctcggcaagacggcagggaaggacttggcaagtgacaagacgacgtacccaaagctattggggttagaaaagtcacgcgagtttgcagaaaagttgctttctgatgcaatagagcagcttgattgtttcgacaaggagaaggcagcacctctgttgcatttggccaactatatcgcccataggcagaactgaggaggaattggggtgatgcttattccattgttgctcattgtcgat

SEQ ID NO: 199 - DNA, 1128 bp, Triticum aestivum
agatttgaagccttatttgggtgaggaagatgagcttccgtcgaggacgacttcatttcaagaaggggaggatgatgaggacatcaatacaattgttacacccacagcccctgctgctatacatactggaccaattactagagctcgcgcacgccaactaaattaccaggtactttcgtttcttggtaatgattctaatgttcatgagaatatgatgctgcctaaattggatacatttgttttgcttacaaatgaagggcctagcttggagaaggatgaacattggagcaagaacaagcatggagatgatggcatgcgcaaggggaacaagaacggagttacaagtgatgatttcaggactttgaagccaccataatgggtgcatgaagccttggacgaaatatacaagatgccacttcataaatttcgtcccgaggctattataggtgctgcgtcaccttattattgggccaggcccatgtaatttcgaaatacataagtataggctatttttagagtccgtatgtgtggggaaacaagagatagggttgatttcggacccctccaccaagggccacgaaattcccccctcttcctccatatatacagcccttagggcatcgtttagactttgggttttgtttagattaaaagttcgccatagctgcaacttcgcgtacttcgtttgtgttcaacgaccagacaaaggcgtcacagaaccccaccttgatcaataaagctttcatcttatattcgcaatatccagattgcaatctcagtttcttgcttgttcttcgtttgctcgcaggaaacagaccctcgtggtcaggttgatcgtgctccggcgtggtcaataacctctcggagttggtttagcgattgctaaggcgcgacgtcctcgcacgttcgtagtcggatcgtcaaagtcgacttccaccaaagcgaaatccaccatctcatcgaaagacgggacacctttgcctctatcaagtggtatcagatttccaggttgctcggtgagattttacagttttttgtagtttagatcgagtctgttcttcatacctacagtccacgaaaaagcacaaaaaaaaatagggttaagtcatcatatcccgaaccaatctg

SEQ ID NO: 200 - DNA, 920 bp, Triticum aestivum
ctcgcccgcctatcctctccaccttctcagccacacagagaaagagcgtccaagctccagctagctagcaatggccgccgcactgagcctccgcgcgcccttctccctgcgcgccgtggcgccaccggcgccccgcgtggccctcgcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctcgaccaggccgaggaggaggggatcgacctgccctactcctgccgcgccggctcctgctcctcctgcgccggcaagttggtgtccggcgagatcgaccagtccgaccagagcttcctcgacgacgaccagatggaggcagggtgggtgctcacctgccacgcctaccccaagtccgacatcgtcatcgagacccacaaggaggaggagctcaccgcataagctgctatacctatctctctttgcaagaggatcgagctgatatcatattatctcctacagtatcatgcatgcatggacatcgccagatcgatacaccgattgttttgtgctcgaatgaattgctcgatgcatggtttgctcaagtaataatgtcttcgaattacctttttgtaccgtaagatatactactgtcgtaatactagcgtgtacgtaattcaacgtactgaaatgaatcctgatggctgaggagtctctctgattaataatatcttctttttaattaagagactgttgaatgttggtttccaggaatttgatgaacatcttacctgcggctttcttctatgcagataataggtgcatgttacgacttgtttcaatatgagttttgagttgcacgatttcctcaaaaaaaaaa

SEQ ID NO: 201 - DNA, 1873 bp, Triticum aestivum
ccgtgtggaggtgttcttggaaggttctcccgcctcagggagtagtgggcgccatcgccgttaccttctttagctaagctataggacacccgcacacgcgcatacatacacgagaaagagaaagagaaaggattcactcacgggagggagaggaggaagaagagatagggggagagatcgatcgatgggggacgaccatggcgccaagctggtgaagagcctgcggggcgcggcgcagaagtacgtcggcgtggggttcttcctcggcttcttcctcgtcctcctcacctacttcaccctctccgagcagttcgccatcgccgcgcccaacgctatccggaggacctcggcggcgcacccgacgccgaccaccccggccgtggcagagaagacggtgcagcagcaacagctccccgtcaaaaaggaggaagcacctctgccagagcatgaacaagtacaagagaagccaccacctgtcgacgaggagccccacagagaaacagaggagcccaactcagaaacagaggaggaccccaagcccatcgatgaggctagcaagatcgtgaccaccgcggaggagagcgcgccggcgaagaagccggcgtgcgacatccaggggccgtgggcgtccgacgtctgcgacctcgccggcggcagcggcggcgtgcgcatccacggctcgacccacacggtgctcgtcccgcccaccatcgagtccggtggcagcaaccccaacccgcaggagtggcgcgtgctgccctactcccggaagcacatgtccggcatcaaggagatcaccgtgcgcgagctgcccacggcggccgacgcgccccgctgcgccgtcacctcgcaggtccccgcgctcgtcttcgccatgggcggcctcacgggaaactactggcacgacttcagcgacgtcatgatcccgctctacctccaggcgtcccgcttcgacggcgaggtgcagctcgtggtcaccaacatccagccatggtacgccggcaagtaccgccacatcatcgcccggctctcccggtacgacgtcgtggacatggacaaggacgaccaggtgcgctgcttccccagcgccgtcgtcggcatccgcatgcacaaggagttcagcatcgaccccaccaaggagcccacgggccactccatgcccgagttcaccaagttcctccgcaacgtcttcgcgctcccgcgcgccgcgcccatgcgggtcaccgccgggcttataagcgacaagaagccgaggatgatgatcatctcccggcgccacccgaggaagctggtgaacgtggcggaggtggtggcgctggccaagcggatcgggttcgaggtggtgatcggggacccgccgttcaacgtggacgtgggcgacttcgcgcgggaggtgaacgccgccgacgtgctcatgggggtgcacggcgccggcctcaccaactcgctcttcctgccgacgggggcggtgttcatccaggtgaaccccttcggcaagatggagcacatcggggaggtggacttcgggacgccggcggtggacatggggctcaagtacatggcctactcgtgcggcatggaggagagcacgctggtggacacgctggggcgcgaccacccggcggtcaaggacccggagtcgatccaccgcagcgggtggagcaaggtggcggagtactacctcggcaagcaggacgtgaagctcgacctccagcggttcgagcccgtgctcctcaaggccatggccatgctcagagagtagccgctccgatcgagcttgcagccccggcgcattggttgattcgcactagcgtagagcagttccatttcttctaatttattcctattaatttacatattttttgggtggata

SEQ ID NO: 202 - DNA, 589 bp, Triticum aestivum
cgaaagaggcgaaaacctgattcgctaccgacctgacctcgccgccggtctccgattctccgctcgcctgctctgctctgctccgccgcctctccggaaaaagaaaacacaggtagtactgaataatagacaaggatggcttctactggcgtgaaagatttctaccggcagaagaagaaaggaggtgtcggcaaaacttcagcatcttccaagaagaaaacacagaattacactggaggggcctctgttggggcctcaaataaggctcagacagcagcactaatttctcacggatccttagacctcaaagatgatttcagtgagcaagaggagcagctgcggcagtttgacatggacatgaagtttggcccgtgcatcggtgtcaaccggcttcagcgctgggagcgtgcttccgccatgggcctccagccaccgccccaccttcgtgatctcctagcgcgcgcctcctccggaaacaaccgcaacaacggcggcccctcccctgagtgcctctgggagggtaagatctagaatcaaatttcttccgccgcaagtgctccttggcaacctagcatggcttgcctactgt

SEQ ID NO: 203 - DNA, 1483 bp, Triticum aestivum
agctccacacgctagccatagccagcgggcaattctacctggcaactgcgacctccgtcgccccggccggccatgtcgcaggtgaggatcgtcgacgcgagctacgtcgatgtgccggagaccgccgtccggccaccggggccgatcaagctgaccgccatggaggcgctgtggatcgtcatcccggtgctgcagcacgtgctgctctacgagggcgacgacgacacgccgcccttcgacgctatcgttcagtcgcttcgttcctccctcgccgcgactttgcgcagcttcgcgccgctcgccggcaagctggtccacctcgaggaaacgggggacgtcggcatcagctgctccgcctccgacagcgtccggttcgtcgtcgcggagtgcgacgcagacatcgggcgcctggccggagacgaggagcacgacctgcgcgtgctcgaggggctcgtgccggaggtggacatgagcctgctgccgacccccgtgctggccgtgcaggccacgcgcttccagggcggcgtggcggtcggggtgacggtgcaccacggtgtcgccgacggccgggcgctgtggacgttcgttgaggcgtgggcggcggcgtgccggggcgagacgccggccacgacgccgtgcttcgaccgctccctcgtcaagctgcccggcggcgaagagctggccaggagcgtcgtacggaaggtggccccgaatttgccttcggtggcactagcatcatcagtcttcgaagaccgaaagcggctcattcgccgaacgttcaccttggacgaaggagacatccaacgcctaaagcagcacatcgtccacctcaacgagtcgggcggcacgcccctgcctcgcccgccgtctgctttcgccaccgtcgtcgcactcgcgtggacgtgcttcgcccggtgcaagtcgttctccttggaggacgacgtgtggctcttcttcttcgccgacatccgtgagcgccttgaccctcccgtcggcgcggggtacattggctcgtgcctcaccaagtgcttggcaaggctccccgcccgggagcttcatggcgagcgcgccctggcggctgcggctgcggcggtccaaggcgagatcaacaagatgaaggaagaccctatcgctgggtggaatttcttctcattcgatcccatgccttccatggaccggctaatgaacatatcaggctcgtcgggttttagtgcataccagatcgccgactttgggtggggcaagccaaggcgaacagagccgattaggatgaactcggatggtcaggtggcactgatgggcagcagggatggccggggtgtgcaggtctcagtggcactgctccaagcggcacaaatggacgagttcaaatctaactttctggcgctacttgagtgacaatatttgttctcaaagagacctacttaggtcacttcaaaacagtacacccaaatgttttataaacattaatacattataattg

SEQ ID NO: 204 - DNA, 1559 bp, Triticum aestivum
cgcatttgctggtcccggcgaggtccgctcctctgcacgcgtgggtggcggcgccctcgccggcgtcgcgtcgcgccggcccccgaatctccggcgagccgctcgcgccccaagcccgagcccggtgaggcctactgctctaggtcttcctgccacccagagttttcgatatactggttttgatatggagtgattggtggagctggtcgtccggaagctctgctggtgaatccgatggggagcaacgatcctagcacgccgtctaaggcttcgaagccaccagaacaggagcaacctccggctactacctctggcaccacagctccagtttaccctgaatggcccggctttcagggctacccagcgatgccaccgcatgggtttttcccccctcctgttgctgcaggccaggctcatccatacatgtggggacctcagcacatggtgccaccttacgggacaccaccacccccctatatgatgtatccaccaggaacagtatatgcccatccgactgctcctggtgtgcatccatttcattatcctatgcaaacaaatggaaatcttgaacctgctggagctcagggagctgcaccaggtgctgcagaaacgaatgggaaaaatgagcccggcaaaacatctggtccatctgccaatggggttacgtccaacagtgaaagcggaagtgatagtgaaagtgaaggaagtgatgccaattctcaaaatgattcacattcaaaggagaatgatgtaaatgaaaatggcagtgctcagaatggcgtatctcattcatcatcgcatggaacatttaataaacccatgccgttggttccagtacaatcaggtgcagtgataggagttgctggtcctgcgacaaacttgaacatagggatggactactggggtgcaactggctcttcacctgttcctgcaatgcgcggcaaagtaccgtctggttcagctcgaggagagcaatgggatgaaagggaactgaagaagcagaagaggaagctgtccaaccgggaatcagcgcgcaggtcccggctgcgcaagcaggccgagtgtgaagagctcgggcagcgggctgaggctttgaagtcagagaactcgtccctcaggatcgagctcgaccggatcaaaaaggagtacgaggagctcctttcgaagaacacctctctcaaggcgaagctaggggagaccggcggcggcggcgacgcagtccccgacatgaacgaacggggcgacaccaacggcggcagccaccagaaggagccctgactgaccgacgacgcatgggacctctactctactctacttacatagctcgtgatgattgatgatgattcttgtaacaaacaaacttggcgaccccgatccgccacacactcacacaatgagatggttcttcttttttgtgcctcttatcgacctgatgacaatggcgacgccgtcgccgccacctgcagactcctgtgcttgtttcgtccctactgtggaaagagagatcatttgtgggcgcgtgcacttctcagttctcaccgccaaaactcaaaaaaaaa

SEQ ID NO: 205 - DNA, 1458 bp, Hordeum vulgare
cgtccgcgttttagtattttccttttctctccccttccttccgagcctctcgtgtcctgacctcctcttccaagttccaacgcggcggatctaccctcgactgccgctgtgccgccccagcgtcaccaccggcgcctcctctcgccactcggagacgggcgtcgtcgccgccgccgccgccgccgccaccgccaccgttccccttcttccccgcccccccgggagatcctggccatcgggtctccttccttcctctgagggccaaagtttagcttgacgccaacatgtcgtcgaagaagatagagctagaccacaaggacatggttcatgattctgccattgactactatgggaagcgccttgccacagcttcctcggactccactgtgaagatcaccaacattggaggtgcatctgccccgtcccagctcgttgccaccctcactggccactatggtcctgtatggcgtgttggatgggcccatcccaagtatggttcaattctggcatcctgcggctatgatggccgtgtgatagtctggaaggaggctgccactgggcaatggtctcagctctatgtgtttgacaaccacaaggcctcagttaactcaattgcttgggctccatatgaacttggcctttgccttgcctgtgggtcttctgatggcaccatctctgtcatctccatgcggcttgatgcaggaggctatgacgctgcaaccatcgagcgggcacaccctgttggagtgacagcagtctcctgggctccagcagcaccccttgggtccatggttggctcaggtcagctcgtccacaagctcgtgtctggtggctttgattgcgtcgtcaaggtgtgggagtttgtcaatggtggctggaagctggagagcgctatggtctccgacatgcacaaagaatgcgtgagggatgtttcatgggcaccggtcctgggcttggcaaagtcaaccattgccagcgcgtcccaagatggcaaggttgtcatctggaccagtggcaaagcaggaggcaagtgggaaggaaagctcatgcgtgacttcgaggccccggtgtggagggtgtcctggtccttgacgggaaacatactgtcggtcgctgccggcgagggcgacataactctgtggaaggaatcgtcggacgggcagtgggagtcgctgtggaccaaggcctcggaggagccgccgcaggagcaggccgcgatcgaggaggccatgcagtaggggggagtcgacgccatgtcccctgtctcgatttcagaccaacgccatgacttgctttcacctgctgccctgatactcatagagatacccgtttccattttttttgccgtttgtttctgcatggacaatgtctgattgcactgtttagttttactttactggtcatgtactcgtcgtgcacaccgtcagaatgtattggctgtttgaactgttcatatcc

SEQ ID NO: 206 - DNA, 1183 bp, Brachypodium distachyon
acatctccagtctcccgccacccgcaaccacctccactgcaacgggtctgtcttgctctcgtcggctagggcttcgccgcgccataccccaaccatggatgcgaccacggccgcctcgctcccacgcctctccgtcccgccggcccctcgccctaccatcaccccctcccgcttccgccccaacgacgcccctgtccccagccgccgccgcctcagcctccgtttccaccgctcgccggtggcagctgctgctgccgcaagctccccgtccgctacatcctcttctccggaaccagggtcgggcatcggtgatgcgctaggtggcgtctccatcttctctgcggccaccggcgagcccgtcctcatcagggatttgtgggaccagaatgagggaatggctgtcgttgcgctgctaaggcatttcgggtgtccttgctgttgggagttggcctccgtgttgaaggatgcgagggagagattcgattcggctggcgtcaaactaattgctgttggtgttggcactcctgataaagcccggattcttgctgagcgtctgccctttccattggattgcctctatgcagatcctgaacgcaaggcttatgatctcttgggtctatattttggtgtcggtcgtacattcttcaacccagctagtgtgaaagtgttctctcgatttgagtccctgaaggaggcaacgaaaaactatacaatcaaagccaccccagatgataggctgagtgtcctgcaacagggtggaatgtttgtgttcaaagggaaagaactgttatatgcaaggaaagatgaaggcacaggtgatcatgcccctttagatgatgtccttgacatctgctgtaaagttccagtcgcctgatgtcgaatcctacacaggctccgccgcgactggaaagcgtatttcacaagcttggcatcagatgattttcgactgctgacgggtgcaagtgtagtatctgcatgtatatctactgtaagttggaaacataaagttgttgggcaaaccaaacgtagaactctgccatacccttatcggagtttagcagggtagggttttggaagaaatgtatacgctgtaaagcaggtttataccgttgcttctggaaatggaacgctgaaaaaagtagcggggtcgatcagtacctgctgcgtatgagttcagatggtc

SEQ ID NO: 207 - DNA, 1807 bp, Zea mays
atccttgcccttcctttatctcctcgtgtcttgtcttcgtctcgtctcgccacaggcacagccagccctatcgatcggcggtacggtgtctgccaagccaagtgccaaccgcaaccgcccccgcgccgagcgagacgatggagacgacggagatggcggcggccgccgccgccgccctgtgctgcgcgctggcgctctacctgtaccacgcgctgtggctggcgcccgggcgggtgcgcgccgcgctgcgggcgcagggcgtcgcgggcccgcgcccctccttcccctacggcaaccgcgcagacatgaggcgggcgaccgcggcgcaccgcggcggcggcggcggcgtcgtgcacgactaccgccaggcgctgttcccacactacgagcggtggaggaaggagtacggccccatcttcacctactccatcggaagcatggtgttcctgcacgccagccggtccgacgtggtccgggacctctgcctcagcgtgtcgtcgctggacctcggcaagagctcctacatgaaggtcacgcaccggccgctcttcggcgacggcatcctcaagtccagcggcgaggcctgggcgcaccagcggaggctcatcgcgcccgagttcttcccggacaaggtgaagggcatggtggacctcatggtcggctcggccacggcgctggtggcgtcgtggggggacaggacgggcggcggaggcgtggagctcaagatcgacgacgacatcagggcctactccgccgacgtcatctccaggacgtgcttcggcagcagctacgtcaagggcaagaggatcttcgcggcgatcagggagctgcagaaggcggtgtccaagcccaacctgctggcggagatgaccggcctcagcttcctcccgacgaggactaacagggaggcgtggaggctcaacagggtcgtgagggacctggtgctggacgtcgtcagggagggcggggacgacgacaggaacctactgaacgcgatgctccgcagcgcttcttcctccggtggctgcagcggcgaccgcgtggcggtggaggagttcgtcgtggacaactgcaagaacatctacttcgccggctacgagaccacggcggtgaccgccgcctggtgcatgatgctcctggcgctgcacccggagtggcaggacctggtgcgcgacgaggtgcgccaggcatgcggcggcggcgacttcgcgtccctgcacaagatgaagaagctgacgatggtgatccaggagacgctgcggctgtacccggcaggcgcggtggtgtcgaggcaggcgctccgcgacgtgaccctcggcggcgtgcgcgtgccggcgggcgtcaacatctacgtgcccgtctcgactatgcacctggacccggagctgtggggcgccgacgcgcgggagttcgacccggggcggttcgcggacgaccaccagcggcagcggcagccgcacgcgtacctccccttcggcgccggcgcgcgcacctgcctcggccaggccttcgccatggccgagctcaaggtcctgctggcgctcgtgctgtccaggttccggctcgcgctgtcgccggcctacgtgcactcgccggcgctcaggctcatcgtggagcccgagcacggggtgcggctgctgctcaccaacgtggagcccaggggtgctagctagatgggcctcactggaccgggtatttaattcggcccagtagtcaaataatctgccatagtataaacttcgtgaagcctgagttcggcagagattccgtgaataaaaacgattacaaaatcgatcaggtttcctgg

SEQ ID NO: 208 - DNA, 827 bp, Zea mays
ataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaa

SEQ ID NO: 209 - DNA, 1860 bp, Sorghum bicolor
gcttacagaaaggacccgtttcgggccagggcatcgtctcacccggtcaggcaaaccaccctcctcctcggcgcctccccaaccaggcaaccacagtaagcccctgccccttcctccccgacgcgcgctccccctcatggcgaggaggcgctgctgatgcctcgcggcgtcggatcggacgcggcggccacgacacgctgccgcttgcggtggcgctcgccgatccctacgcacgcgcccaatccgccgacgctgctcctcggatcccccccgagggattcgggcctcgtctcgtctcgtgctgcctagcggcccagtcgacttccccaggagacggagcagcaggccagcggccacgccggccaagagaggacggcggcctgcaaggcgagaaggctcgtgtcaggcggtagccataggtgcaaggataggcaaccagtgtccaacaacacgtctgtggatcaattgacctgtatttcggcctttcagttgaggattaaactagagctttaagaagcttgataattggcatcatctcaagaatacattgaagtgcaagatgccaaaaataaagaatctctctaatgcatgtaaagtatcattttctccacaaggtcccatatctgaagaggcgcttgagagagtccgtgcactgttagatgagataagacctctagatgtcggcctagataatgaagcacaaattgcacgcaattggactagtactacgcgtccatcaaatgggagacgaggacgtaatggggctaaccagttcgctgctccaatcaaatatttgcacattcatgaatctgaaagtttctctatgggtatattttgtatgccaccttcttcagttattccacttcataatcatcctggaatgactgtacttagcaagcttctttatggaagactgcatgctgaatcttatgactgggttgacgtgcctgatcatccaattgatcaattacaatcgaggccagccaagcttgttaaagattgtgaaatgactgctccagagacaactattctttaccctaatgcaggtggtaacatccacactttcagagccatcacaccttgtgctctctttgacgtcctttctccaccgtactccgctgaggatgggcggcactgttcgtacttccgaaagtctctaatgaatcaaccacctgttgttttgcctgctgagatagatagctcacaagtaatttggttggaggaattggaggaccatcagcccccagaaggctttgttgttgcgagaggtctgtataaaggccctgtaattaggagatgatttgccttggagcacagaatccaccaaactacaaatcagctgaaagacgatgcaggcttgtagtgtcaattgcaagcttcatcaggtcatgtgcagcctacggtttactttgtacatgtcaaagtgatctgtgataatttaacagcagttttacagaacaatggatgttttttttgttttgctgccattttaattgtgtcccactgctggagtattctctgaccttagttatggagctcttatcagatcaagaccgtggagcacatacttttgagcatagtctagcatagctattgtcatggtgtactagggagatcaatggacaaggttttccatttggtgatttcagaaagaatttggtgtgggggaaccattttgtctgtgtgtaatagcagcactactatttttgggcaagactgtaaattacgggggacgaaccgtaaacaaacctgtgcgcatcatctccatgtttcatttacgtccgttgacagcactatagttgaacatgttgctcgttgcccgttatgagcactttccccttaggccttgtttagttggag

SEQ ID NO: 210 - DNA, 1746 bp, Sorghum bicolor
aggacacgagagatgtgagggcgcgcgcgcttggcggtaggtgcattttttctatccttcctcgacccttaggcccgccgcgccttggactcgtctcgcccgcggccgatctcctccgtccgctcgccgcgccgcaacccggagaggagactgagctcggtcgagcaccacctggggcccagcgtcctcgcgaccatctccggcacggcgtccgcactctgcagcctcggtgtccctgcgaccgtcgctgctgtcctgcgtcgccactcgccactttggccggcgacgagcaccaccaggacactaggtattccctccccttggtcctcccttcctgctgtgcgaagccgtgcgcccagacattgacgtaattcatagtgggaagcccgcaatgcctagcttagggggccagggtgaggaagagcatggggagaagggcaatgaggacaactcaggggagagcgaggtgatcaacccgccagaagaggctagcggggaggccacctcgcctatggagggcaggaagcctcgccttggactttccaaggggaatcaaagccatggacctaaggctatcaaatccaagagcccaaggagtggagatgaaggtcaggcaaggagaaaaggggtgaattcttctcttcctaaggcacccattgtccaggtgtcccatggtgacgctggtgtcggcagtaataaagctggcaagaatgaatctcgctcatctcccatggatgcaacattgctggatgactccaaggagaaaaggaaaactcaaaagccatcagcacagctctcttccatcaaaagagatgaagaacagtcaaatggtgagagtgcaaaacctcgaaaagttggcagcactccatcatatggtttcaccttcaagtgtgacgagagatctgaaaaaagaagagagttctattcgaagcttgaggagaagattcaagcaagagagttagaaataagcaatttgcaagagaaatcaaaggaaactgaagaagcagaactcaaaatgttgagaaagagtttgaatttcaaggcaacaccaatgccaagcttctataaggaaccaactcctgccaaggttgaattgaaaaagacccccccaaccagagctaaatcaccaaagcttggtcgttctaaaaacaagtccacaccagagactgaagaaaatactactatggaccaatctgcccgtctgagccttgaggaaaaggtttctcaaaatggtgtgaaaaaatcaaccccgttgaattcagcaaagaagccccagaggaagtcactccccagactgccatctgaagaaactggtccgctcgatgccacctcaaggcagctaaagaacaccaaactgaatgcagttaatactcaggagacaggatctgctacagaacaggtacaaggaagtgagacgaaaacagattctgttcaggggccaattgaagctggagctaatcctgatgaacaagacgtcgccgaacagagtgtcgtttactgaagatcacggtgaccaaaatcaactgatttgtgatggatggtggtgtgcctcatctttgtataatattgtgcttgcctgctagagtaccttgtgcctgtattatgttatgtgatatatactcctgtttgttttcctggaattgagccttgtatgctgtttatcaatctagaaagcttttgttcataatctacagagatatccaaattgcccaaagtcatttgcagttggtggcaaatgcattcatc

SEQ ID NO: 211 - DNA, 1748 bp, Sorghum bicolor
acacacgcacgcagcagcgagccagcgaccgcggcgacgctctctcatcaccaatcgcccatggccacgggcaccgaccgtccatggtgggcgccgccgccgccgccgcccgcggcggttccctccgccccgcggttcccctccccgccgtcgccgtcgtcgtcgttcacggccgacccgccggcggagttcctctgcccgatctccggcacgctgatggcggaccccgtcgtcgcgccaccgggccagactttcgagcgcgcctgcatccaggcctgcgccgcgctcgccttctccccgccagccgtcgccgccgacctctctcagtcccaccactcctcgtcgtcgtcgtccccgctcgtgctcgtccccaacgtcgcgctccgcaccgccatcctcaactggtgcgaccgcctcgcgctgccgcacccagcgccgctgtcgccggacaccgcccacgacatcgtgcgccgcctcatgccgccgcagcagcggagctcgctggcgcagccgcagcgaccgcagacgcaggtcgcctcgtcggttcgggtgaggcgacccagcgtcttcgacggcttcgcgcaggtgcaggagccgagctccagacagaggggtgacgctctggaggaggagatcatggccgcgctcggggcggacggcgccacccccgcggagcaggcgtcggcgatggccttgctgcggcaggcgacgcgggagaaccaggaggtaaggcggcagctctgcacgccgcggctcctcgccgcgctgcgccccatgctgctgtcgcccgacgccgacgtccaggtcaacgcggcggcggcggtggtcaacctgtcgctggagcccgagaacaaggtgcggatcgtgcggtccggggcggtgtcgccgctcgtggacgtgctccgcggcggccacccggaggcgcgcgaccacgccgcgggcgccatgtacagcctcgccgtggaggacgagaaccgcgccgccatcggcgtgctcggcgccatcccgccgctgctggacctgttcgcgggcgccggcgccacgggccaccgcgcgcggcgcgaggcagggatggcgctgtaccatgtctccctctccggtatgaaccgctccaagatcgctcgcgcgccgggcgctgtgcggacgctgctctccgcggccgaggcgcgggaccgcgcgagcgagaccgacgccgccgcgctccggaggctggccgtcatggtcctggccaacctcgcgggctgccccgacgggcgcgccgcgctgatggacggcggcgcggtggccgcggtcgtcaggctgatgcgcaacggctccgtggctcccgggagcgcggagcaggagtactgcatatccacgctctacgggatgagccggggcagcatgaggttccgcgggctcgcgcgcgcggccggggtcgaggccgcgctgcagccggtggccgagggcgaaggaggcgtggggcgagacctggcgcggcgcacgctgcgggctatgcgcggcgaggacgacgacgccccggtcacggccaccggactactcggacggcagtgggacgacggcagcgtcgtgtcggaggggcttgtctccatccggcggccgccgcaccggagcaattacgccgggccgtccgggtcaaacacaacccagttctgaaaaaaaaaaaacaaagtcaaagtcttcgttttctgcacgctgtcctgccgtctcgatcaagtctttggaactgtatgtattttggttaccat

SEQ ID NO: 212 - DNA, 1713 bp, Setaria italica
tcccggccgcttgtctgttgtttattcccctcagccggtcagcagcccaaccgcaccccctcttcggctcttcctccaccccgctagctgcttccagagagctcgcgtcgcgcgtgcgtgggtgggtgggtgcgtgcgtgcggccggcgaagcagcgcagcaccgcaccaccccctcacgccgtcacgcgcgcgcgcgcgtctcgatggccgacgacggcgagccttccatcacgcgctggaccttcgaggacttcgaggtctactacgaggtgcgcctcggcatccgccgcgagcccgcggagggcgacggtgacgaccgcgacgatggccgccccccgctgcgcggatccgaccaactgtccggccgacccgccgtgtcacgcgccaacgggggcgcggacctcgctgtcttcgagcagttcgagcggatggagaggaaggtggagatgcgcaatggggctatagaggacgggccgccgcagaaacctctgcttccttcatttgaatccgcagaaacgcgcaacttagccgagacattgttgagggatataattcgtgggagcccagatgtcaaatgggaaagcataaaaggtctggagaatgcaaagcggcttctcaaagaagcagttgtcatgcccatcaaatatcccaagtacttcacaggcctattatcaccttggaaaggtatactactatttggtccacctgggacaggaaagacgatgctagcaaaagctgtggctactgaatgcaaaactacctttttcaatatttctgcctcatcaattgtgagcaagtggcgtggtgactcggagaaactagtgaaagtcttatttgagcttgcaaggcatcatgcaccatctaccattttccttgatgagattgatgctataattagtcaacgtggtgaagctcgtagtgaacatgaagctagccgacgattgaaaactgagctgttaatacagatggacgggttgactaagacagatgagcttgtttttgttctagcggccacaaatttaccatgggagctggatgcagcaatgctgcgtcggctggagaagcgtattcttgtaccattgccagagccagatgctagacatgctatgtttgaagagctcctgccatctactactggcacaatggagattccctacgatgttcttgtggagaaaactgaaggatattctggctctgatattcgccttgtatgcaaggaggcagcaatgcagcccctaagacggttaatgacagttctcgaacgcaatcaagaggttcctgaagatgagttgcctgaagttggtccagtaacgacagaagatattgaacttgctttgaggaatacaaggccgtctgctcatcttcatgcacatagatatgagaagttcaaccaagattatggcagtcatgtccatggctgaaggagactgttgtaagatatttgtattcagtacggaacttgtgcatgggctgatagataatgtggaatttccatcgatggaatgaagattgcaccccttcctattgagaaagtcaatccattaatctctttcatgaccctttatagcagcggtgccagaggaaacacagaatattgagggcaaggttgccttctgtaattcatattacttccatgcatacactgctctgttcaaattaccagaagcacagtagaattatatagtagtatgaattatatagtactccctcc

SEQ ID NO: 213 - DNA, 577 bp, Zea mays
gaatttacgatccagaagcacgcacgtgacgtggctgtcagcaagtagcagcttctgtcgcgtctccccctccctgaccgagcgatccagcgagagggagcgagtagcagccgcagccggaggagctcgccgaggccgccgaagacgaccatggggttctgggcgacgacgctcatcttcgtcctcgccggcgtcgccgcatccctcttcacgctcctctgctgcaaccgcgggccctccacaaacctgttccatttgaccttggtgactacagctgtaatttgttgctggatgatgtatgcaatcgtctaccttgctcagatgaagccattgatcaaccccattctgagcggagagtgagcgctgcatctgtattgaacagaacgaaagcgagacctgctgtaccattgttcagtccgtgaactttatattcattttggccccacctgatgaaataaataaataaactgccatgatttttttggtgccactcttcacccgtgattagtgtatgcaattgcatgatatacgcagtaataacatataaatatctatgtatcgatcatgtgcttgaatt

SEQ ID NO: 214 - DNA, 2934 bp, Zea mays
aaaccctaacaccgtccactcccgtcggccaccagccacctccatttcaaatacagtttccaccttcctcctccgcctcccacccctcgctgtctccggcgagacccggaaatggatctcgtcgcctccccctccaggtcaaaatccaagcccagatcctcgccagcgaagcccgtcgccgcccccgctgagtccaggatggacctctgcaccccgtccaagcccacgcccaggcggaagtccaaaacgacggcctcgccggcgccgatgtctccggcgacgccatccaccgtccgacgctcgcgtcgccttcttgaaacccccaccaaagcctccccggaggtgcaagtgaaggctacgcccatctccagggctaagcgcaccgcgccgtcaccgaaaacccctgttcagcgcgagaccaagaggcagaggcgacacccgaggaagagggcatactaccggaaggtggtgtatgatggcggggagttcgaggtcggcgatgacgtgtacgtgaagaggcgggagacggcggagtctgacgcggaggaccccgaggaggaggagtgccgcgtatgcttccgcactggcggcggggttatggtggagtgcgacgcgtgcctcggcggattccacctgcgatgcgtgcgaccgccgcttcggagggtgcctgaaggtgattgggcgtgcccttactgcgaggccgagcgcgccggtaaggtggtcgagcggcccaggccgcctgaggggaagcgcgtcgtgaggaccgccaaggaaaaactcctttccagcgacctgtgggctgcacgcatcgagagtttatggagggagcctgatgggacgttctgggcaaaggtcaggtggtacattatccctgaagagactgcagcaggaaggcagctgcataacttgagaagagagctgtatcgtaccaatgatcttgcagacattgagatggaaacaatccttagacattgttctataatgtgccccaaagactttagggatgctaacaacggaggggatgatgtattttattgtgaatatgagtatgatatacattggcataattttaagcgtttggcagatattgatgatgagccagagacaaaggaagatctcagtgacgagccctacaatgctggtgatgattataacagtgacactgatgaagattcagactatgacgaggaggaagaatccacatcatctttctctgtcagaaggaatcaatcacatgaatctgcggcgaattcaaggaaaggtagaatatatggcctgcaaaaaattgggatacaaaaaattcctgagcatgctcggtgccaccaaaagactgagctggagaaggctaaagcaaccctgttattggcaactcttcctaagtcattgccttgcagagataaagaaatggatgagatatcaatatttgtaaaggatgcaatctgcaacaaccaatgcctaggacgctgcctttatatacatggtgtacctggcactggcaagactatgagtgtacttgctgttatgaggaggctgagatctgaatttgattctggaactctgaggccatattgttttatcgaaattaatggtcttaaattagcatctccagagaatatctacaaggttgtatatgaacagttgagtgggcatagggttgggtggaaaaaggctcttcactatttaacagaacatttttcaggtggtactaaaattggaaagcaagcaaaccagccaattgttttgctgatcgatgaacttgatcttcttatgacaagaaaccaatcggtgttgtataacattcttgactggcctaccaaaccaaattcaaatctagttgttataggtatagcaaacacaatggatcttccagaaaagttattgcctcgtatatcaagtcggatgggtatccaacgactgtgttttggtccatacaattatagacaactgcaggaaattataacaagccgtttaaagggtattgatgcctttgaggaacaggctattgaatttgcttctagaaaggtagctgctatgtcaggtgatgctaggcgagctttagagatttgtagacgggcagcagagtttgcagactaccgtgtcaaacagtctcgacagtctgcacagactactgtttctgcaaagaaaggtgatgctgttgtttccatgggtgacatagaagctgctattcaggaagtcttccaggcacctcatattcaagtgatgaagaattgcccaaagtttggaaaagttatactggttgccatggttcatgagctgtacaaaagtggactaggtgaaataatgtttgataagttagcaacaacagttttctcctggtgccatgccaacagagaactattgcctggatacgacactctcttgaaaatttgttgcaagcttggtgaaagcaagatcatcctctgtgaagagggtagtaagcacaagttgcagaaggttcagcttaactatccaagtgacgatgtgacatttgccctcaaggaatccccagatcttccttggctatccaagtacttgtgaggttcatattacattaaccattaattcctggcgttctgttgcatttctgttctctttggaagcaacgattcactttacctgcagaccttgcatacacacgtcccatggtcgatctgcaaaggaaccatcgaaggatgtcggcatggcgctgcacccaagggatcacgcatatttaatcgcacaacaggaacataaaacgttaagaaatatgtacgtctgcaatttcgtctccttcaaactatggtgttgtttgtgttgtattgaactgccgcgtgtgagctgatccaattgttttctattgccatctttcagtaactatatacgaattgttcgttaaacattgacagttttgaataagaaacattgagatatcaaatttgtactttgccggcccca

SEQ ID NO: 215 - DNA, 1107 bp, Brachypodium distachyon
ccctctctccccaatcgaattccccacggaggccgaggagaggagagtgctgcagtgcaccccgcgcgctagggctcgggagaggcggaggagacgcagtcgagtcaactccaatccttactcctcctcctcctgccccgccccgccaacccacacccgcggcattctctccggtgttcctcaaggaaaaaaaaggcaagagaggcagcaagatggtgctgtgggtcttcgggtatggctccctgatctggaaccccggtttcgatttcgacgagaagatcctggggttcatcaagggccacaagcgaacgttcaacctcgcttgcattgaccatagaggcacaccaaagaatccggcgaggacttgcacgcttgagtccgaagatgaagccatatgctggggaattgcatattgtgtcaaaggtggtctagaaaaagagcgagaggcaatgcagtacttggagagaagagaatgtgagtatgaccagaagatttcagttgatttctacaaggatggagattctctgaaaccagctgtgacgggtgtattagttttcgtatccactcctgatccagttggcaacaaatactatcttggccctgcccctttggaggatatggcaaggcaaattgctacagccaatggccctaatggaaataatagggactacctgttctcaatggagaaggcactgtccaacataagccatgaggatgattcgatcattgagcttgcaaatgaggtgaggaaggtcctgagcaggtcagagaagattaccggctccgacatatcactaaaatcacatactcctcttgtgcacttgtctgcccttccagagggcactgtcgtggattcaagatagtaataaagagcggcatggctggatcagcggaaggaaaggcaattttgcccgaccatactcactcttgacattgtctggttgaaggatctgcattttgattcagctctggcataactgaggatccgtgtgtactgattgtcttccaaggctgtaaacctttggagtgctagtgtgaaagcctgagaccacgttatgttggttcgtttgataccctaataagaaacgcttttggcgagtttacaca

SEQ ID NO: 216 - DNA, 1994 bp, Zea mays
ccgcgatgccgacaccgcctccgcggaagaagcgcctggtccgcgcaggcctcctcgccgccgcggccggttacttcgccttcgtcctcctcttcgagctgcccctgctgccctttctggcgtcgtcctcccccgccgccaccacctcctcctcctcctcctcgctccccttccagcacccgcgccggcgggagctggaggccgcggcggcggcgttcacgtccccgttctcgcccgcccgcccctccaagcgggccttccccgccgccgccgcaccggccccgggctccacgccgcggctcccgatcttctcttccctcctcctcctcccgcggcccaatgccacggccacccccttcgacaacaccgccgccgacgccttcgccgcggccaagccgcacctcgcccacctccaggccacggccaaccccaccgccgcgtctgcgcccgcgtcgtcgccgccgccgacctgccccgcctcggtcgccgtgcaccgggagcagctcccctacgacggcgtccgcgtggtggagctcccctgcgggctggcggtgggctcccacgtcaccgtggtggcccggccccggcccgcccggcccgagtacgaccccaagatcgccgagcgcaaggacggggaggccgcggtcatggtgtcgcagttcatggtcgagctggtcggcaccaaggccgtcgacggggaggcgccgcccaggatcctgcacttgaaccccaggatccgcggggactacagccggaagcccgtcgtcgagatgaacagctgctaccggatgcagtggggacagtcgcagcgctgcgagggcttcgcctcccgccccgtcgaggacaccgttgacgggcaactcaagtgtgagaaatggatccgtgacgatgacagcaagtcagaggaatcaaagatgaaatggtgggtcaagcgtttgattggcaggcctaaggatgtccgcatcatttggccatacccattcacggaaggcaagctatttgttatgactttaacagctggtttggaaggttaccatgttaatgttgatgggcggcatgttgcttcgtttccttaccgcactggttactctcttgaggatgcaactgcattatccctgaatggagacatcgatattgagtcgatttttgctagttctctacccaattcgcatccaagcttcgctcccgagcgataccttgagatgtctgaacagtggagagctccacctctgcccactgaacctgttgagcttttcatcggcattctttctgcagccagccattttgctgagcgtatggctgtaaggaaatcgtggatgatgtatacaaggaaatcatccaatgttgtagctcggttctttgtggctctgaatggaaagaaggaggttaacgcagagctcaagaaggaggcagagttcttccaggacattgtcatagtgccttttatcgatacctatgacctcgttgtgttgaagaccgttgccattgctgagtatggggtgcgcgtcgtccctgcaaagtacgtaatgaaatgcgacgacgacacattcgtgaggatcgattcggtactggatcaagtgaagaatgttggaaacgataaaagcgtttacgtagggagtataaactacttccatcgaccactaagatctggcaagtgggcagtaacgtacgaggaatggcctgaagcactgtatccgaattatgctaatggacctggctacgtaatttcatccgatattgctcgctacatcgtgtccgaattcgacaaccagacgcttcggctgtttaagatggaggatgtgagcatgggcatgtgggtggagaagttcaacaggacgcggcgggcggtggagatccggcacgacgtgcggttctaccagtcgggctgctacaacggctacttcacggcgcactaccagtccccgcagcacatgatctgcctgtggcggaagctgcagtccgggagtgcccggtgctgcaacgtcagatgatga

SEQ ID NO: 217 - DNA, 710 bp, Hordeum vulgare
cgcacacctgctgcgacatcgccaagcttgccgcttcctcctccaatgcctcctgctacaccttgacctggtcctcgacaccatgtcaccgccaaagtcactccttttctactaccgcagcagctgaagcataagtccggggattttacggtccctttcatgtgacttaactgactcgcctcttgtcttcgattctacaaggtctcgggcgttttacgtcaccaatcagtgagatgggctcaacctgaggagcctgaagaattgctgcccagctaaagaaaggagagatactggttggtggctgatgatgtcgagggcgtggccacagtgaacgactactagtctgcttatcaggggattgttagggttgtcagatctctcaataggagatgacccaagtgatcgaaggcaggcagcttgatgagggccatcaggtggcctgaggaggtcgatcagcgtgctgagatcgtggcatccaagtgtactgttggtgactttgtgagacccagctatgcggtcagtaagatcgtagtagcgtatgataaatgtaatactatcatgtactccacagtgattgagttaactgctcttcatagtggttgagttgatgagatgagtcttatgggttgtcatgcatcaactgtcctggccgcacaaggtagtatcattctaacattgtttacattgatcctagtatatatggtaaaaaa

SEQ ID NO: 218 - DNA, 716 bp, Zea mays
agttgctgtggctttgtgcgtggctgctgaatgggcatgcagcataaaggcagcaaaaaaaaaaaaaaaaggttgagacgggacgacacagagagaatcaatgactcgtattcccaaatcccaaaaggccaaaaaccatacgccgcccaaatgcaaaagctgaagagggcgggggggcgtccaggttcaatgcatgtacacgaccccccttccgtcttgatctgacctgtgggctgtggcctgtcgctgctgcctgcaactgcaatgcaggtcatctctttcaaaccccacacggccacacggcatgtttcaaagtcaggtccaaattccagcagctctgagctatagaaaaaacggcttgggggcgacggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttccctcagcaggtagctagagatgatcttgctttaattttgtgctgatctcttactcgtcgtgtacgctcatatgcatggggcgacggatttgtctctgatcgttcccatgccgcctcttgtatcttgacttggatctatatatcaatgcaaataaatcatcgatgggtg

SEQ ID NO: 219 - DNA, 2379 bp, Hordeum vulgare
aagttctggttccagaacaagaggacccaaatgaagaaccagcacgagaggcacgagaactcgcagctgagggcggacaacgacaagctgcgggccgagaacatgcgctacaaggaggcgctcagcagcgcgtcatgccccaactgcggcggcccggcggcgctcggcgagatgtcgttcgacgagcaccacctccgcgtcgagaacgcgcgcctgcgcgacgagatcgaccgcatctccgccatcgccgccaagtacgtcggcaagcccatggtgcccttcccggtgctctccagccccctcgccgccgccccgggcgcctccgcctacgacgtcttcgccggggctgcctccgtgctgcaggcgccgcctgacgacaagcagcagggcgtcgtggtcgagctggccgtcgccgccatggaggagctgctccgcatggcgcgcctcgacgacccgctctgggccaccacggtggaccagacgttggcgctggacgaggaggagtatgcaaggatgttcatcgacccacgcggcggccttggacctaagcagtatggcctcgtctctgaggcctcccgcgacgccaccgttgtcatcatgaccccggccagcctcgtcgagatcctcatggacgtcaaccagtacgcggcagtgttctcgagcatcgtgtcaagggcggcaacgctggaggtgctgtccaccggcgtggctgggtgctacgacggcgcgctgcaggtcatgtcggtggagttccaggtgccgtcgccgctggtgccgacaagggagagctacttcgtgcgctactgcaagcgcaacgctgatggagcctgggccgtcgtcgatgtgtcgctggacggcctgcaaggggtcaagtgccggcgcaggccctccggttgcctcatccaggaggcgcccaacggctactccaaggtgacgtgggtggagcatgtggaggtggacgacaggtccgtgcacaacatctacaagccgctggtcggctccggcctggccttcggcgcccgccggtgggtcggcgtcctcggccgccagtgcgagcgcctcgctagcgccatggccagcaacatccccaccagcgacatcggagtgatcacgagctcagaggggaggaagagcatgctgaagctggcggagaggatggtggcaagcttctgcggcggcgtgacggcctctgttgcgcaccaatggacaacactgtcggggagcggcgccgaagacgtcagggtcatgaccaggaagagcgtcgacgacccagggaggccgccgggcatcgtcctcaacgccgctacctccttctggctccctgtcccgcccaagcgcgtctttgacttcctccgtgacgaaacctctcgcagcgagtgggacatcctttccaatggcggcatcgttcaagaaatggctcacatcgccaatggccgtgaccatggcaactgcgtctcactccttcgcgtgaatagcaccaactcgaaccaaagcaacatgctgatcctgcaagagagctgcacggacgcatcaggctcctacgtcatctacgcgccggtggatgtggtggcaatgaacgtggttctcaacggcggcgaccctgattacgtcgcgctcctgccctcgggcttcgccatcctgcccgacggtcctgcagggacaatgcacgccgcggcaggggcaaccggcaccggtgggtcgctcctgacggtggcgttccagatcctggtcgactccgtccccactgccaagctctccctagggtcggtggccaccgtcaacagcctcatcgcctgcaccgtggagcgcatcaagaccgccgtcatctccaatggcggcgcctctcccccgcagtagcttcgttcaattcatcaatcttcctatgttctgtatcagaggagcagcaaaattttggagccttcatcagtgggaagtcaagaacgcacctcagactctccttgccatgtggtgctcatagccatagattgttccctgtgaattcgaccggggaaactccgcgacttcttcgttccatgcaagaaaacatttgccaaaacaagatgcggtcaccactacgcaagggcggttggttcgggtattgacttcatcttcgtgtcggcctctcggatgctgctacctctgagtttcttttctagggttcttcgtcgagtacaaaaaaaccgtaattttcttcagtcagtctgtctgtaattccttcgacttgtcgttgttcatgctgctgtttcagacttccagtgctttgtaggtgcagcagaatagagatttgtgcccatctgtctgtctgttgctttggattgtgggtttataattttgtagcgctcctggtgatccgtcgccatttcaatcccaaaatgtgtg

SEQ ID NO: 220 - DNA, 700 bp, Hordeum vulgare
ctcccacgctctaccatcaaacttcaaaaatgtcgggttggttcgggggcaagacgacggacgccaaggccgacgaggccgccaagacggggccgtccgtccaggaccgcgccatcgaggcgaaagaccagaccatcagcttcatcggcgagaaaagcgaggccgtcacgaaggcggcctccgacaccgccgatgcggccatgaagatggggggagacgccatggggaaggtctccgagacggggcaggccatcacggaccgcgccatcgagagcaaagaccagacgttcggcttcatcggcgagaaggccgaggctgccaagaagatggccgtcgacaccggcgacgccgccaagcagaagtccgccgaggccgcgaagtgtgtcgaggagaccgcggcgcagttcaccggggaacccgccgcccccaaggagcccgccggcaacatgttccagcaggctggcgggcaggtgatgggcgccgctacgggcgccagggacgccgtcatgaacacgctcgggatgggaggagacaaagccgacgccggcagcgccaaatgaagaccggagccctcatttcgtttcgttattcgtgttgctttattttccgttccaagaaactgatttctaggcatgcgtcggtgttacttcctccattgtatgcaaagatgctttgaatatacggatttgcaattctcatc

SEQ ID NO: 221 - DNA, 1059 bp, Hordeum vulgare
cggcgaaaggcatcccggcggcgatggcggcggccgcggcaaggtccggatcccggcgcttgttctccatatccgccctggtgcctccgaagccgccaacccctcccccgaaggcagaccccttcgccagcctcttcatccccgggttaagcaagcgaacaacaactgatggacttagggaagcttttgcaaagtctggtgaagttgtgcatgcatcatctgtaaaaagttcaaggtggtatatgatcagtgcaaaccgttcaggtcctttgacagtgcgtaaagaataccgcaaagtgcttccttctttcataaggccatctgcatcttactccacaaaagcctcagaaaaaagaccaaaacaggagagaacagacttgacgactgttgaagatccctttaatgcccctacctacaatatacctgagaagccggtgacttttgctgagggagcttcttacagtgttgtaatactcgcggggcttggagttgcagcattagctggatatgctgttttcaaggagcttatctttgaaccaaaagagtacaagatctttgggaaagctctagcaagagttcagagtgatagtcaggttacagccaaaattggttaccctataactggttatggtacggaatccagaaaccgtgcagctcggcagcgcatccaaaacagggtttggacagatgaggatggtgttgaacatgtggaggttgcctttcatatccgggggccacatggagctggaaaggtgtttgcagagatgttcaaagataacgccgacaggacatggaagttcatgtaccttcttgttgagttcacagcgccgcaacagggacaagtaatgttagaatcttacataccagcgtaaggatgcgtgagaccatagttgctaggaaccttggtaatatgggttgaggaacagggttgggtcgccgccacctcttacggtagaggtgtggcgaacctcttttgggttaggtgcaacaaagagtacacatttttcggaccccccaaaagaaattggtcaatggcccggttctcttctatacattttt

SEQ ID NO: 222 - DNA, 1006 bp, Hordeum vulgare
caacttcaactctgtcatggccaatgagattgaaagtggctctcgatgctgcccgcgggctcaagtatctgcacgaagagatggactttcaggttattttccgggacttgaaaacatctaacattctattagatgagaactggaatgcaaaattatcggacttcggattggctaggcatggaccacaggaagggctatcccatgtctccacagcggttgttggaactctaggatacgccgcgccggagtacatgcaaaccggacgcctgactgcaaaaagcgacatatggggctatggtgtgctcctctacgagctcatcaccggccggcgtcccattgacaggaaccgcccaaagagcgagcagaagctcctggactgggtgaaaccgtacatctccgatgtcaaacggttccccatcatcgtcgacccgcggctcgagggccactacaacctcaagtccatgacaaagctggccggtgtggcgaaccgctgcctcctccggatgcccaagtcgcgcccaaagatgagcgaggtgtatgagatggtgcagaagatcgtcgacagcgtcgagatcggcccgccggagcctcccctgcactaccacggctcggtctccgggccgggcgcgaagcggaccaagaaagggtcattgaagaggaggctccaggagttcaagttcgggtgccgccagatcgtgtggcggggctggaaaccagagatcataaagacctgctgaaatggatgccaccaccctcctgcctgtgactgtaagtatggctagctgttcatagagatatgaagttcgtaaccggtgcacggtttgcgctgcagcgtgtaacttttttggtcctgtagatttctgtttaaacagtcttttgtttgtgtattaccctggtctgagctgcaagattgtgaatcagtaggttgcttgtgattttggtccagtttcagctcttccatcttgtgcacgctactaatctagtttgtgcacaacttaaaactttc

SEQ ID NO: 223 - DNA, 568 bp, Hordeum vulgare
ttcttccctatccatagttcatggcctattacaattataaggtgctctggtgcaatccttcccgccagacacagattgcagtcaggttcataatagtctagtgcacattacttcgtcggtccgaactaaggaatctgttataaatgttttgaaatggatattgttctctctttgatcagggattgctatatgaaaagaagtggagtttgaaaaagggaacggaatgctcaaaccggaactgctagaggaacgaattttcaatagcataacttgggctcctagaatatggcgcccttgggacaatctatttgattgcagggttttgttccgaagcaaagatatccgcggaggccggttcgttcgtcctattctgatattcaggaccaagaggtactggattctctttcggataggccctgaaaggagaagaaaggctgaaatgccaacggacctctgtctattctctaattcacccgatccgatagtacccgtttttggaacgtccagtgccaaagtcactgaatgggtaagtcaccaatccaatccctttgacaaatcggagaaaacc

SEQ ID NO: 224 - DNA, 1751 bp, Hordeum vulgare
gtccggtgataccgatgtagattcagaatacgatgaggaggatgaaccggctgcacgttgctcagccagaaagaaccaatctaatgagaaaattttgcctgctaattcatggaaagggaggatatatggcctgcaaaagattggaatccgtaaaatacctgagcatgttcggtgtcatcaaaagactgctctggagaaggcgaaagctaccttgttattggctactcttcccaagtcattgccttgcagggataaagaaatggaggagatctcgacatttgtgaaggatgcaatttgcaatgaccattgtctaggacgctgcctttatattcatggtgtgcctggtactggcaagactatgagtgtacttgcagtcatgaggaggttgagatctgaatttgattctggagctctgaggccctattgttttatagaaatcaatggtctcaaattagcttctccagagaatatctacaaggttatatatgaacagttgagtgggcatagggtgggatggaaaaaagctcttcattatttgacacagcacttttcagatggcaagaaaattggaaagcaagcaaaccagccaattgttttgctcatcgacgagcttgatctccttttgacaagaaatcagtcggtgctgtataacattcttgattggccgaccaagccaaattcaaacctagttattataggtatagcaaacacaatggatcttccagaaaaactattgccgcgtatctcaagtaggatgggtattcagcggctgtgttttggcccctataattatcggcaactgcaggaaatcataacaagccgtcttaagggtatcaatgcctttgaagatcaagctattgagtttgcttctagaaaggtagctgctatgtctggcgatgctaggcgggccttagaaatttgtagacgcgcagcagagtttgcagactaccgtgttaaacaatttcaacaggttgaacagactccctcttctgcaaatataggaaatggttttgtttgcatgggtgacatagaagacgctattcaagaagtctttcaggcaccacatattcaagtaatgaagaattgtccaaaatttgggaaagttatactggctgctatggtccacgaactatacaggagtggcctaggtgaagtattgtttgataagctggcagcgactgttttctcttggtgccacgtcaacagagaaatattgcccggatacgatactctcctgaaaatctgttgcaagcttggtgagagcaagatcgttctctgtgaggaaggcaccaagcataagttgcagaagctgcagcttaattacccaagcgacgatgtgacctttgccctcaaggagtccccagatcttccttggctgtccaagtacctctaaatctcatacctgcagcggctaaatttcccagcactccattgcatttctgcttctcttggggagcagcagccctgcctacatgtataaaacttagaaaagaaaaccctgcaccgattgcatatcggttgccatgtaaaccaagaactcagccgtacatcggctttctatagttgccatctcagaaaaaaaaggagtctcagttgtgcgtcggatttgtaagatgtgaaaaaacttgtacttcttttttcaccacatttgtggaacttgtgtgggaccgtgttgtaatgttgtcgcgctctcatttgagctagtactgttacctttaacatgacttatctataacactaaattgttattt

SEQ ID NO: 225 - DNA, 864 bp, Hordeum vulgare
cggcacgaggatcccagcggaagatgcaggccaagaagctgacgctgctgcagacggtggctgccgcgggagtcttctcagccgtctcctgctggtacggcttcatgttcgggagggagtctgcgcggcgcgagctcggtggcatcatcgacgacctccgcagcggctccacgacaggctctgccgcgtcctcctccgactcccacgctcaccccaaaccatagtgtgatcctgctctacagtgtcaagaccaagaatgtccatcataaatgacgaggtgggtattagaagagttaccaagcagttctggtaaaaaagaaacattttcagatgaagatctaagcaattagtagacttatgtttagcaggtttccttttgtgcttttcttacgcaaacaaattatgctacagtatgattgggtcatcaatacctttccttccactgtataacaatggtgtaacattcgttctccagcggccgctggacgttcggaggatggtcgagcaggaggaatgaatgattccaacgcagcgatggttcccgtgacaatacttgcctttcaccgcggtaatgttttatttaacaagataagaagcggaatggagaaaacaagatcgagactgagctatatatgtccagttttgtataatcattcatcgtgcacggacgcctagggctcttgcagaaaggaaggctatcacctgttggggtcctccctaggatttggagcattgttcgcggtggctgcattcttgtgaatgatgcccttgatgtatctactattttcagttttggggatcgaaaggctttccattattagtcatcatgtagcaataaaatatccagtcaatgaccttgcaaaa

SEQ ID NO: 226 - DNA, 6097 bp, Brachypodium distachyon
gatggcggcgcctgggaggagggcggacttctcctcctcgtcggcgcagtcgcccgggccctcgccggcgggggcgtcgggcgggggcggaggagggaggaggctgctcaggacgcagacggtggggggaaacatgggggagtccatctttgacagcgaggtggtcccgtcctcgctcgtcgagatcgcgcccatcctccgtgtcgccaacgaggtcgaggccggcaacccgcgcgtcgcctacctctgtcgtttctacgctttcgagaaggctcaccggctcgaccccaactccagcggccgtggtgtccgccagttcaagaccgcgctcctccagaggctcgaaagggagaacgatcccacattgaaggggagggtgcaccagagcgatgcgcgagagatgcagcgcttctaccgcgagtactacaagaagtacatccacgctcttcagagtgccgccgacaaggctgaccgcgctctgctcacgaaagcgtatcagactgcagctgtcttgttcgaggtcttgaaagcggtcaatgtgtcgcagtctgttgaagtcgatcaagcgattctggacacacacaacaagattgaggagaagaaaaagctctatgttccttacaatattctgccactcgatcctgaaagtacagatgaagctattatgcaatatccagagattcgagcttctgtttacgctctccggaatactagaggccttccatggcccaaggagaacgaaaagaagcctgacgagaagaagactgataaagatcttcttgattggcttcaggcaatgtttgggtttcagaaagataatgtatccaatcaaagggaacatctgatactgttacttgcaaatgtacatataaggcagataccaaagcctgaccaacaatctaagttggatgaccgggcactggatgctgtaatgaagaggctgtttaagaattataagatgtggtgcaagtacctcggccgcaaaagcagtttatggttgccaactatccaacaggaagtacagcagcgcaagcttctctatatgggtctctaccttctaatttggggtgaggcggctaacttgagattcatgccagagtgtctttgctacatctaccatcatatggcttttgaactctatggcatgttggctggaaatgtgagcccaatgactggtgaaaatgttaaaccagcttatggtggtgatgaagaagcattcttgatgaaaattgtgactcctatatacaaagttatagaggaggaagctcacaggagcaagactatgaaatcaaaacactcacactggaggaactatgatgatctaaatgagtacttctggaaagttgactgttttcggctaggatggcccatgagagctgatgcagattttttcaaaacacccaaattggcttatcctaatcgtctgaatggagaggaaagatctgctggcagtgtccattggatgggaaagattaattttgttgagatacgttcattttggcacatattccgtagcttcgatagaatgtggatcttcttgatactatccttgcaggctatggttattattgcttggaatggtggcacaccgagtgatatctttgatagtggagtacttcagcaggttttgagcatatttataactgctgctgttttgaagttgggtcaagcaaccctggacattgtatttggctggaaagcaagaacaaacatgtcatttgcaagaaaactgagatacgtcttgaagttagtgtcagctgctgcttgggttgtgattttacctgtgacttatgcatatacctggacgaaccctacgggtcttgcaagaacaatcaaagattggcttggcaatggtcatcagccatcattgtacattttggctgtggttgtatatttggcaccaaacatgctcgcgtctgggttatttcttttcccgtgtatccgaaggtatctcgagagttcaaattttaaggtcataacattcatgatgtggtggtctcagcctcgagtatttgttggcagaggaatgcatgaaggcccattttccctcttcaagtataccatgttctgggttctccttttagcaatgaaattgacagtgagcttctatattgagatcaagcctctggtacaaccaactaaagatataatgggaacaccaattcggacattccagtggcatgagtttttccctcatgcaaataataacattggtgttgtcattgcactttgggctccaataattcttgtctatttcatggacacccaaatttggtatgcagttttttctacgttggttggtggtatctatggggcttgtcgtcggcttggtgagatacggacattaggaatgttgagatatcgctttgaatctttgcctgatgccttcaataaatggttgattccttctgatgcacacaagaggaaaggtttccgtgctgccttttccactaaaccttcgaagtcacctagtgatgaacaagagatagagaaaagagctgcaagatttgctcaaatgtggaacctaattatcacaagttttcgtgaagaagacctcatagataacagagagatggacttgctacttgttccatactgcaaagatcgtgaattgaatatattccaatggccacctttcctacttgctagcaagattccaatagcgctggatatggcagctgacagtggaggaaaagatcgcgatctgaacaagagaatggggtcggatccttatttttcctatgctatcagagaatgctatgcttccttcaaaaacatcataaataccttagtgtctggacaacgtgagaaagttgttatgcaagagatttttacagttgttgagaaacatataaacgagggaactctgataaaggatttgcacatgagaaatcttccagccttgagcaagaagctcattgaactacttgagttactgcaaacaaataaggaagaagacaagggtcaagtcgttattttgttccaagatatgcttgaggtggtcacaagggatataatggaggatcaagagctcggcggagtactggattcaatacacggtggaaattctagaaaacacgaaggaatgacaccgcttgatcagcaagatcaattgtttactaaagctattaagttccccgtggtggaatcaaatgcatggactgaaaagataaagaggcttcagcttctgctcactgtgaaagagtctgctatggatgtccctacgaacctcgatgctagaaggagaatttctttctttgcaaattctcttttcatggagatgccaaatgctccagaagtgcggaatatgttgcccttctcggttttgactccttattacaaggaagatgttttgttttcattgcataatctagaagagccaaatgaggatggagtttccatacttttctacctgcaaaaaatttacccagatgagtggaaaaatttcctcgaaagggtggatcgcaagactgaggaggaggtccgcgaggatgaaacattggaagacgagcttcgtctttgggcatcatataggggacaaacattgacaagaactgtaagagggatgatgtactaccggaaagctttggagcttcagggttttcttgatatggccaaagatgatgatcttatgaaaggctaccgagcaactgagctgatgtctgaggagtctccactaatgacacaatgcaaagcgatagctgacatgaagtttacttatgttgtctcatgccagcagtacggtatccaaaaacgttctaatgatccttgtgcgcatgacattttgagactaatgacaacatatccatctttgcgggttgcctacattgatgaagttgaagcacctagccaagacagaatcaaaaagattgacaaagtttactactcagttttagtgaaggcttctgttacgaaacccaatgatcctggacagagtcttgatcaggtcatctacaagataaaacttcccggaaatgctattctaggtgaaggaaagccagaaaatcagaaccacgcaataattttcactcgaggagaatgtctccaaactatagatatgaatcaggagcattatatggaggaggctttgaaaatgagaaatctattgcaagagtttctggagaaacatgatggtgtgagatatccatcgatacttggagtaagagagcatatatttactggcagtgtttcatcccttgcatggttcatgtcaaatcaggagaccagttttgtcactattggacagcgtgtgctggccaatccattgagggttcggttccactatggtcatcctgatatatttgatcgtcttttccaccttacaaggggtggtataagtaaagcatctaagattatcaatcttagtgaggacatatttgcaggattcaattctacattacgtggaggcaatgtcacccatcatgaatacatgcaagttggcaaaggaagagatgtgggtcttaatcaaatttcactatttgaggcaaagatagcaaatggtaatggtgaacagactctgagccgtgacatatatcgattggggcaccgttttgattttttcagaatgttgtcatgttactatacaacaattgggttctatttcagtacaatgattacagtttggactgtgtatgttttcctttatgggcgtttgtatcttgtcctcagtggacttgacgaagcacttgctactggaaagaggtttgtgcataattcgcctctccaagttgctcttgcatcagagtcttttgttcaacttggatttttgatggcattgcccatgatgatggaaattggtctagagagaggattcagaacggcattaagtgattttgtacttatgcaacttcagttggcatctgttttctttacattttcacttgggaccaaaactcactattatggaaggacgctactccatggaggagctgaatatagagcaactggacgtggatttgtggtgttccatgccaaattcgctgagaactaccgactctattctcgcagccattttgtgaagggtattgagctgatgattctgctcgttgtatatgaaatctttggacagtcgtacagaggagctatcacttacattttcatcactgtttccatgtggtttatggtgggcacgtggctctttgcaccgttcttgttcaatccttctggatttgagtggcagaagattgtggatgactggactgattggaataagtggatccataaccgtggaggtattggtgtggcaccagagaagagctgggaatcatggtgggacaaagagcagggccctcttcggcactctgggaagcgtggcactgttgttgaaatactgcttgcattacgcttctttatctaccaatatgggcttgtgtatcatttgaatataaccaaacagtataacaaaagtgtgctggtttatggcatctcatgggttgtgattttctccatgttgcttgttatgaagaccgtgtcagtcggcaggaggagattcagcgcggagttccagctcgtcttccggttgatgaagggcctcatattcatatcattcatctccacaatcgtaatcttaatagcactcgctcacatgacagttcttgacatcttcgtctgcatcctggctttcatgccaacaggatggggtttgcttctgattgcccaagcgatcaaacctgttgttgagatggtcgggctctggggatcagtgaaggccctcgcacggggctatgagatcctgatggggctcctcctgttcacacccattgcattcctcgcatggttcccgttcgtctccgagttccaaaccaggatgctcttcaaccaggccttcagcagaggtctgcagatctcccgtatccttggtggccacaagaaggaccgagccacccggaacaaggagtagattcattggtcccctgccgactctgaatctgatgttaacagattcgtagactgggaggttgtatgatagactagttagtattctccattgtaggtgtagattgagaaccattgcgccctccctttgtgtgtaaagcactactgctccgtagcaaggtggatgaaccctatgcagtaatgtttaaagtgttctgcgaag

SEQ ID NO: 227 - DNA, 1661 bp, Brachypodium distachyon
cccccgtccctcctccataaatggaagcgctcgctatcggatccgtgccttcccggccaggcctaccacctccgacccgccactcccatcttcggcgccccaaaaccctactcgcctccgcgcccccttgccgcatcatcgccgccgttcccatggacggcgccgccagccggagccccgcgcctctccgctgcactcccgccgagacggatgctgtggcgacgagctcggacgagacggcggccacggctgaagccacccagcagggcgacggaatcccagtggaagatgccgccgcaagcatcgagggggtcgacgggataaagattcggaggcgcccggtgacggggccgtcggtgcactacgttggcccgtttcagttccgcctcgagaacgaggggaacacgcctcgcaacatcctcgagaagattgtgtggaataaggacgttgaggtttggcagatgaaggagagaaggcccttgtacatgctgaaaggtccgctggacaatgcgcctccagcgagggactttgtagcggccctgaaagcatcatatgatcggactgctctgcctgctctgattgcagaggtcaagaaggcttcaccaagccggggggttctgagggagaattttgatccggtcgtgatcgctcaaacatacgagataaatggagcagcatgcttaagtgttcttacagatgcaaaatacttccagggaagttttgacaacttggaggctatacgcaatgctggagtacagtgtcctcttctgtgtaaagagttcatcattgatgcctggcaactttactatgcacgttccaagggagcagatgctgttcttctgattgctgctgtcttaccagatcgtgatatcaagtatatgctgaaaatatgtaaaatacttggcatggctgctttagttgaggtgcatgatgaaagggaaatggaccgtgttctagggatagatggtattcagctcatcggcatcaataaccgtaatcttgagacttttgaagttgatatctcgaataccaaaaatcttctggagggtgaacgaggacaacttatagcccagaagggaataattgttgtaggggaatctggactgttcacacctgaccatatttcatttgttcagaatgctggggtcaaagcagttctcgttggggagtccctcatcaagcaggaggatccagggaaagcaatagctgggctttttggtaaagatatctcacatgcgagtgctgtgtaaataacgaaatgccggatcgctcatattttgtataggaaaatggagcgtttcactttttttggagagtttcggccggcaattttgtttacttggccattatctgccttcttctttcgctgccttttcttgcaccttttttttttaaaacaaactagtaatacagtacaagagatgcaacacaaaagatgtgatccaataagttggatgtagcttttaggagctcgagttcatttaccttcatagatctgctcttggcacttgttagccagaatactattgttatactttgtactctgtattagctttgtatttccttcccacgatctccactcggtttccctcagcagttattctataactcatatatatgtactctgcacacgatcagtcaatcaacaacgattctgtatc

SEQ ID NO: 228 - DNA, 2388 bp, Brachypodium distachyon
cccaccccagcccacgcgcaaggcatggccgcagcggcgtcgcacaagcccctggccgcgatcaccgccgacgacctcgccgcggcgggggccgcggaggccgccgcgctccactcggcggtaagtcgagcgctcggtgccaaaggcagcggcgggcccgccgcggtgtgggcggagctctcgcgggccgcgctccgcccggacgtcccgttcgccgtccaccggatgctctactacggctgctacgccgggttcccgtcccccgcaccgcccgcctggatgcccgaccccgaggaggcggccctgaccaatgttggccgcgtcctggaggcgcgggggagggagctcatcggcgaagcgtacaaggacccgatcactagcttccgtgacttccacaaattctccaacgagaaccccgaggcatattggaagatgatctttgaagagatgggtattacattcagcgtggagccatcttgtatcttgcgtgacaacgatgcgtacccaggtggcgaatggttgccgggggctgtgctgaatgcggctgcaaattgcctgaatgctaaacctggaaggcgttccagcgatgttgccattgtgtggagggatgaggggaaggattccgagcccctcaacgttgtgactcttgaggaattgaggaaaaaagtctgccttgtggcaaatgcgctcgattcactggatctgacaaagggatctgctattgcaattgacatgcctatgaatgtgaatgccgttattatctaccttgcgatcgtgttagcaggctatgttgttgtctctattgcagacagctttgctgcacctgcaatatcgacgaggctaaagatatcggaagcaaaagcaattttcacccaggattgtatccttcgtgatgacaaggaactgccattgtatagtagagttctggaggccaaggcccctatggctattgtgatccctgcaaggggatccacaccgataaaaggactccgtactgatgacctttcatggcaagatttccttggaagggctgatcgtaccaaggctgatatttataccacagttgagcaacctgtctatgaatttagcaatatactattttcatcagggaccacaggggagccaaaggcgattccatggacacatttgacccctcttaaggcagctgctgatggatggtgtcacatggatattcggaaaggtgatgttgttgcttggcctacaaaccttggttggatgatgggtccctggcttgtctatgcttcgctactgaatggagcttccatggcactgtataatggttccccgaatagttcaggttttgcgaagtttgtacaggatgctaaggtgacaatgcttggagtggtacccagcattgttcgtacgtggaaaaatacagattgtactgcaggatttgattggtcaaccatcagatgctttagctcaactggggaggcatctagtgtggatgattatttgtggctgatgggaagagcttgttacaagccggtaattgagtactgtggtggcacagaaattggtggcggatttattactggatgcctgctgcaacctcaagcattgtctgcattcagtacacctgccatgggttgtaacctgtttattcttgacagtaacgggaaacccttaccacaggattctgctggcattggagaacttgcgcttgatccaacattatttggatcatcaacgatgctgctaaatgctgatcatcatgaggtgtacttcagcgggatgccagaatggaatgcgaaagtcctccggaggcatggggatgaatttgagcgtactgcagacggatattatagggctcatggacgtgcagatgacacaatgaaccttggtggtattaaggttagttccatcgaaattgagaggatctgcaacagggtgaatgatgacattctggaaacagcagctattggggttccacctgtagggggtggccccgaacaattaaccatagccgttgtattcaaagaccaaagaccacaagctgaagatttgaatcaactgaaactaatgttcaactctgctctgaagaaattgaaccctcttttcaaggtttcatcagtcatcgtggtgtcatcacttcctcgaaccgcctcgaataaggtcatgaggagagtcctacgaaaagagctcaccctggcaaaacattctaaaatctagatagttaggaagaattttccgcaccttttaaagtttcacggagttaccaatttaactgtgaatatatacacatacgagctcatgtctttcaaacttcggttgtattattacacgtccaatgtacagcatggatagtttactttgatctttgatgtgacatggaagatgaggtactaataaagcatggttacttcc

SEQ ID NO: 229 - DNA, 503 bp, Setaria italica
cttggatcttgttcaattcaggagctacaggaactggagttgcagttggagaagagcctaagcagcatcaggcaaaggaagcaaaagaagctgatggatcagattttggagttgagggagaaggagcagaaactctcgaaggagaatgcgatgctccgcgatcagtgtaaagccctgcctctgctggagctgaatgataagggccgtgtggatgctgctgctggtggcggcgaagaagaagaggatgatgtgcgcatggaggacgtggagacggagttggccatcggaatcggaaggagacggccgagtaatactagtgttggcgacgatgcatgagagctagcgcatgatgatgactagcaatcaatcaactgatcgatgatgatgtatttatatatgcatgtatgcccccgtgctcttggattaagatatacatacgtgttgataaagaagaggacacggtctctggtcgatgaataacatattttgcatgctggggatgc

SEQ ID NO: 230 - DNA, 601 bp, Setaria italica
gttgcatcatgcagtactgcatgcaagggttcatggcgccgacataggtagcagcagtggcgcttgcacaaagagcaagaagacacgactgcagctctgtacgtgcgctagctagctgttttacaagcaacgccagcgcgctccacaccccagcgaccgaccgagacgatgtatccggcgaagcccagcgtggcggcggcgtcggcgccggtgaccggcgtccccatgggcggcccgcctgtcgccgccggcaacgccaccagccagtggtcctcggggctcttcgactgcttcgacgactgcgggctgtgctgcctgacgtgctggtgcccgtgcatcacgttcgggcgcgtcgccgagatcgtggaccggggcgcgacgtcgtgcgggatgagcggggcgatgtacacgctgctggccttagtggcctacctcacggggttcaggtgccagtggatctactcctgcacctaccgctccaagatgcgcgcccagttcggcctccccgagaccccatgctgcgactgctgcgtccacttcttctgcgagcgttgcgcactctgccagcagtacaaggagctcaaggcccgcggcttcgacc

SEQ ID NO: 231 - DNA, 1372 bp, Setaria italica
gcgcctcctgcgacaccgcggcattcacggcgctcttgatggtggccagagccctggggcagaccacgggtaacccaaaataatctggtcttgtagctaataacaatggcctctgcctcttgccttagcctgttggtgctggtggctctggcctcgtcggcgtcggcgcagttgtcgtcgacgttctacgaaaggtcgtgccccagggctctggccaccatcaagagcgccgtgaatgccgcggtgtcgcaggaggcgcgcatgggcgcctccctgctcaggctgcacttccacgactgctttgtccaaggttgtgacgcatccgttctgctggcggggaacgagcagaacgatcctccgaatctaactctgagaggcttcaacgtcatcgccaacatcaaggcgcaggtggaggccatctgcaagcagaccgtctcctgcgccgacatcctcgccgtcgccgcccgcgactccgtcgtagcgctgggagggccgtcttggacagttccgctggggagaagggactcgctgaaagctgcaagcacgagcatggtgttgcagaacctcatcccgcctacatctagcctcactcaactgattcaagggtacgggaacttgggcctcaacccaaccgacttggttgctctctcaggtgcgcacacgatcggccaggcgcactgcccgagctaccaagaccacatctacaacgacaccaacatcaaccaggcgttcgcggcgtcgctcaaggccaactgccccgcgacaggcggctccaacgtcatggcgccgctggacacgacgacgcccaacgcgttcgacaacgcctacttcaagaacctgcagtcgcagaaggggctcctgcactccgaccaggagctcttcaacggcggcagcaccgacaacacggtccgcaacttcgcgtccaacccgtcggcgttcagcagcgccttcgtgactgccatgatcaagatgggcaacatcagccctctgacggggacgcaaggccagatcaggaccacatgctccgcggcgaacccgtaataacgtacaagctaggatacacatatacgtgtgtacgaataaacgatgacatgaacgaataaggtctcattacagccatcacaaaatagcaagcatcagctgaaatagcatgccagctcgcttttcttgttccatcaagtcttgtacggaacagagagcatatggacattgttgtatgcatgtaacattctctttgctaaagcatggaggattattgctaagcaaagagaatgttaaactatgtttttgctaaacatgttgtgccttctttaccgtagtttccttatctgtctaaccgtttttttcatgttgaaaggatggcaagagccgc

SEQ ID NO: 232 - DNA, 5297 bp, Setaria italica
tttgcctgtgtcatcggttgagaatgtctgtagctaaattctgcgagcatgcgggtggaactccagaaaaagctggtgaaattgtccacgtggagaatggcatgactattgcgcaatggttcaaattctgcataggagtggcgggatctattgctaataccaggtgggattggccagactgggcatgtatgaaaagttctccagaagaatacatgttgaaaagtcttgcttcaagaaacagtggtacaggaaaagtaaggttgttaggtggatatggaaaaatcaatggacttataaacaacccagcttattccagcgatctgtacatcgaaggtggaggatgcactaatgttgataagcaaatgaatgggtcagttggaacaaattacaaaaagagcgttgatgtgcacgaaggtttaacaaaggactctgctttactacagaattccacaacaatgaatgtagggctcgctagaaaccatacggttcatgcattaaacctgaaccctcttagcacacctagtggaagcctacactctgaagcaagcatgggaagacattacaaaggaaatcacttggcacataattatggaatctgtttggagaaaaaccttgatgcctcttttcgtaatcctgagccacgttcctcaagagttgtgaaccatgatagtagggcgtgcagacctgatttcccccacaaaatattgcaggacactttgtgcaacacttcaaacactgaattaaagcttggacaatcttcttatcatcaatctatgaccactctatttccattggtacagtcggcggtcattgaatttcagaaacctcaatcacacaggccattgataaatcagaatccttgcccaaagcaagcaacaaaggtcaacaacaatctagctgaacctgaacataatggaccatccattagtactggaaataagcaaccacttctagttactaatggaacaaaacattctgaagttggtgagcttacggatgatacatccaagaattcatttatctcattatttctttcacaccttgagagaaatagtacacctgaacccattgacgatattctcaacagtaacgagcattatcatcctaaggccctggatgtcgcatgtggttctgatcatccaaaaaatgccagtagacatattgagacaagggttaatgataatcatccaaagttggccccaaccattattcatatgaaaaggagatcagaaggcatttctctttcagcatcttacagtggatataatcctcaagatgcatcccatggtaatagtcaggaacatttgattcatggggattgcccatcacatttgctgcctaatcaacctaatgctggaatctcaaattgtgcaagagtttcatgtcctgcaaattgcatgtgctgcactcacatgggtaataaatcccatcaggttgcacatggtgagattggggttccctgtttctatgataaaatggccaggggccatggtacttttgagcgagttgatgacttatgcacacatagaagtttgagagcttttgccaaaatcagttgtgagaatgggaaatcttgctgttcttctcaggagtttctacctagcttttgccaaaatgatccgtcaacactcggaaaatcgatttgtggatgctgttgcaaaattcaggaaggtgtttccaagcttggttttatacctggtcacttgtgcagaactcgtttttctagtgatcttggtccagttgtatcaagtaagcctacccttgaagggcaagatgaactttgtgcctgctccagttttatgcaaagatcgtcattatgttctcgagaacacatcttgcagtcttgttatgcatgccccattgatggattgcactacagaaattccatgggacatgcaacagacagcttgacaaaacactctctgtttgatggacgtagcacaaaagaacaaggtccttgttgcaatggaagatgttgctattctgtagtcccaaaatgtttgtctagttgtgcctttacaaagcactgtgatgtcagagttgatcaaattggtcatactgcacctataagcaaacaccagatgcaaatgcctaccagatgctgcacattagaggagaatgagaaattaacatgccaatgcttaagcaatagaattgcaggaagaagcttatctcaagcttctcgttgtaaagatgtctctgataaagtaatgaaccagccttctattgcaataacggagaggctgaagaatatatccgaagcttcagtggctgatgatagttcgtccaaagccgtaacagagagaaagggcccttctaaagattctgtagtatctaaaggacaaccaaagtttggtttctcttctggatcatcaagcattgtggttacaaagtttcagatgtcacctgaagttcacaaagtgtcatctactgctaaacataggaaacataaaaatgtatgtgatgaaggatcaagaattgagaaatgttcagcatccagctatgtgcctgccagtagtacaggatgtgaggaagccctaaatagttttaccagatctcagttggctccatctcgagtgaagcgcaagggtaatcagatttctgtgggaagtagactagaggaaaaggacaatgaggagctttgttttgggctgccaaaaagaatgagaacattgaggtgctctagtaaaaattctgaatcagaagattgtactaggactagttcccagtcgtcccagaaggggggttgtcaaccacaaaatgaggttaactcattttcttgcagggtgttgagaaccaagcgaaaacatcctaccatgcaactgaataagcctgtgaaacagcttcatagccagaacaaggttttcaaaggtgatggcaagctaccagataccaagggaaatttttttggtggattagattcctttgatagaaaaaaacaagtagaggatacgactccgggtagaacaaaacatcaccaggaagggagtcgagcatttgtccgcaaactacctaaatatgtgtctctaaactgcattgttaatgaacctaacagtgaagatgcttgcagtgggagtgctggaattgattcaagtttaattgccacgggaatggcaaatgataaccgaaaatctcccaaaatcgttccactcagtctggttcttaaaaaggctaagagatgtcattctgttaaactctgtaagaccgaaagcacccacttgtatgaaaaaaagggctcagattgttctgtgaacagctcatcagattgttctgtagataagtgccccattgatgatgaaggttgcagtccacaagctgaatatgaaatgcagggttccaaaaggagtaggtattcatctaatggtttgaggtcacattttatggctcactgcaaaagaccatctggtgttcttggagaagatgatcctcttggtctaaaagatatggaaacaaatcgcctgtcaataacatcatcaagaagtaatgggaccaagaatcgaagagcaagtgtatcccttactaggattaagaggcataagaaatttgcaaacaaatcagcatgctattccagcagtggcaaagaaaatgctgtgctaacccatgaagaaaatgttaggagagacagtggaagactcagcttagatgctccatgctgcgtttgtggaatctcagacccagagccttgcaatcaatttatagagtgctgcaagtgctatatcaaagtgcaccaagcttgttatggtgttctaaaagttcctagaggtcaatggttctgtagaccctgcaagactaataccctgaacacagcctgtgtgttgtgtggttatggaggtggagctatgacaagggcactgaaaaccaagaatattctgaaaagtttgctcaaaagtttgatgactacagcaagatcagaaaaaaatgttgattcattaagaaacggaaggagtgagtgtacaagcctgcgaaatccagtagacagtgcacgtggggatagcattgcgaatggggagaacattaccagcaattcctggacctctattaatcacaattccagtttacttggaccacgaacaatgcagtgggttcacatggtctgtggactttggacacctggcacaaaatgcccaaatgccaccacgatgagtgcttttgatgtatcgggtgcttcacctgccaagagaaatactgcatgttcaatatgtggcagaactgggggctcatttattaagtgccgagatgtaaattgtttggtgctctttcatccttggtgtgcacatcagaggggtttgctgcaaagtgagcctgaaggtgagcgcaatgaaaatgttggcttttatgggcgatgcatcgatcatgctaatgatttttctagtcgcattaatcctaaggaatgcttgagaagcagcagctggacatgcgcacgtacagagggttttaaaggtcgaaagggagaaggctttcatggtagtagtcacaagaaatctgaagagtacagtggtgagttcagtgtttcccaagaacagataaatgcttggttacgcataaatggttcgaagcctagcgggagaggacagaaggaatacatccattataagcagttaaaaggatggaagcatttggtagtgtacaaatctggcatacatggacttggtctctacacatcagtgtttattccgcgtggctctatggttgtagagtatgtgggtgaaattgttgggcagcgggttgccgacaaaagagagatcgaataccagtctgggaaacgactacaatataagagtgcctgttatttctttaagattgacagggagcatattattgatgccacccgcaaaggtgggattgcaagatttgtaaaccattcatgccagccaaactgcgttgcgaaaataatctcggtcaggaatgagaagaaggtaatgttctttgcagaacgtcacataaacccaggggaggaaattacttacgattaccactttaaccgtgaagatgaaggccagaggatcccttgcttctgtagatcaagatactgcaggcgttacctcaattagtttactattgtgccatcttactgtgtaacatgtctatatatcctttatttttcatcctttagaacacttcattgcatgtctgggagaacaataaactgcttgatgtatataaactctagggacttgcatctggcagtgccagtttatcttttgtgaagccaaatgaactatcagctgtatgtgcaccctagggtctttcatctgacgcaaaatttaatgttagtggtcaatgggaaagaaaagctg

SEQ ID NO: 233 - DNA, 3118 bp, Setaria italica
gttctggaagctctccggagatgaggaggggtagaggacatggaggaggaggggtatccgcgtccctcgccgcgctgctgtgctgcggctgcgtcatggtcctcgccggcgcagccgccgcgcaggggccccggcttccctccgcgtacaaaaccctaagaggtgatgctccacgagttgtggccaaaggcgggttctcaggagtgtttcccgactccagctcagatgcctactcctttgcgttgatcgccagcgcacccggtacaactctgtggtgtgacgtccagctgacaaaggatggcgttggagtctgccttcgggacataaacatgaataattgcaccaacgtcgcccacacttaccaggcgagaaagcggacctatgtcatcgatggcgtgcggaaaaatggatggtttgctctggactttaccaaggatgagcttcagtctgtttctttaacacaagcaatttggtctcgcacctacagattcgattctgtcggatattctatcctctctgtcacagacttgctgtccattgtcaagcagccttctgtttggttgaatgttcagcatgacaccttctacaaagaacatggtttgaacatgaggaactacatactttccatccaaaagcgtgtatctgtggattatatctcgtcacctgaacttggcttcctccaaaatatatctggaacagttcatcgcaaaacaaagcttgtgtttagctttcttgataaatccctcttggatcattctataaaccaaacatatggttcacttttgagtaacctaacgcttattaagtctattgcatctggcataatggtcccgaagacatacatttggccagtgacaaaggataactatctacagccgtccacatcaattgtcgccgaagcccacaatgcagggctggaaatatatgcctctgattttgcaaatgatagaattattccctataactacagttatgatccattggcagaatacctaaactttatcagcgatggtggcttctctgttgatggtgtattgtcagaacaccctattactgcatcagaggctattggttgcttcgctaatctgaattcaagtgagactggtcatggggaacccttagttatctcgcataatggtgctagtggagattatccagactgtacggacctggcctacaatagtgcaattaatgatggcgcagatgtcattgattgtcctgttcaagtgacaagtgatggagttcttatgtgcatgagttccattaacctgcttgataccacgaatgtgcagggaacaactttcagctctcttagttctgttgttccagaaattcaggctacagcaggaatcttcacattcaaccttacttgggatgacattaatagtagcaccttaaaacccaaaatatcttccccagtgagtgattattatcttgtaaggaacccaaggtacacaaatcaagggaagtttctgaacttatctgactttctagcaatcggaatggataaggatttgtctggtgtcatgatcatcattgagaatgctgcatttgtggcaaagtcattaggaattgacatagttgattctgtaaatgctgccttaagtgctgctggctatgataatcagactaccaagcaagttctgatccagtcgaaagatagtgctgttcttgtcaaactgaagcagcagaaaacaaaatgcaagcttgtgtacactctccccttaggcattggggatgcttctacttcctcattagaagccatgaagaagtttgctgatgctgtagttgttgataggaaatctgtttttaccttaagtcaagattttgcgatccgacagaacagtcttgtgaaagatctacagtcagcagggctagctgtgtacgcacaggtgttccggaatgagtttgtatcacaaccgttggacttctttgcagatgaaactgttgagatcaattactatgttcaatcatttaatctgtcaggcatcataactgacttcccgaagacagtcagaagatacaaaaaaaacacttgtacaggtttgggaaatgacatgcccaactacatgcagcgcattgacgttggctccctttaccagttacttcaacccttcaaagcccagccgccatctgtgccgccaatgccgacactgaatgcttcaagcgtggaggaggcaccgcttcctcctgttgcgtcaagaaatgggtccggtggttcctcaagtggcgccgaaactcctggtgcgcctcctgctgctgctcacaaggctactgtaagtactggcatgctgtttgtaatggttttcacagctcttctgatctgagcaaaccatgaggctgtatagtaggctgatctgagcaaaccttgaggctgtatgattcaggcaagcttcgaccgatgttttggtgctcccaagcacttgtttctgtagctgtttcagtatgtccctgcatattcgtttccacctgtataaattccccggtagaaatgttacactattcagcgagcattggtgttatacattgctaatggaagccacagttcctggtgtttgcacatcactgctctgcatagatcctcatactgagctaaatgacacggtacatgttcagcaaattggcaagccttacccttacgcacataacaaattttcctgatgtcagttaaaaggtgaacatttcttaggactaagctttgtctcctaaagtgaagaacagcctaagaacatattgcaactatgctctcggtcacagtatcaactatcaaacattagcatataagatagagcacgactgcggaggacaatcctctgtatgtacaacactacattgaaccaggaagcagcagaagctatgacgcaccaaagccgctgctcacatgttcctgaacgatcacacgcagccggctttgcatcatgctggatgaagtgtaagctggcagatggaggtggtagaagcaggtttgcgaagtggggagatggtcgcgggagctggaggccctgtatatgaacagcctgcaccccagtccccagaaaccatctgacggcaaacatttcactgaggtccagaagaaaagtagcctcccctgctgttcgaccgtcatgttttccacggc

SEQ ID NO: 234 - DNA, 515 bp, Setaria italica
aggctctcgagttcctggggatccatggcgaggacagcagcccagtttctgttcatgcggatcagctggaggtcgcggtgaacctgataatcacagactactgcatgcctggcatcacaggatatgatcttgacaggatatgatctgctcaagaaggtcaaggaatcatcgtctctaagagatatcccagtgctgatcatgtcatccgagaacattccttcaaggatcaatagatgcctggaagaaggagcggatgagttttacctaaaaccagtgaggctatcagacatgagcaagctgaagccccacatactgaaaagcagatgcaaggagcactaccaggaacagcaccagcaaagcgacagcaacagcaacgaatgcagtaaccccacaaacgacagcagcagcagcagcagcgataacagcaacagccgcaagagagaggcagaagacaacgaagaaattttgccccagagaaacagatcaaggcacagttagctgcaaactgattatag

SEQ ID NO: 235 - DNA, 2736 bp, Zea mays
atcgtactagtggtaccaccacacacagccccctgtgccctcctgccgtccgtgacgtgacgcagccgagccgcgcgcgcgctccgggccggacgcctccgctcgaatcgatggacgccgaggccggcgtcgccggcgccgaccagcttccgcggaggcagtactacctgaatctactgcttttagcttaccagagctttggtgttgtttacggggacctgagcacatcgcctctctacgtgtataaaagtacgttctctggaaagctcagacactaccaagacgaggagacagtgttcggcgtactttcgctcatcttttggaccttcactctgattcctttgcttaagtatgtcatcatcgtcttgagtgctgatgataacggcgaaggtggaccattcgctctctattcgctcctttgcaggcatgcaaaactcagcttgctgccaaatcaacaagcagctgatgaggagctatcttcatactatagaaatgggttcgcgcctcgcaatggatcttcaccttggtcaagaaggtttctggagaagcacaaaaaaatgaggactctgtttcttctcatagttctctgtggcgctagcatggtgattggtgatggtgtccttaccccagcaatctcagtactctcgtctatgtctggattacacgttcgagctactggtctacatcatagttctgtagttctcctttcatgcattgtgttggttggtctatttgcattgcaacaccgaggtactcagaaggttgcattcatgtttgcaccaattgtcatcatctggctgctttccattggaggaattggtttatacaacattcttcattggaacccaaatgtatatcaagctctctctccatattatatggttaagttctttagaaagacaggtaaagatggatggattgctttaggagggatccttctttctatgacaggcagtgaggcaatgtttgctgaccttggtcactttacgagtgcatctgtcagggtggcttttattaccgtcatatacccatgccttatgctacaatatatgggtcatgctgcatttctgtcgaagaacacatttcacatgccgacaggtttttatgatactatcccagaaccagtgttttggcctgtctttgtggtggccacacttgctgctgttgttggtagccaagctgttatttcagcaacattctccattgtgaaacaatgccatgctttgggatgtttcccgcgagtgaaggttgtccacacatcgaggtggatctatgggcagatatatattccagaaataaattggattcttatggttctttgcgtcgctgtcactattgcatttcgtgatactactcttattggcaatgcctacggtattgcatgcatgactgttatgcttgttactacattcttgatggcattaatagtcatctttgtttggcaaaggaacataatattttccctagttttcctggttttctttggatccattgaagctgtatatctttcgtcatctctcatgaaggttcctcagggaggatgggtgcctcttgtgcttgcattcatattcatgtcagtcatgtacatctggcactatgggtcaaggaggaagtaccagtttgacctacagaacaaagtatcaatgagatccatcctatctctcggtccaagccttggcatagttcgggttcctggtgttggattgatttacacagagctggtcactggtgtaccctccatcttctcccattttgtcacgaatctccctgccttccatgaagttctagtctttctctgtgtgaagtcagtgccagtgccatatgtttcaccagatgagcgataccttgtgggtaggattggacctaaagaatatcggatgtaccgttgcattgttagatatggttacaaagatgtgcagagagatgatgacaattttgagaacatgttagttatgagcatcgcaaagtttattatgatggaagcagaagatgcttcttcagcaagttatgatatcgctaacgaaggaaggatggcggtcataacaaccactgatgcctctggcagcccattggccatgagggatttcgacggcctagctgactccatgtctacgaggagcagtaaatcagaaagccttcgaagtttgcaatcctcctacgagcaagaatccccgagtgtaaaccggcgccgccgtgtccgctttgaggtcccagaggaggatggcatgggtcagcaagtgaaagaagaactcacggcactagttgaagcgaaacatgctgggatcgcatacatcatgggggcattcttatatcaaagccaggaggaactcaagtttcctgaagaagtttgctattgatgttggttactctttcctccggaagaactgcagaggcccatcagtcacgctgcacattccacacattagtctgatagaagtcggcatgatctactatgtttagcttaatgcccattgccaaagctcacatgtggatacccggtcgggacaatgcttgtgctgtctgcggattgtggtgtggaaggagttcaggcttgttcgttctgggccaagtttcagcttgtagagaagaaggcagacttctttgttaatattatttttagcctaaataaaccagcacaatgttagacggtgatgtttctcatttggcatatttgcatgcatgctctgtaattttttctgcgagctatgtgatggaaatatatgcatcatctttata

SEQ ID NO: 236 - DNA, 2602 bp, Zea mays
agtgggtgtgcgagcgggcggacgaaagcaacgccccaacaacctgatccctccccttcaccccatcgcacgccacaacaaagcagagcgcggcgctacacctacacacctccacccggaccacccccccacagtcccacaccacaccacgcagtgccgtgccgcactgctgtcctgcaatctcccataaactcactcgcctcgcctcgcctcgcctcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcaggatgttcgggcgggacccctggggcgggcctctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcgcagcgatccggtccgctgccgaagcacaacggcgtcagctggaggggcaattcctgcatgaaggatggcctctccgacagcaccgtccgccggagcttggtcggaggcttctacgatgcgggggacgccatcaagttcaactaccccatggcctggtccatgaccatgctcagctggagtgtgatcgagtacagggcgaagtatgaggccatcggtgagctcgaccatatcaaggagctgatcaagtggggaacagactacatcctcaaaaccttcaattcatctgctgacacgatagacaggattgtcgctcaggtgggtgtaggtgacacctctaaaggcagcagtcagcctaatgaccattactgctggatgagaccagaggacatcgactacaaaaggccagtcaccgagtgtcactcttgctcagatctagcgtctgaaatggctgctgccctggctgcagcttccatagtgttcaaggacagcaaaacctactccgacaagctcgtcaaaggcgcaaaagccctgtacaagttcggaaggctgcagcgcgggcgatacagccccaatgggtctgaccaggcaatcttctacaattccaccagctactgggatgagtttgtgtggggtggtgcgtggatgtactttgccacagggaacaattcatacctcacggtcgccactgccccaggaatggcgaagcatgctggagcctactggtttggaagtccaaactatggagtatttacctgggatgacaaacttccaggagctcaggttcttctcagcaggttgcgactcttcctaagtccagggtacccttacgaagaaatactgaggacattccacaaccaaaccgacaatgttatgtgctcatatctgcctctattcaattcattcaacttcactaaaggaggactaatacaactcaaccatggaaggcctcagccacttcagtatgctgtcaacgcagctttccttgcttctctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgattcctccgatgttcccaacacccccgccgccgccatcagcatggaaaccatagaggcaatacctctgaatgtttttccaaagcatcgaacagggaagtggagcaaacgtgtgatcatttggtacagcgaaggccagagacaggaaagctgacagcataagtttatagagcttctatttctgtaccaatatgacagatcagtataagatcctctgtcagacatagatcggaagctgtgtgcatcgcgtggagctaatttttgggggtcttgttgctattggcactccagctcatgtgtgaagttctttttgtagaaatggtacctttacaaattgttttataggagtgacttttcattattatagtaaagaatgcgtgtgatctctatgcttgcttca

SEQ ID NO: 237 - DNA, 3328 bp, Zea mays
cgtctccgtactggtacggggacgtctctttctcgaaattctctgcccgcaagcctactactacaacttctgcagccgcccgtccgtctccctcccccaaccgagtatatttatcaggccccttcccccgccccggcgccctccttccccccgctcctgtgcgcgttgtttctcgtcgccgtcgtccgtcctccggcgtccggcaacctgcaaccggcgacgacgatggaggcggcgctgggggcgctgtgccgcgccggaggctggtcgtacgcggccgtctggcgcttccatccccaagaccctcgattgctcacattgggggactgctactgtgaagatgaggcaaaagcaatggttcagaagatgcttaatcttgttgaagttgttggagaaggcatcctaggacaagctctagtaagcggagagtgtcaatggatttacgacgatacttgccacgcgttgaatcagataagccatgctgataacggagatttacatcagggttatacttggtggcagcatcagtttctcagtgggatgaagactattgcagtgttacctcttcagttgcatggactggtgcaatttggttccacacggaaggttcccaggagctcagtttttttgaatcaggtcagagatatatttgatcggatgaagaatgcttcaagcgatggtccaatggagtatacccagaataactctcttgcatgcggtcagcaacctatccttacttcatcgagacctgtcaatgacatgctcgtacataacaaggtcaacccattgcaaactgagaaacttttggaggatatcgagagaacagaatctataaggagttcgatctgttctccaagcaattcacaaagatctttaaatgatctaacctcccatggtactggtaacagcagcatggatactaatatattagccatgcctgttaactccaagtctatatatgatctcaaacgatttgataacgtcacagagttgtttcatcgaagttctaatgacagaattggttttcaagtcagctctagtaaagagcctgattctaccattgctggtgtaatgtcagaatacaaaagtttgaacaatattcatatgacagaaaatgattcatgtggtcaaaacataggatataccccgtacctttacactaccaccaactcttcaaattctggccttgatgaactttcttattctggcgttgctttgtcgtcatcgtttacagcagtatcagggaaagttaaagattgcctgcaaactgagagtgacaagtttctatgtaaatctgtatcattcggcagcaacccttgtgcttctaaattccaagaaaatcgcctatcaccataccatgccctcatgcacgaacaatccctgatacctgaccctggagaatctgtgaggctcctctcacaagaagaatcctttattgttcaaggtgactcaagtcaattcaaggatactgccgactttacaggccagggtaacagtacatttcctgaattacctaacagatcacctgaagaagctactgctgaaactctagaaaacaacatgaaggactgtagtggaaacaacagtctgctggaaactatgatgcttgatcttagcaccaacagctttgtgcaagattggtgggacaacagtgttctactggcagaaaaccttccaaattcaagcgaaaaggacccagagcctgctatggaattggccaataggcattcattgccaactggggagagaggctcgcctttcatacctgtcatcgaacaattgctaggtgatgttgcacatccacctacacctaccggacatagttcacttgaggctgaagctactgctttagctggccgtgtttcagattatcagctgcctcagtttgctttccgagactgcctaacagtagacaacgcacaaatcccagcattggcctgcagtaattacacatgcagaactagaagtgcacaaaatggttcttcagaagtgccatcagcaaacgtatctgtggacgacacctgcagtttgaacacagcaaactccaatggcagtcagtcgagcaatcctgagggaacgaaggttgctaagagaagagctagagctggggagagtacccgacctagaccaaaagaccgacaactgatacaagatcgcgttaaagaattacgagagattgtccctaatggtgcaaagtgcagcattgatgctttgttggagcgaacaattaagcacatgctgtttctacaaagtgtaaacaaatatgcagagaaaattaagcaagctgatgaaccaaagataatcgacaaagggagcggtgttatcttgaaagacaacccagttgctggcacaaatggtggtgccacgtgggcctacgaggttgctggccaaactatggtttgcccaataatcattgaggatctttcaccacctggtcagatgcttgttgagatgctttgcgaggaacaagggctctttctggagatagctgacaacatacgtggaattggtctgacggtcttgaaaggacggatggagctctgtgatggcaagatatggtcgcggtttcttgtcgaggcaaacagagaggtcacaaggatggatatatttctgtcgcttgttcagttactggaacagaacagccttgttcgacctactgaccagatggccaaggtcatgaataatggggttccatcctttgcaaaccaccaacggtctccgctgctagttccagtgggcattcctgagagactacagtgacatgcagatgcttcaactagatagagttaggtaccacgactgttaacatatctggtagccagaactccatgcattagactgagcctagtgataacatctgaatgaagatagtctcactgctgctaaagatgactgtatcaagaacatgcatgactggtgcagacatgagcctctagcgcagaaattatgaactttccctgattattagtggtgtgatcagtgaaatggcattatctcctgcttagttggttgacaccttgctcctgagtaactgggtcttgatagtggtgtttcttatgcagcgatggcagtgtattagggtagtagtgctagcttgcagttcgttgcccctgagtcaaccttgggcagttcgtggtaggttcttcatgggcttgggcccaggaccgggccccatgcacgtgcaataagtgcgactgcacagggctcaaaattctgaggggccaatatgtatcaataagcagactaatattacaccatctaagttgaactcagttagcagctagactgttgctcttcaaacacatctattaatacatatgtttattta

SEQ ID NO: 238 - DNA, 1389 bp, Zea mays
gctgatgattagctagggagatgagcagacactggttgcctggcgggccactgtaagtacgtgacaataggagaatggatggaggtcttgccatgcaaatttctaagcaactgtatatacgctttctttgtagaaaggcgtatctatttgagtcgcttccgagcagacgtcctccttggataaggggataggcgcgaggaagagcggcctatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaacctccgggtgctcatgatcaagggggccgtgccagggaagcccgggaacctcctccgcataacgccggccaagatcgtcggcaagaacatccccaagaactagacttcttttttcaggggggtgaatgttgagtgtttgtgtttgttaccctgctacaaactggatgtaatcctttgccaatttccagtttttgaacacatgcaacttcagattagtaaaactataacctgtacaatttggatgcttgggtgagagagtaataggcaggtaatgcaagatgcacttctggttcctgaattccgctaaacaatagttgattaattctatggccatagatcatacaaatagttaaatacaaatggtcgcagatcatgcagatatgtactgatctgagtcaggaaacgcaaccaaa

SEQ ID NO: 239 - DNA, 2542 bp, Zea mays
ggtaacgtagcagtaaatcatccatgcaccattccaccacctgcggcagtgccggagtgcccacgagccatcctccgcaaagctgatttattttctctcgctctcgccttcgcggcgctgcctgcgcagtactacgagctagcaggctagcagcaccaggaccaggagcctcttcccacacttccgctctccctctctctctttcctctcgagaatggttgtgtaggcgggcgcaggagggaggagagagaggggagctagctagggttttgcgtcgccgccttctgttacccttaggctctgaacccctccggtccggtgcggcggcggattaggctccgatggggaagtctccggcgaagtggatcaagtccgtgctcttcgggaaaaagtcgtcgtcgaggtccggctccaccaaggccaaggatttatcgaagggtacgactaacaaagcggcggctgctgctgctgccgggaaggagcccgcgttctctgagagctctccggtcatctcggagcctgtgcttgttagcgcccacaacaatgagaccgcgcgggaggccgctaagggtgagaattccagcgtgcaagaagtgccagtgactgatgtcagtcaagacttggagaagcagggcactgttgggtctgatacgtctaatgatgctgagaggttgagggaagagcaagcggccgtgaaggcacaagctgccttccgtggttatctggcacgccgagcattccgtgccctgaaagggatcataagactacaggcactgattcggggacatcttgtaaggaggcaagctgtttcaactctccgtgcgacatggttgattgtgaagtttcaagccctggtccgtggaaggaacgttagactttctaaagtttccattcaagcaactatggaactttcccaacagaacttcgggggttctaaacctggttcctggaaggagaagttgtcttcaaatgcatttgctcggaagcttctctcttcaccaattgtggttgaggctcttcacgtccagtatgatgagatggaccctaattcggccttcaattggttagagaggtggacagtaagtcatgtctggaagcctatttcccaaccaaagagagttggcgctgatgctaagcctcatacaaggaaggccagttatgcaatggaaacagagtcagcgaaattaaagcgtaatgcacggaagagccctgcagtgccatttgagccttctcaaacaaacaccaccattgaaaatgagaagacaagacggaatccaaggaaattaagtagcactcctgctgagtcagttcccgatggccagttaacagaacttgagaaggttaaacgtagccttaggaaggttactagttccatggttgaaacctcaaaggtgcctagcccaacaactgagattcctgaccgtcaagaggtacaatgtgagagaccactaagaagtgcaaagcaagctccaattcatgttgagaatcaagaacctcagaatgttaatctatcggacaatgcaaagatggatattctggtaccagatatccagcctgacgtggaagttgcttcagatctagtcacaatcacaaatgaagaaaaagttgatgagacaccgtctgttgttgctccagcggctgaaattatgccactgcaagacatcaacagcgaagaaaatgctttggtgaatgatgtggaagagagatccaaagaagaacatccatctactgataacctgaaaggcagcaagaggaggtcttcattctcagctaagcctgaatatccagaaaatggctccaaaaattctccagccctgccaagctacatggctgctacacaatctgcaaaggcgaaactgcgggggaatagttcaccaagacttagctctgattcagcagagaaaaacgggttcactcgtcgtcactcccttccgtcccctaacaatggtaagataatttcacattctccacgtacgcaaaggccaacccatgctggtggcaaggacggagcaaaaggcgacaaggctatgctgtcatcaagagatgcgagcgagagaccactgaaagctgagtggagacgctgaggtggcgaatcaaaaccccaaaccctccatttggttagtgcaactatttgggtcggtggatggcgtctgcagtttgctcaattgttttgcttgtgatgtaaaaaagacgttatcatcatcatccgaggcgatgaacgggttcagctttgttgtgatgaatctgctgggagtcaacttatttacagggttttgggtcatgccttttgtgatgtatagctgaagtattttcccggtttgttttgtttcccagacccccagacttacccccccccccccccccccccccctccccctcctgcttgctgagagggctgctgatgttagagagaacgagaacctgtatggattgagttgaacagaacaatcttagtcccgtttggtcaaatctgggctgcgttttgactgatggttgtgtgtcatttatggttattgcccttgaggtcgtagtattcttttcc

SEQ ID NO: 240 - DNA, 925 bp, Zea mays
ggaagaagtcatttctacctataagctaggtgctgttgttgtttgaatagagaccatctctactcctttaatgcctaaacctacagctgtgtgacatgaagaacttgtgaaccaaaatcacggcacaactgaagacataactaactggaaaaatgacttttttattttcaagaactataacagaatccagtaacattgcagcaacccctgtttccccaacattgactctcgtctctgcatctgtttccgcaggggaatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatgcagtacttggagagaagagagtgtgagtacgaccagaagatatccattgatttctacaaggaaggagatcccttgaaaccagctgtgacaggcgtcttagtgttcgtttccactccagatccaattggcaacaagtactatcttggccctgctcctttgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccattatgttttttattatgatttggtatcttcttcgtgtctg

SEQ ID NO: 241 - DNA, 3934 bp, Zea mays
ccctatccgcgtaccgccccccgggcgatcgatcgaacgcggctagcctcgccgccgacccgtcgaggcagccatggcggagatcgccgaacgggccgtcgcgggcgaggtgccggaggagccgcggccgccgcacggggaggaggacgacgaaggggaggaggagggggacgtgtgccggatctgccgtaaccatggcgacgaggatcacccactgcggtacccgtgcgcctgcagcggcagcatcaagttcgtgcaccaggactgcctcctccagtggctcgaccatagcaactcgcgccagtgcgaggtctgtaaacatgcattctccttctcacccgtgtacgctgataatgctccgacaagacttcctttccaggaactgatggttggtgttggaatgaaagcatgccatgtgtttcagttcatccttcggcttgcctttgttctctcagtttggctcatgattatcccattcataacctattggatatggcggttaacatttgtgagaagtctcagtgaagctcaaaggctgttcctcagtcacatcagcgctcagttgatccttagtgattgccttcatgggttccttctctcagctatcattgtccttatatttcttggagccacctcattacgagactacataaggcatttgcgtgaacttggtggacacgatgctgagagggatgatggtgggcgtgaaaggcatggtgctcgggctgttaggaggctagctggtcctaataatagggttcctgcagatggaaatgttgatgaattagcagaagcccaaggaatcggtgctggtgaacttctgaggagaaatgctgaaaatgttgctgctcgattagaacgacttgaggctcaggttgagcagatgcttgatggtctagatgatgcagatggtgcagaggacgttccttttgatgaacttgttggtatgcaaggccctgtcttccacttggttgagaacgcaataacagttttggccagcaatgctatattcctcattgttgtgatctttgttccattctcattgggaaggattatcctgtactatctatcctggtttttctcttcggcttctactcctatgctggcaaaagtgatgcccttcacagaaacagctatttctatagctaatgatacattaaagagcgcacttaatgttgtgaagaatttttcttctgacagtaataatgaaggtgttatcgggcatgtgattgaggttgttactcaatccttgaagataaatgccactggacttagtgtaattcaaggcactgggaagaacagtctgatgaaaggaacaacaattgcctcatcttatctttcagatctgacaactcttgctgttggatacatgttcatcttctgtcttgtgtttttgtatattggatcactggctttacttcgatatgccaggggagaacgttttaccattggaagactctacggtatagctactatattagaggccatcccttctctatgcagacagttctttgctggaatgaagcaccttatgactatggtcaaagttgcattccttctggtcattgagcttggtgtatttcctcttatgtgtggttggtggcttgatgtttgcactctaaagatgctgggcacaacaattgcgcagagagttgaattctttacaatgtcacccttggcgagctcatctatccattggctagttggtattgtgtatatgcttcaaataagcatatttgtgagccttcttcgaggggtgctgcgcaatggagttctttattttctgcgggaccctgctgatccaaattacaatccatttagggatttgattgatgaccctgtgcataaacatgcccgacgagttcttttgtcagttgcagtgtatggaagtttgattgtgatgttagtcttcttacctgtaaaagtggccatgagagtagctccttcaatgtttcctctggacataaccatatttgacccattcactgagattccagttgatgttcttctgttccaaatatgcatcccattcgctattgaacatttcaagcctcgtgcaaccattaaagctcttttacatcattggttttctgtggttggttggggccttggcttaaccgatttcttactgccaaaatctgaagaaaacggtgggcaggaaaatttgaatgcaagggcagaaagaagagacagaggacatggtgggagggaaatggtcgccccacaggttgaacaactcatgatacaacatgttgccgcagaagataatggcaggggggattcaaatgaagccaatgatgtaactgaggactctgatgtagatgaccagggagactctgagtatggctttgtgcttcggatcgtgctcttgcttgtactggcatggatgacattactaatattcaatgctggaatgatagtttttcctatctcacttggccgtctggtttttgaggctgttccccgcctgccaatcacacatggcatcaagtgcaatgatctgttctcctttagcattgggtgctatattctctggagtgtggcagctgggaccagatatgcgattgattacatcacatcacgacagctggggtttttggtacaacagatctgcaagtggtgctcaattgttttgaagagctctgttctcttgtcgatatggatctttgttattcctgtgctgattggactcctttttgagctgctggtcatcgtacccatgagggtgcctattgatgagagccctgtcttcctattgtatcaggattgggctctggggttaatattcttgaaaatatggactagactggttatgttggatcagatggcacctttggttgatgaaagctggaggtcaaagtttgagagagttagagacgatggcttctcccgtttaaagggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgcactcttcttttggggcaagagatttcatgtctggttcaccaacctccacaactccatcagggatgaccgctatctgattgggcggaggctgcacaactttggcgaggactcacactcacctgagcggagtgaatctggagcaactatagggtcagatgatcaggacagagatattgtactaagagatcaggaagaggaagtggggttgaggatgaggcgcaataatatgcatgcaaaccaacaacctaggcttgctttataagtaggaagtagttttggacaaagagctcataaccctctataagcttcggtctgcaggttctgcttgtgctttgtaatgggcattgtagagtgagtttatgtgttagtgataggaaatagtctaaggactgttctacgataaagcctggagaaagctgaagtggctggtgattataaaactggtggcaactcccattcctgtggtagtcctggctgactgtaaatatcgtttgacagagcattaccatgccaactcaatctgttgtgatcctcttgtaatgactagtgagttaaggtgaactgttgggtagatacgagatactagattattatcgcgttcactcttttttttttgggtcccatctttgtttttttagaaactgcaattgcattctgtttatatcatggagcatctagcggcttgaaatgaacaagaacaagatgcatgggcagtgggcagtattggttgtgggtaactgaaagcagggaaaagttcctgatgaataagggctattttggaaacttaatttttctaagggttttctattttatcaagagaaattagtttattttttcttgggaaaataaaaatcccttcaaaaaa

SEQ ID NO: 242 - DNA, 655 bp, Zea mays
atgaccgaggagaagccgtacaaccggaggcacaaggtgtgcgaggcgcactccaaggcccccgtcgtgctcgtcgccggcctccgccagcgcttctgccagcaatgcagccggttccacgagctgtcggagttcgacgacgtcaagcgcagctgccgcctgcgtctggccggccacaacgagcggcgccggaagagctcggccgacgcgcacgccggcggcggcaataatggattccgccaacacgccgaccagaacggccgcggcgacccggccgggaaccacttccagatcagataaagcatgctctctctcttctgtcatgcagcaggatatgctagcatcatcactaccgatagatatttatgcgtctatcgtctacccgccccgaaaaccctagttatatatatatatatatatatatatatatatatatatatatatatatagacatatgctgattgtaacctaattagcctgcagccagttaagcagggactgcctactctgctaggaggacgtgtgtaatcatgtggcctgcgcaaacagtaatttgtgctggctgctgtgtattcatgctgctctgataatcgtgtcgtggtaataatatatcctatttattctactactagtaatatataccgattctctattg

SEQ ID NO: 243 - DNA, 738 bp, Zea mays
aaatcgcccatcccgtcctctccagtctctagttctttctctacactcttgcagtgcagctagcagcgcacggagagccaaaaccaaagccatggcagcacatctcgccagcgccttcttcttcgctgccgagcccgtcggcgagcccggcgtgcacgcgctctgcgccaagccgctggcgcgcgacagcgacatcttcatgtacagaggggacacgcccttctgcagcgaggagtgccgctacgagcagatgcagctcgacgccatccgcgccaggcagccgtacgcgtcagggacggaggcgcggagggggcaccgggaggccagcaaggtgtccgcggtggcgacctgatgaacgcccgccggagggtggcccggagctgcgcctgcacagattgagagactcaagccaacggtttggttggtcgtttgcctcgtgaaggttgggattcggagaaacgtactcttagatcagatcgagcggccctgagccgagcttcgcggtgaatgatgcccgcggatgccggaagtcggagaagacgatctccatcggagttgctctggttgcacgaggcttggcctgcgtgccacagtcagtgccttagtcctagtgtaacatgatttttgtaaattcgatgcatttggaaagcttttgcctccaaattcagagccaatttttggaacaccgtgtgcgcttcaactgttcatgaattggttcgagtaaactgtacttgctta

SEQ ID NO: 244 - DNA, 917 bp, Zea mays
agaaaatgttcactccccttcctcggcattggcgtcacattcgcagccgtctcactcctctcgcacagcatccgcttctcctgccaaaccctagcacctccgtcctccgaccccctcagctccggcgatggcctccaccccgcaccctccgccgctcatcggcaagtcgggaaacctcacggtgttcttcacgccatcggcggagcacgagagcccggggtccgagttctctacgcccccgacgagccctcgcgccgaggactcccctgaatcaccaccggcgcagacagcccctccgcccgcgcctgtttactcagtatccacgccgcagcttgtcaagatggtctccccgccgcttcccgccgagaagctctcccgaccctcgctggtccaggtgccgccattgcagttcgggaaggcttcggcaggatcagatggatcgctgcttgcgttcttctgggacgcggttgcacgcatgcaagaagcacacgcgagcttggacgagcacatctcgagatggttcgggctggaccagtccaagtaccagtgggcgctcaacgactattatgagaggaccgggcaggtaaaacattcaattcctgcaaggttggcacgtcatagctatatttattaaggagatagatttgagcaacgttggcactcgttagcagcacagttgtaaaaattcagaaagcttgaaaaagtggattatttctagtttttatgtgtgtaactaagctggtgccgtgtcaagctgcatatagaatccttttggttgcgtgaagactgagttctctttttctgcacccggaagctcttggttgtaacaaatccatatttagcacctttattgtagcttcgttgtggataaagaaaaaccttgctgaccttttttttattgtaccttcattttcatt

SEQ ID NO: 245 - DNA, 1546 bp, Zea mays
aacattaacatttgttatgtgaccaggggccatttcgacttgttgctgaggaggggaaatccaaatgttcctgggttagtcttgatgacatcactaattgcttgataagaggagattctgaaaaatcgcatcatcaccaacgtgtcgctgagttgcaacgacttcggtccatatttgcaacaagtgaaagacaatggattgaagcgcaggttgagaatgctaaacagcaggctatactctctatattgaaagcacaagtgtcatccgacgaggctcatatacatagggatatccattctcttaggagaaaaggttctgagcttgctggagagctctcgacactttctcaaaaggtgcaagctttggtatctgagacaataccatgcctgtgttcagaacttgctcaacttcaaggcacatatatcttgcaaggggattatgatttaaaggtcatgcgccaggagtactacattaacaggcaaaaaacgttcatcaatcacttggttaatcagcttgccagacaccagtttctgaagattgcttgccaacttgaaaggaagaatatagctagtgcgtactcattgcttagagtaatagaatctgagttacaaagctacctctcagcagtcaatacccgcttgggtcattataattcattgattcaagctgcatctgaagtacgagaacaaggagctattgatgatcgtgacactttcctccatgcagtgcgagatctcctatgtattcactcaaatgtccaagcaacagtgccaacatacatgtcagcacatgcattggttcagcagatatcagcacttcaatctgacttgctttctcttcagtctgagctggagaacacccttccagctgaccggaaaagatgtatcaatgaattatgtactctgattcaaacagtggaacagcttctatttgcgtcgtcaactactgcagaaccaatattgacgccttggccattgatgcgggcacttgatgatatggaaaatgccaacgctcaagtcgaagtttctgtggaagaagtaaccaaggctcgcacccagaagataaagatctttgaaaatcgtgcccatgaggtggggagggagaggcaaatattcgttgatttcttctgcaaccctgaacgcctcaagaatcaagtcagagagctgacctcccgtgtgaaagctctccaggactaacctgtttctgtaggctggtctcacaggtcgtgatgctttttttttctatgtaaagtttgacttcactccagcgtcaggttggggctgctgtgcagggacggtatggaacaatatacccatcatgtagctcgggggggttcaggctgtaggtccttgtgccacccggaataggatggcattgttgtgatattatttgtagcgatatgtatgttgtaaagtatctcagaaatcacgagccctttctttcgtgtatggttttgcttttgagtaggttgtggtggtacagttgttagcgtccaaaggcacaatcggtactgtagtttggataaatgggatcgatttcctcttca

SEQ ID NO: 246 - DNA, 747 bp, Zea mays
acactgcagtcactcagtcagtaccctttattaacaggatctccatctccatccgctagctaggcaagacagtcgagagtcgacaccatggccatggcgacgcaggggcaggccgaccaccagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgccgccgccgccgccgccgcgccggctctggtggtggccagggcaacggcagcggcgtgctgccgtcggacgagccggctgagaagccctccgtggaggtggagctgcaggcgccggcgcgccgccgcccgccctgctggtgtactccgccgccgggacgaagctggcgggcgccgcggcggagtgcgccatctgcctcgccgagttcgcggacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctgcacgcaagtgaattactctaaataaataattgccgttttagtgttgctatttaccattgcttgtactgcctctgtaaatcaagaagaagaaataaaattataactctta

SEQ ID NO: 247 - DNA, 2919 bp, Zea mays
atgatggacatgaggcgccactctgtgtctgtggatgccccactgtcaagaaccttggtgcagctcaagcgagtgaggtcgctgcgggatccagcgacaaactcgatgagcaagtacgcgtctccttccgatcacatgatctgggagactgcttctagcaatggggtgactccggagcttggcaggagcaagtcttctgctgcaatgagccgtgttgggagcccctgcatgtcagccagtgaggcacgctcagttgggtcaagaagaagcactttggggcatggaaccgaggatacacgactgaggtcaaatgatgtcgtgggatccaatttcagtggctgtggtataagctactgctggtcaggagcgtcaaagtaccgggagctttattctgacagcgatggtccagaccaacctctcttatccacagatgggattgaggcagcattccaaggcaatgtaccatacactgagacactgaggtgtctaagccagaagttccgccctcgttccttcagtgaactgattggcctaaatgtcgttgcccagtccctcctatattccacttgcaaaggaaaagttgctccaatgtacttgttccatggcccccggggtacaggcaagacatccacggcaaggatttttgccgcggcactgaactgtgtatctcttgaggagcaaaggccgtgtgggttctgtaaagagtgtgtcattcttttctctgggaagagcagagatgtgaaagagcttgacgctgcgaaaatggatcgtctaggccgagtgaaggcacttctcaagagcgcatcgctcgtgccatactcctcgcgcttcaaggtcttcatagtagatgagtgccacctcttgcgagaagatgcatggtcagcaatactgaagagccttgacgagccataccggcacacggtgtacattatgatcacttctgacatagaaagcctgcctcgcgcttccatcacacattgtcagaagttccattttccaaagataaaggtggcggatattgtctacaggttggagaggatctgtatagaagaaggattggaatttgaccatgatgggttgtacttcattgctgcaaagtctaatggttctcttagagattcagaaataatgcttgatcaactcagtttgcttgggaagaaggtcacaatttctcttgtgcatgaacttgtaggatctgtgtctgatgatgagttgattgaattgcttgatctagcgttgtcatccgacacaaccaataccgtaagacgagctcgagaacttatggggtcagcaatcgatcctctgcagctggtgtctcagttggccaaccttattatggacattctctcagggagatgtcaatctgcagtcacggaagtcagcaaaagtttcttgggtagatatgcattatcagaggttggaataaagaaactaagacatgcactgaagatactatcagaaactgaaaaacaattgagaacatcaaggaatcaggctacttgggttacagttgcgcttttgcagtttagcaccaatgaacctaaccctgttgctgaaacaaatgatatgcatgcacattcagtaactggatatacagatgactgggtttccaaggtgcactcaagtgccaatttttgccaggcatgtaacagcagcaagtccaactgttctgagagacactgtaggcggcttaagctcgagaacatatggaggagagccattggaaagtgtcgatctaggtcagctaaaagtttcctcaggaaagaaggcttcttatcgtcggttcacgtcaccgaagagctggccatagcagaagttggttttgaacacccagatcacctgtcaagagcggagaaaatgcaaagcctaatagaatcctctttgcaacacgttcttgggtgcaatgtggagatcagattcaaactcgtgccatgcccagtgagcaaagatgctaggttgaagagacagccgttcagctttctcaactgctctggccggaagcaagagctgtcagattcagtcgtgactgatgaagacgaagctgcgagggggcctggagcaagagagacaccgcttaaaggctacacctctagccagcaggaatcaccatacaccatgcgacgtgtcgattcgaaaccaacaacggtccacggttgcgaggatgacgcccggagtaccttgacgtcaagcagatccacggcagatgacctgacaaggacgtgcaggtcggagactggctacccaaagggtgtgcgtgagcagggccgctctgatggcacgcagcaggagcctgacctacagccgaactgcttctcgcgaacgctcaagcttcagaagaagctgctgtcttctggcgcagcgcacaccatctgtctgagggtccagccacataacaagatggatttcctgcctaagaaagagttcgatacgtacttctgcgcgtatgagccctacgagcagtgtccaagatcagattcaagagctacttacagttcaagagacgatgacttgtggagcaagaattcacgctttggctcgaatctactctgctggagagccccaaaacagtccatgtaatggaggaaagaacgagtgaactgggtggaacaaatcgattctgctacgagattttaccaattttgcccgaagctggagacatggacaccacccgcagctgcggggacaaattttgaagggaagtctaggaggggtctgtgctattcttgatcttggtaggcagctgaggattgaggaactatttagtgatgttttcttggaaatgcagatcctttataatgctagtgggcagttgtacagcgcgccagcgacgaaaccctgtgaattgttctgttattctgaattttgtaggacgatttgatgctctctctctgaatttacatgatctttttattagctgaa

SEQ ID NO: 248 - DNA, 649 bp, Zea mays
atgccactaaacaatagcttgatcagttttactgaattaatctcggtaacatttgttaacaaggatggctcagaaaagacaatacgtgttccagttggaatgtccatgttagaagctgctcatgaaaatgacatagagcttgaaggagcatgtgagggttcacttgcgtgttctacttgtcatgtaatagtaatggatgtaaactactataacaaattagaagatccagcagatgaagaaaatgatatgcttgaccttgcatttgggctcacagagacatctcgcctcggctgccaagtgatcgcgaagcctgaactcgatggtattcggctggcattacctgtagccacaagaaacttcgcggtagatggctatgtaccgaaaccacactgaagacagttatgtacaccacactgaagacagttatgtacaccacactgaggcagtcatcttggggggcacggattcgtacaagtcaattttgtagtttataacctgtataacctaactacacctttgctacttgtagtcggggtagcttaggactaccttgttgagggagggttcgttcattgatgaacccctccattactcccagataacagtgcttccttcatctgggcgaataaacatctttcgttttgtgcga

SEQ ID NO: 249 - DNA, 665 bp, Zea mays
tttttttctaggactgttttatcaattcatttttattccatttcaacccctgctaaattcgaactttcgtcgaaatcgtctctattcatatgtatgaaatacatatatgaaatacgtatgtggagttccctagaatttcatgtgattcagtaaacagaatatggattccatgattgctagattgatccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggcttggcggacgaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagaggaaaagcccaaagccaatcccagggaacagtaaagcttcatagggtctttctgtccaggtgcaggtagtccgcatcttcacagacatgtctatttcaccgagcctctctccgagacagtgcccagatcgttacgcctttcgtgcgggtcggaa

SEQ ID NO: 250 - DNA, 3395 bp, Zea mays
ttcaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcctccggaatggaaatgagggaatgtccacaatacccggatttagtcagatccaattcgagggattttgtagattcattaatcaaggcttggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaaggaaaccatttctattggaaacattcctataatgaattccttaggaacctttataataaatggaatataccgaattgtgatcaatcaaatattgctaagtcctggtatttactaccgctcggaattagaccataagggaatttctatatataccgggactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaataactacttatgagaccttttttggcacataccccttagctcaagtttttgatcaaaccaatccattgacacaaacggttcatgggcgaaaagtgagttgtttgggtccaggaggattgacggggagaactgcaagttttcggagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgccaaacagctctagattcgagggtttccgttatagcccaacgcgagggaaagatcatttctagtgatagtcacaagatccttttatcaagtagtgggaagaccataagtattcctttagttgcccatcggcgctctaacaaaaatacttgtatgcaccaaaaacctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacgtttggtatatgaggatatttatacttcttttcacatccgaaaatatgaaattcagacggatacgacaagccaaggctccgctgaaaaaatcactaaacaaataccacatctagaagaacatttacttcgcaatttggacagaaatggagttgtaaggttgggatcctgggtagaaactggcgatattttagtaggtaaattaacgcctcagatagcgagcgaatcgtcctatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagctggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaatgctacgatctggggaaaaagagtgcctaatcacgaggatccgccagaatcttttcgagtgctcgttcgagaactacgatctttggctctagaactgaaccatttccttgtatctgagaagaacttccaggttaatagggaggatgtttga

SEQ ID NO: 251 - DNA, 1642 bp, Zea mays
gcctgtatctgtcactggatgcctgacacaggaggtcaccgacgagcggttcgtcgacatacccgaggaggtcatcgacgtgtacaagctctggcgcccgacgcccctgatcaggtaccctacgacctctttcgtgctggtcaatagctgctgctgctgctgctagcaacgctcgggcagagtatggtgtgagtgaacacaaccaatgctgccaacgttcagggccaggaggctggagaagctgctcggcacgccggcgaagatctactacaagtacgaggggaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggcctcaactgcgaggtgagcgagcgcgcatttgtttcgcgccgcgagaccgcgatgccacccctctgtccgtggtccactgactgattgcgcgagcaagaaatgcaggtatggcaggtgcgcgcgtcgttcgaccagaagccgtaccggaggctgatgatggagacgtggggcgccaaggtgcacccgtcgccgtcgacggcgacggaggccggcaagaggatccttgaggcggacccgtccagcccgggcagcctcgggattgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaagatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggttttcatttcttcacgcgctctcttgttgcctcctcgattactctgctgtttgttcttctcctcctcctcctcctcgctgatcgaggcacttcgattcgcaggtgggcttcggtaccatggaatggcacctctgatctcgcacgtgtacgagctgggcttcatggatgccgttgctatacagcagactgaatgcttccaaggtatctgtggagcagctgccttgcaattcgccaggacggagggcatcatcccggcgccggagccgacgcacgcaatcgccgcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggacaagctggaggcctccctcgctgccgtgcccaaagtctgacggcgttggagccaacagcacatgcgactggaatgggacgaataatccattgatatcggcttcttgaatcttgtggtcatccatcgcccatcggcagtgggata

SEQ ID NO: 252 - DNA, 1881 bp, Zea mays
aaactaagcaaagaaatagcgccaacaagttaaataatgccccctttgcacgtccccggtagtagtactcctcgcaagttctatcacctggtgctgttccatgtgcacccgttctggatccaagtcctgtacttccttttgatctccgttttgggtttcttgatgctgagagtcctgcccatgaagtccagctccgtgcctaggccctcggctctggacctactcttcacgtcggtgtcggcgacgacagtctccagcatgatcgccgtcgagatggaatccttctctaacgcgcagctcctcctcatgaccctccttatgctcctcgggggcgaggtgttcacaagcatgcttggtctccacttcacctgcaccaagctcagaaacaagagagaaacacctcataataatctccatggtaatagcttagagcagagtcgtcgtcgtcaccgtcccatggagatggaagcccaggccgccgccgtccaaatggagcttgcagggttcaacaaggacggccatggcgatttcgcatccatggctagcgtggtcggcagcgcgagagcagtgcttgttaggaagaggatcagcctgagcaccttctccgtcttcacggtcgtctcgtcgttcgcaaactgtggcttcgtgccaaccaacgaggggatggtgtccttcaagtccttcccgggcatgctcctcctggtcatgccacacatcctgctcgggaacacgctcttccccatcttcctcaggctctccattacggcgctcgagagggtcacaaggtggcgagacctctgcgagctgctgagagacagaggacccggcggcgggccagctgcggctgccgccgccgccgctataggctacgaccacctgctcccgggaccgcgcacatggttccttgctctcaccgtggcggtgttcctggcggtgcagctggtgctctactgcgccatggagtggggctccggtggccttggagggctcaacgcgttccagaagctcgttgcagcggtcttcatgtccgtcaactccaggcactccggcgagatggtcgtcgacctcgccaccgtctcctccgccgtcgtcgtgctgtatgtgctcatgatgtatctaccgccttacactacatttttaccggtagcagtggaagacgaccagcagcagcaaaatgaggcacaaccccacgacaatagcacgagcaagagcagcacaagtattagcatctggcacaatctgctcatgtcgccgctctcgtgcctaaccatcttcatcgtcgtcatctgcatcaccgagaggcggcagattgctcgtgacccaatcaacttcagcgtcctcaacatcgtcgtcgaggtcatcagtgcgtatggcaacgtgggattcagcaccgggtacagctgcagcaggcaggtgacgcccggcggcggctgctgcaaggacgcgtgggttagcttgtccggcaagtggagtgtggaagggaagctcacgctcatggccatcatgttctatggcaggctcaagaagttcagcatgcttgggggtcaggcatggaggctgaactgaaccgaagtactatttcgaaactcgctcgatcaacctgatctccaggactccaagactagtacttgaattctcagtctattcagacggaaccggatcatatgacaaatccatctgcgaggagtttggctgcattctgtaaagtcggtaggggcaaggggttgttcatatcctttttatttaaaaataaaaaatagttttatatctcgacttttgaaaattatattttgaggtgtctgtcacccaggggacggcagggagttaaatgtaatttttaataaataggttctcgtcgctcactcactcattacgggctta

SEQ ID NO: 253 - DNA, 1041 bp, Zea mays
aagcaaagccctcctctcccctctccctcgcggcctcgccttatcccctccgtcactcacctcgaccaccgccatggccatggccatggccttggcctccgcgaccgccgccgcactcttccgctccgccctgtccgcgccacacggcgccggcgcgcgcgtccggccgcagcgccggcagccgttcttggctccgctccacgcggcgaagggccccggctcggcgccggtggtgctggagggcaaggccaagggaaagaagaagaaggggcccagctccgggaaccttcccgcagccctcgacgtcgagatcagggaggcgcaggagtacctcgacagcgaccagcaggaacctgttccagacaacttcccatttgaattaatcgacgaagagggcatgagcgtggttattttgagaagggactacaaggacgagaaggtcgaggttactgtcagcatgcctaatttagaaggaggccccgagtttggtgatgaggatggcgagggcgatggtgagagcgctgtcaaggacgacggagaagcagaagaagatgacgagagtgccggggatagcagcatctctcttaaggtggtagtttccaaagactctggcccaaagctcgagttcacatgcacagccttccgcgaggagatcaccatcgatgatatgctgatagtggagaaaacagacgacgacgacggagaagagaagttcccctacgagggccccgagttcaccgagctccctgtgaatgttcagaaaggcctgttcaagtacctggagcaaagaggggtaacgctgtcggctaccaactatatgcacgattacatggtgactaagcaggctcaggagtacatccggtggatgactaagctgaaggatttcgtggcgcagtgaggaacagcgtcgtgattcggcagcattgtttggttagcctagccttagcatgtgttacagccttacaggaacactacgactacaccgaattggccacactccccaaaaaacaaaaaagggggagcattgtatctgcttcaatg

SEQ ID NO: 254 - DNA, 3040 bp, Oryza sativa
tgattgtactaggaaaattgatctgtcatcccgggaaggggattctcaaccgcagcataaggctggtccattttcacgcagagtatcaaaaaccaagaggaaacatcctcccacgcatctgaataaacatgtgaaacggcttcacagcaactgcaaagttctcaatgttgacaatgaacggtcagatgatgagggcatttatgttggagaatcaaattcctctgatagaaaaaagcaagaagataatatgaccactttggatagaacaaaatgccaacagcaagggagtcgattgcttgtccgcaaactgccaaaatatgtgtctctgaattgcattgtaaatgaaactaacagtgaagatgcctgtagtgggagtgccagtattgattctagtttgattgctacaggaataactaatgataatcggaaatctcccaaaattgttccactcaatctgattcttaaaaaggctaagagatgtcatgctatcaaacccctcagtaagacagaaaatatccatttttctgaggaaaagagttcagatggttctgcagataaatcttcctctggtgacagaagtttcagtccacaagatgaactgtggtctcccaaaaagaataggtattcatctaatgtctcgaggccacacgtcaagactgactgccaaagtccctgctgtgtacttgaagaagatgagcctcttagccttgcagatatggggacaagtcagctgtcagcatcaagaagtagaggaagtaagaatcaaagagcatgcatatctcttaataggatggagaggtgtgaagaatttacaaatgaatcagcatgcagtccttgtggcgataaacacgctgcggttcaagcctgtgtaacaaaatttgaaagatatatacaaaggcctagtttagatgcttcatgttgtgtttgtggtatctcaaacctggagccttccaatcagttgatagagtgcagcaagtgctttatcaaggtgcaccaagcttgctatggtgttctaaaagttccaagaggacaatggttctgtaagccctgcaagatcaatacccaggacacagtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgaatgctcaatgtgtaacagaactgggggctcatttatggggtgtcgtgatgttaattgctcagttctctttcatccttggtgtgctcatcagaggggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacagaaggaatatgtccactacaagcagttaaagggatggaagcatttggtagtgtacaaatctagcattcatgggcttggtctctacacatcggagtttattccacgtggctctatggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaaccaaactgtgtcgcaaaaataatctcagtaaggaacgagaagaaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactc

SEQ ID NO: 255 - DNA, 3740 bp, Oryza sativa
ctctcttcccgcgttcccctctccctccccctcccccctctccggcgatgagctcaggcggacgcggcggcaagcggcgaggggcgccgcccccggggccatccggggcggcggcgaagcgggcccaccccggtggcaccccgcagccgcctccgcccgccgcgacggcggcggcgcccgtggcggaggaggaggacatgatggacgaggacgtcttcctcgacgagaccatcctggcggaggacgaggaggcgttgctgctgctcgaccgggacgaggccctcgcctcacgcctctcccgctggaggcgccccgcgctccccgccgacctagcgtccggctgctcgcgcaatgttgcttttcagcagctggagatagattatgttattggtgagagccacaaagtactgctccccaactcatctggtcctgcagctatactcaggatatttggcgtaactagagaaggtcacagtgtatgctgccaagtgcatggatttgagccatatttctacatcagttgtccaatggggatgggccctgatgatatttcacgcttccaccaaacactagaggggaggatgaaggattcaaataggaacagcaacgtgccaaggtttgtgaagagaatcgaacttgtgcagaagcagacaatcatgcattaccaaccacagcaatctcagcctttcctcaagatagtggttgctttgccaacaatggttgctagttgtcgcggcatcctggaaaggggcataacaattgaaggccttggttcgaagagttttctgacatatgaaagcaacattctttttgcacttcgcttcatgattgactgcaatattgttggtggtaattggattgaagttcctgccggaaagtatatgaaggcagctcgtatcatgtcctattgtcagctagagttggattgcctatattcggatttggtaagccatgctgctgaaggagaacattctaagatggctccatttcgcatattaagttttgatattgaatgtgccggtcgcaaaggtcacttcccagaaccaactcatgatcccgttattcagatagctaacttggtcacccttcaaggagaaggacaaccttttgtacgcaatgttatgacgcttaaatcatgttctcccattgttggagttgatgttatgtcatttgacacagagagggatgttctacttgcttggagggatttcatacgtgaagtggaccctgatattattattggatacaatatctgcaaatttgacttaccctatcttattgagagagctgaagttcttaagatagtagagtttccaatacttggacgaatcagaaatagtcgtgttcgtgtccgtgacacaactttctcttcaaggcaatatggtatgcgtgaaagtaaagatgtagcagtggaaggaagagtacaatttgatcttctgcaggctatgcaacgggattacaagcttagttcttattcattaaactctgtatctgcacatttcctcggggagcaaaaagaggatgttcatcactcaattatatctgatcttcaaaatgggaattcagagacacgaagacggcttgcggtttattgtttgaaggatgcctatcttccacaacgactgctagataagttgatgtatatctacaactatgtggaaatggcaagagtcactggagttcccatttcatttcttctttcaaggggacagagcattaaggtcctctcacagctactcaggaaagcaaaacagaaaaaccttgttataccaaatataaagggtcaagcgtctggacaggatacctttgaaggtgcaactgttttggaggcaagggctggattttatgagaaacccattgcgactttggactttgcttcgttgtatccatccatcatgatggcatataacctatgctactgtactttggtcccccctgaggatgcccgcaaactcaacctgcctccagaaagtgtcaacaaaaccccatctggtgaaacatttgtgaaaccagatgtgcaaaagggtatacttcctgaaatccttgaagaattgttggctgctcggaaaagggcgaaagcagatttgaaggaagcaaaggatccatttgaaagggccgttcttgatggtcgtcagcttgccctaaaaataagcgcaaactctgtctatggttttactggagcgactgttggtcaattaccttgtttagaaatttcttcaagtgtgaccagctatggtcgacagatgattgaacatacaaaaaagcttgttgaagataaattcacgacacttggaggctatgagcacaatgcagaggtcatctatggagatactgattctgtaatggtacagttcggtgtttctactgttgaggacgcaatgaagctaggaagagaagctgcagactacattagtggaacatttattaagcccatcaagcttgagtttgagaagatctatttcccttatctactgattagcaagaagagatatgctggtttgtactggacaaatcctgagaaatttgacaaaatggacacgaaaggtattgaaacagtgagaagggacaactgtttattagtaaagaacctggttactgagtgccttcataaaatactagtggacagagatgttcctggtgcagttcaatatgtcaagaacaccatttctgatctactaatgaaccgtgtagacttatctcttctagttataacaaagggtttgactaaaacaggagaggattatgctgtcaaagctgcccatgtggagcttgctgagagaatgcgaaagagggacgctgctactgctcctactgttggtgaccgggttccttatgttataatcaaagcagcaaaaggggcaaaggcatatgagaggtcagaagatcctatttatgttttggataataacataccaatagatccccaatactaccttgagaaccaaatcagcaaaccacttttgaggatctttgagccgattctgaagaatgccagtagagagctgcttcatggaagtcacaccagggctgtttcaatctcaactccttcaaatagtggaataatgaaatttgcaaagaaacaattgacatgcctcggatgcaaagcagttataagtggttccaatcaaacgctttgctttcattgcaagggaagagaagcagagttatactgcaaaactgtaggaaacgtttctgagctggagatgctctttgggaggctctggacgcagtgccaggagtgccaaggctcccttcatcaggacgttctctgcacaagccgggattgtcctattttctaccgccgaagaaaggcgcagaaggatatggctgaagctagagtacagcttcaacgttgggacttctgagtcctctcatactgacggagtactactttccccaaatattgcgaaaccattactgtgaggcacgccattgcgggatcatgtgattgcatcttcatgcatgatggctctggcttgtttagttggatcggctgaaatagctttgttctacggtcagtttgttgtatttttaggtggtaggttatctgtacctctagccgctaacagggtaatctagttgcttcccttggtgcattgatgcagccatgtgtaaggtagataaacaattttttttcatcatcttttaacttcatgaggtgattgaggctgagaagcacccattcaagaaatcccaccatgtgaatctttttaacttctaggctattttcacataatgta

SEQ ID NO: 256 - DNA, 1423 bp, Sorghum bicolor
tcgatggagaaatggacgacgagttcgagatgggggccgggcctcggagattcacctacaaccagctgtcacaggcgacgcgaggtttctccgacgaggagaagctcggcgagggtggcttcggatcagtctaccgtgggtacctgcaggatcaaggtctccatgtggccatcaagaaggtctccaagacgtcgaagcaggggaggcgagagtacgtctccgaggtcaccatcataagccgcctcaggcaccgtaacctcgtgcagctcgtcgggtggtgccatgacgccgacgagctcctgctcgtctacgagctcatgagcaatggcagccttgacaagcatctctatagcacagacaacattcttacatggcaagtcagttttcatttttgggcgtggatgatcggatcgatcgggtacgacattatccttggcatggggtctgcgctcctgtaccttcaccaggaatgggagcagtgcgtggtgcacagggacatgaagccgagcaacgtgatgctggactcgtcgttcaacgccaagctaggggacttcggcctggcgcgcctcgtcaaccacagccgcgccgcgcacaccacctggctcgccggcaccatgggctacatggacccagagtgcgtggtcaccagccgcgccagcgtccagtccgacgtctacagcttcggcgtcgtcctcctcgaggtcgcctgcggcaggaagcccgtcgtactggaggaggaagacgagagcagagtgctgctcgtgcagtgggtctgggatctgtacgggaggggcgagctcctcgacgcggcggacccccggctgaacgacggcggcggcggcggtgggttccagccgctggagatggagcgggtgctatgcgtggggctgtggtgcgtgcatccggactacgcgtcccgggcatcgatccggcaggccatgagcgtgctccagttcgaggcgccattgccggagctcccgctggagatgccggtggcgacgtatgggccgcctgttgccaggggtcacaattggtcaagcaccacgtcgtcgtccgcaagtgccaacaccggaggccactcgtcgactagtgaccggacggcggaacactcgttaggctcgtcggacaagagcagcacccatggccttttgtcacttccaagttccaacacgaggagtgcgacgaaataaggagtttttcggtgtatgatactgtgagaagagaaatatgtaaattgcgtatggaacagggttgatcctggacactgaatgcctgacctgtaaagttctaggatgttgcctatagcaagttcgcctaatttagtgactgaaactggtatggccaattggaggatactatttcatcgatggcctttagagtttacaccgagacttgtcctaaattaaccctatcggtttccttg

SEQ ID NO: 257 - DNA, 1704 bp, Sorghum bicolor
tggggccgtcgtccattcaggagatggaggaggcccgaaggaccgcagtgcagagctgccaccgggtgctggcgctcctctccaacccgcacggccagctcgtccccagcaaggacctcatggctgccaccggggaggccgtcgccaagttcggctccctgacggccaagctcaccaactccaactccaactccaacggcaatggcctgcagctgcagggccacgctagggtcaggaagatcaagaagcccctgcccatcttcgacagcaacctcttcctcgagagctctgcggtggccgccgccgccgccgccactgtggccaagacgcccagcccgagcccgatcactggcctccagctgttcccgaggtaccaccagatggagggctcgtcgtctaaggatcctgtcaggatccctacccagttccccaagaggttactgctagagaacccggctgccggtctggaggggctgccgtccaaggcccctccggtccagatggtccagccggtgtcggttgcgcctcctgcagggacgcctaccccggcattgcccgctgctcaccttcatttcctccagcagaaccagagctaccagaggtttcagctcatgcatcagatgaagattcagaacgagatgatgaagaggagcaatcttggtgatcagggtggtagcttaagcggtggtggtggtggtaagggtgtgaatctcaagtttgatagctcgaattgcacagcgtcatcgtctcgctccttcctttcgtctctgagcatggaagggactcttgcgagtttggatggaagccgggccagcaggccattccagctagttagtggctctcagacatctagcacaccggagatgggcctggtgcataggaaaaggtgcgctggtagggaggatgggggtggtcggtgcactaccgggagccggtgccattgttcaaagaaaaggaagcttaggataaggaggtccatcaaggtccctgcaataagcaacaaggttgcagacatcccagctgatgagttctcgtggaggaagtatgggcagaagccaattaagggatccccacatcctaggggttattacaagtgtagcagcgtgagagggtgccccgcgaggaagcatgtcgagaggtgcgtggacgacccctcgatgctgattgttacctatgaaggtgaccacaaccacaaccgagttctagcccaaccagcctgatctttcaggctatcaattcaagatcgcttctatagtcaccctccttcccctagaggaagggaggacaacaacaacaagaagaagagcctagtgtctgtacatattttctgcttctaacagttggggggagagagagtcagttagctagctctttcagaagaatcaaatcaatggtgacagaaggaaacttatcgcgtcgatggagaaagggagagtgcctcatcaaatcaaatactctagttttgtagtttcgatttctcttttgtgttcatcatcctgtgttagggccccatcctgtggttgcagtgtagtaacattgagctgcagttgtatgtctgagaaatggtgttagggggattggatcggagaagaaggcataaggcaggaaagtgcctgtaaaagtggctacacctaggaacagaatgtacaatcgtcttcagcccagtggtacaatcttgttgatgcagtggtgtttggtttggtc

SEQ ID NO: 258 - DNA, 1183 bp, Sorghum bicolor
accgcagctctcaatctcaagcgacatcgcggcagtgcgcacgccgtgcccgtgcaggcctctcctccactcactgcacatctctccagctctccactcgatcgaccaccgcgcgtcatggccttgttgcgcgagcacctcgacctcatccgcgcccacctcctcgacgaccaccacgtcgccgtgaccgtgagctccgatgactcggcgtcgttgcagtcgtcatcgccatcgccatcgcaatcgccgccggggcgtagtaggccgctgccagcgctttccgtctcgctgcccccgaggccaccggcggtagacctgcagcagcagcacctgtgggcgccggcgccgccgccgatgcagattcatcggcaggagcagcagcactactgctacccaccggaacccgaggaggaggaggacgatttccggcggtaccgcggcgtgcggcagcggccgtggggcaagtacgcggccgagatccgggaccccgcgcggaagggcgcgcgcgtgtggctgggcacctacgacaccgccgtggaggccgcgcgcgcctacgaccgcgccgcgttccgcctgcgcgggtccaaggccatcctcaacttccccaacgaggtcgcgttcggcgccgccgcacggtgggcggcggcgcctgctgctgctcctcagcccagcgtgaccgtggccgggaacaagaggggccgggcgaggtcgccgcaggagcaggacgccgggtgcttattggtcagggaggtgaagaaggagcgggttcaggagcccgcagcggcggcagcgggttgtggctgggatggcaaggatacggcggcaagcggcggaggggcggactacttctgggaggacgagtcgctgaagggggcgatctgcagcctgccgccgctctcaccgttgtcgccgcacccgcacctggccgtcccgcagctctccgtcagctgagacctgagatgtggcagcaagacagcggacggtggtcgcttaattaactgattagttagtcttagtcttaatctattttttgagttctttgattatgctagagaggagtgtacaggtccaaatgttctttcgttctttaattaggcctttgattcacaagcaaggaaacgtgccctggcgtagcaagaggatgctataagaatgtcagactggacaatttaaacatagcata

SEQ ID NO: 259 - DNA, 1760 bp, Sorghum bicolor
accacaccaaaccaaaccgttctcggcgtctccctccctccggcggcctccagagcccacccaaaaccacctcggtctccctgtctgtctccctctcgccccccgtttgcgtttgcccatcccatggcgacccacggcggcgagaacggcagcgggcacgcggcggcggagtggcggttcgcgcgggcggcggcggccaaggacgtggccggggcggacaagatgagcatccgggcggcgcggttcaagatcagcgcgagcgtggacgcgcgcgacccgcggcccgtgctgccgctggcgcacggggacccctccgtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagccattgaggttgtcgtctcagtccttgcccaaccgggcaccaacatattgctcccaagaccaggctatccaaattatgaggcgcgtgcagggctgcacaacttagaagttcgtcgtttcgatctgattcctgaaagaggctgggaaatcgatatcgactctctggagtcgattgctgacaagaacaccaccgcaatggtcatcataaaccccaacaatccttgcgggagtgtctatacccatgaacatttagcaaaggtcgcggaggtagcaaggaagcttggaatactagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatccatcacaaacttccttaacatttcaactgacccagcaacttttgttcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttttggaagggatcaatgatgatattgatttttgctgcaagctggcaaaagaagagtccgtgattttgtgtccagggagtgtattgggaatggaaaattggatccgtatcactttcgccattgattcatcttctcttcttgatggtcttgagaggatcaaatctttctgccgaaggcataagaagaagaatttgcttaatggccattaactgtatgagttcaaagttgttacccagttccatagttttccattgtatcatcaacaaatgtggaactttgaaatccctcagaattaataaagttaatgtttgcatatcagcatatgcaagttagtgtacatttttagtcaccttaaccatctgtgttgagatcttttgattttgtgtttgtttcagtttgcaattgcaatgttcttttcttttaatttgacatcatttatatgtgtggtaatggtgaaccgtgaaatacctagtcccatctattatgtactatgtcagttgtgaagctttttgtattgacagaaaatttacaactccaa

SEQ ID NO: 260 - DNA, 2419 bp, Sorghum bicolor
cgcccgcgacgatgccgccggcgccggctgcgcggaagaagcgcctggtccgcgcgggcctcctaaccgccgcggtcgggtacttcgccttcgtgctcctcttcgagctccccttgctgcccttcctggcgtcgtcgtcctcccccgccgccacctcctcctcctcgtcgctccccttccagcacccgcgccggcgggagctagaggccgcggcggcggcgttcacgtcgccgtactcccccgcccgcccctccaagccagccttccccgccgccgcaccgggcccgagctcaacgccccggctcccgatcttctcgtccctcctcctcctcccgcggcccaacgccacggccaccccgttcgacaccaccgccgccgacgccttcgccgcggccaagccgcacctcgcccacctccagtccatccccaaccccgcctccgcctccacctccgcgtccgcgcccgcgtcgtcgccgccgccgccgacatgccccgcgtccatctccgtgcaccgggagcagctgccctacgacggcgtgcgcgtggtggagctcccctgcgggctcgccgtgggctcgcacgttaccgtggtggcccggccccgacccgccaggcccgagtacgaccccaagatcgccgagcgcaaggacggggaggccgccgtcatggtgtcgcagttcatggtcgagctggtcggcaccaaggccgtcgacggcgaggcgccgcccaggatcctgcacttcaaccccaggatccgcggggactacagccggaagcccgtcatcgagatgaacagctgctaccggatgcagtgggggcagtcgcagcgctgcgagggattcgcctcccgccccgccgaggacaccgttgacgggcaactcaagtgtgagaaatggattcacgacgatgacaacaagtcagaggaatcaaagatgaaatggtgggtgaaacgattgattggcagaccaaaggatgtccacatcagttggccatacccgttcacagaaggcaagctatttgttatgactttaacagctggtttggaaggttaccatgtcaatgttgatgggcggcatgttgcttcatttccttaccgcactggttactctcttgaggatgcaactgcgttgtctctgaatggagacattgatatcgagtcaatttttgctagttctctacccaattcacatcctagttttgctcccgagcgataccttgagatgtctgaacagtggaaagccccaccgctgcccactgaacctgttgagcttttcataggcattctctctgcagccagccattttgctgagcgtatggctgtaaggaaatcatggatgatgtatacaaggaaatcatccaatattgtagctcggttctttgtggctctgaatggaaaaaaggaagttaatgcagagctcaagaaggaggcagagttcttccaggacattgttatagtgccttttattgatagctatgaccttgttgtgttgaagaccgttgccattgctgagtatggggtgcgcgttgtccctgcaaagtacgtaatgaaatgtgatgatgatacattcgtcaggatcgattcagtactggatcaagtgaagaaaggtcgaaatgataaaagcgtttatgtcggaagtataaactacttccatcgaccactaagatctggcaagtgggcagtaacttatgaggaatggccggaagaagtgtacccgaattatgcgaatggacctggctatgtaatttcatctgatattgctcactacatcgtgtctgaattcgacaatcagacacttcggctgtttaagatggaggatgtgagcatgggcatgtgggtggagaagttcaacaagacgcggcggccggtggagatccggcacgacgtgcggttctaccagtcgggctgctacaacggctacttcacggcgcactaccagtccccgcagcacatgatctgcctgtggcggaagctgcagtctgggagtgcccggtgctgcaatgtgagatgacgatggcgaaaacctgatctttgtggctaattccacttttgaggttcaaagaggacagacagatggtggacgacgggtcgacagcccgtaagaacagctcgcttatgaggaacgacggctgacgacccggtggtggtggggatgagtttggaggagtttgctcctcttgactttgtgatacgatcgatgattcgttcattcttttgatcggtggcccgtttcagctgctgattctgacagtcctgatcgatgttcttggtcagggattcttttatacactactactacctgttgatagtgtagctgcgtcaaacttttttgacctagaaattttgacttgggcgagttgggttagtatactggcggtgtttgtgtataaaaaggattttgtgagttgggatttatatatt

SEQ ID NO: 261 - DNA, 1055 bp, Sorghum bicolor
ccttccccatttcctcgcatcgcatccgccctcttgcttgcttcacacgagcgacgcgattaccaaatttttttccttttccgggggagtggttgttcgtcctgtcggcggcgggcggcggagggatggagacggcggccgcggcgatgctagaggccggggtagggcggttctcgcgggcgccggcgatggccacggcgctgctggcggagatgtgggcgccgctggccgtggcgctggcggcgctggccacgctgcccagcctgctgcgccgcctgcaggtcatcgtgctccgcctccggtcccgcgggaaggaggtcgtccagtcgcacatcgggacctactactcgccctgcgccgaggaggatggctccgccgaccgaagacgagagctccgacgaagaggcggaggacgccagctcatccgacgacgacggggagggggaggatctgaagcggatcgggttctacgagggggcctcggacggcgtcttcccctggggcggcgccgtggtccgcacctggcagggcctcccgcgccgcttctccggctgcgcctcgggtatcggaggaggtttcggcggcgccaccggaggagcgttccctggagctgtcaggctgtggggcgccagcacggccagcggcggcgagccgtggtgggccgccgtctgcagcgccgatgaaggcggctgccgtcgcgacggcggcgcggccgcggccgcggaggcggaccaggtcgtcgtcgggtggcggcgcgagcacgcgtcgcagcagcagcagcagcggcggcgccggcggcgtgccgttcccctcgctcacacgggccagtgaaacggaacggcacggcaacgggggtggtgggtgtcggatgtgaatatgccacaggggcgaccagctggagatgccgatcccgtgctgggggcccacctgtaagtgggtgggagggagggacgagggggcgggggtgatttattagtgtgggggatgggggaagactggttaggcgccgcgccggattggttggtgacaacattaaattttttttattagtagga

SEQ ID NO: 262 - DNA, 867 bp, Sorghum bicolor
ttatccgcgcggcggattccgtcgccaaacctcacgcgcggcctcgcgcggtggagtctgtttcctccgtcctctcgctcgatttctgcgacgcccgatggttggtcgcctcgcctagcacagccggttccacgccgcctgtccgcctgcgccaccagacctcgcgccaatcggtccttgagctcgcacgcacctacgaggacgaggagggagtgccgcccgcggggggctgctgctgctgctcatgctcccgatcccggcctggtcctggtggtggcggaggcacgcacggatctcgtggatccggccttgggcctccttgacgagtcgtcggcgtttgccgtaggtctgctcgaggcgccgctgcagctcggcggcgcgcgcccgcgcccgctccagctccgccagagcctccgccaggcgcgccctgctgagcttcaaggcagcgtcagcacatccagattcctgcgctgtggccgccgtcctcgccgccgcgtgcgccacctcgtggcgcggtacgaccaaggcagaggcggggatgaggatctggcggacagcgacgaggggcacggcggcggtggggaacgccccagcggcccaggagcgaagccaatgctgttcggcgtcccaatcggggccaagcggctacacggcgcggatggagatggagacgatgttgatgacggcgaggacagggccgccgaggaaaatggcgagggcaacgacgaggacgaggagaggcacgcggcgcgggagcggggggttaaggcggccaggaggaacgagacgtcggatctggatgtgctgacgctgtccgtgcgggcggccgcggcggcgaggacgagcacatccttgacgctgccttga

SEQ ID NO: 263 - DNA, 1307 bp, Sorghum bicolor
cacgcttctcgcttcccctcgttcaccgctgccgggacagctcttcttccgcaacggcaaggccacacgctcctggccgcggctgttcgcagcgcaaaccctaacggagccaacggaggcgcgcgagcggaagcatccatggacggcggccgcaagagggggaaggccgacggcgccaaaggggcctccgccggcgcgaagcggtcgcgagaatcggagtcatttcaaagtggcgtaggaagcaaatcgaagccatgcaccaattttttcagtacttctggttgtccctttggtgagggctgccattttctccattacttccccggtggctaccaggcagtttcaaaaatgaccaatctgggtggcacaacaattgcatctcctggaagaatgacgatggacgggccacctacacccaccgtgaagactcgcttgtgcaacaagtacaacactgcagagggatgcaaatggggtgacaaatgccactttgcacatggtgaaaaggagcttggcaagcctaagttgatgggcagctatatgccacctcccatggggccaagacccactggtcattttgcacctccaccaatggccagccctggcttggccactccagctagcttcggcgcttctgccacagccaagatcagtgttgatgcatcccttgcaggtggcatcatcgggaggggtggagtaaacacaaaacagatatcccgagtcaccggggcaaagctggccatccgggaccatgaatcagacaccagcttgaaaaacattgagcttgagggcacctttgatcagatcaggaatgctagtgctatggtcagtgagcttattgtcagcatcagtggcaatgcccctccacaggccaagaacccagctggcggtactcatcgtggtggacgcacaggaagcaacttcaagaccaagatgtgtgagaacttcgcaaaaggatcgtgttcgtttggcgacaagtgtcactttgcccatggtgacaatgagctgcgcaagcctgctgctgcttgagatccatgccctgtttcatacctcagtagtcattagtcaatgtaactctaaacatcgtctctgatgatggatttgctgacttctttaggcctgcgctactgatttactgacttcagggctactactgaatttgcggacttctttaggccctcgctattgccaactgaatttgttttcagcattcttcttgaatgttatgttatgaactacttaggtagtatgttactaggacccgttcaagaagaaaagtgtttgatgctgctgattggcatagtatctct

SEQ ID NO: 264 - DNA, 1965 bp, Sorghum bicolor
gtacatggatggcctcatgcgtgggcaagtggtgtgctctttggagacgaattctagagcacatatatatatggggagctgccttgagcttcttgcttgattggtgtatctgcctaaccttacctgctcatccttacaagaaggttgatcaggtgaagcatgagatggagctttaccctggatatctccaagaccatttcaacatccacaaactcagtcgcctggcgacgagcggcgccgcaccgggccgctacgtgacctcgggacccgccgtcggcggcggggccacggccatggggatctacgagcggcagcgccacctggtggcggccggcgtgtccgtgtggggggagccgttccggcccgacgccgacgccctgcccctgtccgcggtcgtccccacggtcaccctggcgacgccgccggcgccgccgcttgacgtcgtcgaagcagaggaagtcaagttcggcaaacaccagctgttacaggcacagcagtacgacttcccgccgcaggtggaagaagaagcgccgccgccgtcgtcggatagcttcggccacgaccacgacgacgacgccgcccggccaagagacaagattcagagacgcctcgcgcagaacagagaggcagctcggaagagccggctccggaagaaggcgtacatccagaatctcgagacgagccggatgaagctggcgcagctggagcaggagctcaccatggccaggcgccagcagcagcagcagcagcacggcgcgtacggcgttggaggaggaggaggaggagtcgcggcggcggcgggcgcggacccgcgggtggccgcgttcgagctggagtacgcgcgctgggtggaggagcaggggaggcaggcgacggagctgcgggcggcgctgcagtcgcacgcgccggaggtgcagctgcgggtgctcgtcgacgccgggctggcgcactacggcgcgctgttccaggccaaggcgcaggcggcgcggtccgacgccttcttcgtgctgtcgggggtgtggcgggcccccgcggagcggttcttcctctggatcggcgggttccgcccctccgagctgctcaaggtgctggcgccgcggctgaacccgctcatggaccaccaggcggccgaggtgcgcaagctgcagaacacggcgaggcagctggaggacgcgctgtcgcagggcatgagcaagctgcagcagacgctcgtcgacgccctcatgaccgtcgacgtcgcctcgccgctcggcgccggcggcgggtacgcggcgcagcagatggccagcgccgtcggcaagctcgccgacctcgtcgacttcgtggacaaggcggaccatctccggcagcagacgctgcggaacatgcacaagatcctgacgccgcggcaggcggcgcggggcctgctcgcgctcgcggactacggccagcggctgcgcgcgctcagctcgctctgggcggcgcgcccgcgggagccggcgtaagtgtaacggaacacccccgcgacggcgacggcgacggcgacggagaagaggaagcggcattacaggcacgtgcgcgcgtggttggctttggctgccgccccggacggccggcggagcaaggctgcggcggtcagtgcctcagtctcctctccttccagctctgcatctggtattctggtacgggcaaccggcgtgttcttctgttggctctcaggatgaaacctgaatcttctaatggtgttacagttacagcagtgaattaggctttgaatttgattgacagatcaaagaagttaattacaagtgtaaatacagtatacaaagttgtttgggtaggagtaggacaggcttttattgttcagttgctcttgtctcggtcaacctgtaaacagatcatgcgaaagatgtacaatgaacaatctatggagtgttaacacaggcttgtatggcaactatccctaaggtccgtttagatgcaaat

SEQ ID NO: 265 - DNA, 167 bp, Sorghum bicolor
gtgaaaaaggagcaaagaatgacaaaagatgagactctactagtcttcactcttgtggtttcctcggtttctattttcttattcgggatcttgcttttcagggttctcatctctgcaactcgcgattttcgcgagagaaccaaatccaagttggtgaagatcttgat

SEQ ID NO: 266 - DNA, 2348 bp, Sorghum bicolor
acagcagcagtaacaatggctagcggcgcgacgagcgacgcgtggccatcctccccctactcctcgtcggcgcccgacggggaggtcctacgctccctgcaccgcctggcgcgggacctgtctgcagccgaggcaccggcgccgttcctccgggcggtcttcgcggcggtggcgaggcgggcgcgcctgctggcggccgtgttcgacgacctcctcctctgcggcgctgccgcgggcccgctgctcctacttccgcggtccgcgtcgctgtgcctccgggagctcctgctggtgctgcagcggttcaaggcgctggtggccgactgcgccgcgcgcagccgcacgcgcctgctgctccagtcggacgaggtggcggcccgggcgcgggagctccagcacgacctcgccacgctcctcgacctgctccccgtcgccgacctcggcctcgccgacgacgtgtcggacctcctggcgctcgcgtcgcggcagtgccgccgcgcggtcgcggcaccggagctggagctcaaggcgggcgtgctcgcgctcatccaggaggtggagcgggagatcgtgccggggcgggagaggctggagggcgtactggaggacgtgggcatcaatgatccggctagctgtagcgacgagatcgagaccctggagcgagagatcggcgaccgtgtcgctgagaggtggacgtcgtcgatgatcgccctcgtcggcctcctccgctacgccaagtgcgtcctcttcagtgccgccacgccgcggcccgtggactccaacaaggtggatctcgacgacggcgacggcgacgacggcgcggagccaccgtcgccaccgctggatttcaggtgccccatctccctcgagctgatggccgatcccgtcgtggcttctagcggtcagacgtacgaccgcgactccatcacgcggtggttcggctccggcaaatccacgtgccccaagaccgggcaggtgctgccgaatctggagctcgtgcccaacaaggcgctcaagaacttgatatcgcggtggtgccgggagaacggcatccccatggagagcagcgagtctgggaaatccgagccggcgccggtggtggtaggcgcgaacaaggccgcgcagaaggcggcgcggatgaccgcgtcgttcctggtgaagaagctgtcggcctcgttctcccccgaggcgaccaagcgcgtggtgcaggagatccggcagctggccaagtccgggtccgacaaccgcgccttcatcggggaggccggcgccgcggggctcctcgtgccgctgctccggtccgaggactcggctctgcagctcaacgccgtcacggcgctgctcaacctctccatcctggaggccaacaagaagcgcatcatgcacgccgagggcgccgtggacgcgctctgccacgtgatgtgctcgggcgccacgtggcgcgccaaggagaacgccgcggccacggtcctcagccttgcggccgtgcacgcgtaccgccgccggctcggccggaacccgcgcgtcgtcgacagcgtggtgcagctcgcgcgcacgggccccgccagcaccaagaaggacgccctcgcggcgctcctgtgcctgtccgccgagcgcgagaacgtcccgaggatcgcagccgcggccgtgctggcgtccctggcgaagcgcggcggcgcggaggcgatcgtggcgctggacggcgccgtggcgcggctggtggccgagatgcggcgcggcacggagtggtcgcgggagtgcgcggccgccgcgctggtgctgctgtgccggcgcgcgggcgccgccgccgcgtcacaggtgatggccgtcccgggcgtggagtgggccatctgggagctgctgggcaccggcacggagcgcgcgcgtcgcaaggccgcgtcgctcggcagggcgtgccgacggtgggccgctgccgccaacgcggagcagggcaccgagtgccccacctccggcgacgcgtcggggctcacggtggcgtcgtgaaatccactactacacgatcagtatagtagatagaagctcaaaaaaagaagcgaagccattttttttttaccacgattcttgtacaaaatttgttgttggccgtcaaggccttcacgattctttggtccgtgatttgggccgtgggtaattgatcaactgtgaatacaagatactagtactgtagtacgttttttttccctttttcatcaaacatttgttacctattgtcatgtctcaagaaaatacaaaggaaagcaacaaaatcgctcgaaccagtgacttgagctccattgttgtgacgtccgcattccaaacaagcgcaattaacgttgtcgtctgttccc

SEQ ID NO: 267 - DNA, 1263 bp, Sorghum bicolor
atggaggagagaattccccaacgaccaagagaggcacaagcacccaccgtcgctcagccggcgccgacgaccggcaagccctgcgatgacggcgatgctctagctcccgccatccagctgctttcgtcgtcgtcctcaggcgaggagtcgtccgacgacgagggggagctcgagttcgagttcccgttcgtcagcagggactcccccgcgggcacggccgccccggccgacgagctcttcgccgacggccggatcaggactttctacccggtgttcggccgcggcgccagcagccacggcggctgcacgacgcgtccggctgctccggcggctgccccgccgcgggtgaggggccagctgggaaagttgttcctggaggaaacccgggagcgcaactcctccactagctccacgtcgtcgtcgtcgtcgtcgtcaggggccgccacggacgacgacggcctggaaggcgtggcgccggagagctactgcgtgtggcgtccgggctcgtccgcgtcgccctccccgccgacgccgcccaggaagagcgggtccacggggtccatggcgcgatggctccgcatcagcgacctcgcggtgggccgcagccacagcgacggcagggagaagttcctctttctcgccgccgcgccggcgcacgacgcgcccaggcggagcaagaagcctgcccctgtccctgcccggcctgcaggcgccaggaagcctgcgccctccgccgccgtcgccgccgcagacgccgacaccgccgccgcccaccggatagcgcacctcgccagaggcggactcggcgtccccgtcccaccaggcggcacgccgcggcgcacgttcctgccgtaccgcgaggagctcgtgggcttcttcgccaacgtgaatggcatcagccggagccaccaccatccgttctgacgtcttgtcacaggcgaacaaactattcgatcagttacacaccctgattaattattcagttttcagggcttggattggattgcggcaaaaaaaaaaaatcaaattctactgtatgtgattatcgctttttttactagtgcgtaagtaggcggttatagctaatgatttcgggttagaaattgatcacgcgactggtggtggtgaggtgaagcatactccctccataccagatttaagtgacgttctgggcacttgtatagatttcgtaaaacatgacgttgtagctctgaagaagtccggaggactggaatgcccctgccgcttcgttagtatgatttc

SEQ ID NO: 268 - DNA, 1694 bp, Sorghum bicolor
ccacacagagcaggcgagcaccaagcaccaccaccgcccgggcggccactccacttccacttccacttcccctgtgcctgtgcactgacgcggccagcgccaaagcttcctttcacctcaagataaggagatcgcagcctctcggggccacccccaatctccaacgacgccgtcccccgcacttgtccccaactcgccactcatggccatggccttccacttccacccgctggccgccacgcgcgtccacctctccccactcccgttcgccgccgccgccgccgcgggggcgccctccccctcgtcctcctccgtcgccatcgcggcgccccaccaccaccacggccgccgccgcttctccgccgtcgtggccacggcggccgccacggagttcgacttcaaggcgtacatgggggagcgcgcggtcgcggtgaaccgtgcgctggacgcggccatccccgccggggaaccccccgccgcgctgcacgacgcgatgcggtacgcgctgctggcgggcgggaagcgcgtgcgcccggcgctgtgcctggccgcgtgcgccgtggtgggtgggcccgaggcctgggcgatgcccgccgccgcggccgtcgagatggtgcacaccatgtcgctcgtccacgacgacctcccctgcatggacgacgacgacctccgccgcggcaagcccacctgccacgtcgtctacggcgagcccatcgcggtcctcgccggggacgcgctgctctcgctctccttccaccacatggccagcgtcgggtcctaccctccggacgtagacccggagaagcatcccgcccgcgtcgtccgagccattggcgagctcgcgcgctgcatcggatcggagggactcgtcgccggccaggtctcttcgtttctcagattacatattgcttttccgccattcaccaaatatacatacatacaatcaagtaaaaccgggcagttgcttatattaaaatttactagctctccaacaaagaatgcgacttccaagtgcttaaacaaattgctgaaaatgcttcacctgccctctacaggttgtcgatcttgagatgacgggcacatctgaacctgtgccccttgaacgccttgagtacatccatctccacaagactgccgcattgcttgaggcctcagtggtgattggggcaatcattggaggcggcacggatgagcaaattgagcggctgcgaaaatatgcgaggtcaatcgggctgctgttccaggtggtcgatgacattcttgatgtcaccaagtcgtcagaggagctcggcaagacggcagggaaggacttggcaagtgacaagacgacgtacccaaagctattggggttagaaaagtcacgcgagtttgcagaaaagttgctttctgatgcaatagagcagcttgattgtttcgacaaggagaaggcagcacctctgttgcatttggccaactatatcgcccataggcagaactgaggaggaattggggtgatgcttattccattgttgctcattgtcgatctgtaactttgtaaggccgttgaacttgggtttgaggaatatatccaaatcatcatgtgatgtatactagctgtagctctgtaccttgatgtaatgaggctgttttagttgaaaaatatgaatatcatatcaaattagtgaaacctgattgaaaccaatctttatgcctca

SEQ ID NO: 269 - DNA, 698 bp, Triticum aestivum
ggacgaaggagacatccaacgcctgaagcagcacatcgtccacctcaacgagtcgggcggcacgcccctgcctcgcccgccgtctgctttcgccaccgtcgtcgcactcgcgtggacgtgctttgcccggtgcaagtcgttctccttggaggacgacgtgtggctcttcttcttcgccgacatccgtgagcgccttgaccctcccgtcggcgcggggtacatcggctcgtgcctcaccaagtgcttggcaaggctccccgcccgggagcttcatggcgagcgcgccctggcggctgcggcggcggcggtccaagacgagatcaacaagatgaaggaagaccctatcgctgggtggaacttcttctcattcgatcccatgcccgccatggaccggctaatgaacatatcaggctcgtcgggctttagtgcatacaagatcgccgacttcgggtggggaaagccaagacgaacagagccgattaggatgaacacagacggtcaggtggcactgatgggcagcagggacgaccggggtgtgcaggtctcagtggcactgctccaagcggcacaaatggacgagttcaaatctaactttctggcgctacttgagtgacaatatttgttctcaaagagacctacttaggtcacttcaaaacagtacacccaaatgttttataaacattaatacattataattg

SEQ ID NO: 270 - DNA, 1121 bp, Brachypodium distachyon
ccccaaccatggatgcgaccacggccgcctcgctcccacgcctctccgtcccgccggcccctcgccctaccatcaccccctcccgcttccgccccaacgacgcccctgtccccagccgccgccgcctcagcctccgtttccaccgctcgccggtggcagctgctgctgccgcaagctccccgtccgctacatcctcttctccggaaccagggtcgggcatcggtgatgcgctaggtggcgtctccatcttctctgcggccaccggcgagcccgtcctcatcagggatttgtgggaccagaatgagggaatggctgtcgttgcgctgctaaggcatttcgggtgtccttgctgttgggagttggcctccgtgttgaaggatgcgagggagagattcgattcggctggcgtcaaactaattgctgttggtgttggcactcctgataaagcccggattcttgctgagcgtctgccctttccattggattgcctctatgcagatcctgaacgcaaggcttatgatctcttgggtctatattttggtgtcggtcgtacattcttcaacccagctagtgtgaaagtgttctctcgatttgagtccctgaaggaggcaacgaaaaactatacaatcaaagccaccccagatgataggctgagtgtcctgcaacagggtggaatgtttgtgttcaaagggaaagaactgttatatgcaaggaaagatgaaggcacaggtgatcatgcccctttagatgatgtccttgacatctgctgtaaagttccagtcgcctgatgtcgaatcctacacaggctccgccgcgactggaaagcgtatttcacaagcttggcatcagatgattttcgactgctgacgggtgcaagtgtagtatctgcatgtatatctactgtaagttggaaacataaagttgttgggcaaaccaaacgtagaactctgccatacccttatcggagtttagcagggtagggttttggaagaaatgtatacgctgtaaagcaggtttataccgttgcttctggaaatggaacgctgaaaaaagtagcggggtcgatcagtacctgctgcgtatgagttcagatggtcaaatccccaggctctgacccacca

SEQ ID NO: 271 - DNA, 1591 bp, Zea mays
cttgtcttcgtctcgtctcgccacaggcacagccagccctatcgatcggcggtacggtgtctgccaagccaagtgccaaccgcaaccgcccccgcgccgagcgagacgatggagacgacggagatggcggcgtcgtgcacgactaccgccaggcgctgttcccacactacgagcggtggaggaaggagtacggccccatcttcacctactccatcggaagcatggtgttcctgcacgccagccggtccgacgtggtccgggacctctgcctcagcgtgtcgtcgctggacctcggcaagagctcctacatgaaggtcacgcaccggccgctcttcggcgacggcatcctcaagtccagcggcgaggcctgggcgcaccagcggaggctcatcgcgcccgagttcttcccggacaaggtgaagggcatggtggacctcatggtcggctcggccacggcgctggtggcgtcgtggggggacaggacgggcggcggaggcgtggagctcaagatcgacgacgacatcagggcctactccgccgacgtcatctccaggacgtgcttcggcagcagctacgtcaagggcaagaggatcttcgcggcgatcagggagctgcagaaggcggtgtccaagcccaacctgctggcggagatgaccggcctcagcttcctcccgacgaggactaacagggaggcgtggaggctcaacagggtcgtgagggacctggtgctggacgtcgtcagggagggcggggacgacgacaggaacctactgaacgcgatgctccgcagcgcttcttcctccggtggctgcagcggcgaccgcgtggcggtggaggagttcgtcgtggacaactgcaagaacatctacttcgccggctacgagaccacggcggtgaccgccgcctggtgcatgatgctcctggcgctgcacccggagtggcaggacctggtgcgcgacgaggtgcgccaggcatgcggcggcggcgacttcgcgtccctgcacaagatgaagaagctgacgatggtgatccaggagacgctgcggctgtacccggcaggcgcggtggtgtcgaggcaggcgctccgcgacgtgaccctcggcggcgtgcgcgtgccggcgggcgtcaacatctacgtgcccgtctcgactatgcacctggacccggagctgtggggcgccgacgcgcgggagttcgacccggggcggttcgcggacgaccaccagcggcagcggcagccgcacgcgtacctccccttcggcgccggcgcgcgcacctgcctcggccaggccttcgccatggccgagctcaaggtcctgctggcgctcgtgctgtccaggttccggctcgcgctgtcgccggcctacgtgcactcgccggcgctcaggctcatcgtggagcccgagcacggggtgcggctgctgctcaccaacgtggagcccaggggtgctagctagatgggcctcactggaccgggtatttaattcggcccagtagtcaaataatctgccatagtataaacttcgtgaagcctgagttcggcagagattccgtgaataaaaacgattacaaaatcgatcaggtttcctgg

SEQ ID NO: 272 - DNA, 1470 bp, Zea mays
tgatccaatttgactacctctacgggatagacctcaatagaaaactgttgagtaacggcagcaagtgattgagttcagtagttcctcatagaaaattattcgactctagagatatggtaatatggagaagacaaaattgtttgaagcacgcacagaaccggaagcgccccttgtttcaaagagaggaggacgggttattcacatttaatttgatggtcagaggcgaattgaaagttaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcagcggatttggattccttttctatatatccactcatgtggtatttcatcatacgattcatataagatccatctgtctagagatcgtcatatacatctagaaagtcgtatgctttggaagaagcttgtacagtttgggaaggggttttttgagaaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaaggtaagtaaatacgtactaggaatatggaaaattgcatatttgggaaatttgcaataatgcgatgggcgaacgacgggaattgaacccgcgcatggtggattcacaatccactgccttgatccacttggctacatccgccccttatccagctaaaggattttctcttttttccattcattattattctatttattctgacctccatacctcgatcgagatagtggacataggatgccactctttaaaatgaaaaaaaggagtaatcagctgtgacacgaaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacata

SEQ ID NO: 273 - DNA, 1820 bp, Sorghum bicolor
cacgcagcagcgagccagcgaccgcggcgacgctctctcatcaccaatcgcccatggccacgggcaccgaccgtccatggtgggcgccgccgccgccgccgcccgcggcggttccctccgccccgcggttcccctccccgccgtcgccgtcgtcgtcgttcacggccgacccgccggcggagttcctctgcccgatctccggcacgctgatggcggaccccgtcgtcgcgccaccgggccagactttcgagcgcgcctgcatccaggcctgcgccgcgctcgccttctccccgccagccgtcgccgccgacctctctcagtcccaccactcctcgtcgtcgtcgtccccgctcgtgctcgtccccaacgtcgcgctccgcaccgccatcctcaactggtgcgaccgcctcgcgctgccgcacccagcgccgctgtcgccggacaccgcccacgacatcgtgcgccgcctcatgccgccgcagcagcggagctcgctggcgcagccgcagcgaccgcagacgcaggtcgcctcgtcggttcgggtgaggcgacccagcgtcttcgacggcttcgcgcaggtgcaggagccgagctccagacagaggggtgacgctctggaggaggagatcatggccgcgctcggggcggacggcgccacccccgcggagcaggcgtcggcgatggccttgctgcggcaggcgacgcgggagaaccaggaggtaaggcggcagctctgcacgccgcggctcctcgccgcgctgcgccccatgctgctgtcgcccgacgccgacgtccaggtcaacgcggcggcggcggtggtcaacctgtcgctggagcccgagaacaaggtgcggatcgtgcggtccggggcggtgtcgccgctcgtggacgtgctccgcggcggccacccggaggcgcgcgaccacgccgcgggcgccatgtacagcctcgccgtggaggacgagaaccgcgccgccatcggcgtgctcggcgccatcccgccgctgctggacctgttcgcgggcgccggcgccacgggccaccgcgcgcggcgcgaggcagggatggcgctgtaccatgtctccctctccggtatgaaccgctccaagatcgctcgcgcgccgggcgctgtgcggacgctgctctccgcggccgaggcgcgggaccgcgcgagcgagaccgacgccgccgcgctccggaggctggccgtcatggtcctggccaacctcgcgggctgccccgacgggcgcgccgcgctgatggacggcggcgcggtggccgcggtcgtcaggctgatgcgcaacggctccgtggctcccgggagcgcggagcaggagtactgcatatccacgctctacgggatgagccggggcagcatgaggttccgcgggctcgcgcgcgcggccggggtcgaggccgcgctgcagccggtggccgagggcgaaggaggcgtggggcgagacctggcgcggcgcacgctgcgggctatgcgcggcgaggacgacgacgccccggtcacggccaccggactactcggacggcagtgggacgacggcagcgtcgtgtcggaggggcttgtctccatccggcggccgccgcaccggagcaattacgccgggccgtccgggtcaaacacaacccagttctgaaaaaaaaaaaacaaagtcaaagtcttcgttttctgcacgctgtcctgccgtctcgatcaagtctttggaactgtatgtattttggttaccatagcagaaaaatattgcaaggtccctcttgtcttgtataaactgtacaggcctgtttggaacggaggaatcaaaaacaaa

SEQ ID NO: 274 - DNA, 1178 bp, Brachypodium distachyon
cgtcctaatcctaatccccaaaagccaaggccgctcgatataaatgcccgctgccacgccaccgtcttctcccctctctccccaatcgaattccccacggaggccgaggagaggagagtgctgcagtgcaccccgcgcgctagggctcgggagaggcggaggagacgcagtcgagtcaactccaatccttactcctcctcctcctgccccgccccgccaacccacacccgcggcattctctccggtgttcctcaaggaaaaaaaaggcaagagaggcagcaagatggtgctgtgggtcttcgggtatggctccctgatctggaaccccggtttcgatttcgacgagaagatcctggggttcatcaagggccacaagcgaacgttcaacctcgcttgcattgaccatagaggcacaccaaagaatccggcgaggacttgcacgcttgagtccgaagatgaagccatatgctggggaattgcatattgtgtcaaaggtggtctagaaaaagagcgagaggcaatgcagtacttggagagaagagaatgtgagtatgaccagaagatttcagttgatttctacaaggatggagattctctgaaaccagctgtgacgggtgtattagttttcgtatccactcctgatccagttggcaacaaatactatcttggccctgcccctttggaggatatggcaaggcaaattgctacagccaatggccctaatggaaataatagggactacctgttctcaatggagaaggcactgtccaacataagccatgaggatgattcgatcattgagcttgcaaatgaggtgaggaaggtcctgagcaggtcagagaagattaccggctccgacatatcactaaaatcacatactcctcttgtgcacttgtctgcccttccagagggcactgtcgtggattcaagatagtaataaagagcggcatggctggatcagcggaaggaaaggcaattttgcccgaccatactcactcttgacattgtctggttgaaggatctgcattttgattcagctctggcataactgaggatccgtgtgtactgattgtcttccaaggctgtaaacctttggagtgctagtgtgaaagcctgagaccacgttatgttggttcgtttgataccctaataagaaacgcttttggcgagtttacaca

SEQ ID NO: 275 - DNA, 2893 bp, Zea mays
ttttaattatagcttcaaacagctaactttaatacgaaacgaacatgtaatatactcgatacaaaatttacaacccaacattaggtttcatcagttcaccgtcgtaaaaagtaaaactaccggaagtttgtaactaacccaacaaaaccgccgttatcatacgcgtattaccacctatccgttgtgcttgctgttccagcctcctcacaacacaagggtccatgccctgcgccgccgccgcggcgaccccccaccccgcgtcccccgcaacggtcacagctcacctcagctcaacgcgcccagacccggcgaccccgaccctcctctccagctagtatttaccaccacccagcccccttcccgcaccgcaccaaacggctactacccctcccctcccctcccaggctcccacccccactgccttccagaaccttccgccgtccgcgatgccgacaccgcctccgcggaagaagcgcctggtccgcgcaggcctcctcgccgccgcggccggttacttcgccttcgtcctcctcttcgagctgcccctgctgccctttctggcgtcgtcctcccccgccgccaccacctcctcctcctcctcctcgctccccttccagcacccgcgccggcgggagctggaggccgcggcggcggcgttcacgtccccgttctcgcccgcccgcccctccaagcgggccttccccgccgccgccgcaccggccccgggctccacgccgcggctcccgatcttctcttccctcctcctcctcccgcggcccaatgccacggccacccccttcgacaacaccgccgccgacgccttcgccgcggccaagccgcacctcgcccacctccaggccacggccaaccccaccgccgcgtctgcgcccgcgtcgtcgccgccgccgacctgccccgcctcggtcgccgtgcaccgggagcagctcccctacgacggcgtccgcgtggtggagctcccctgcgggctggcggtgggctcccacgtcaccgtggtggcccggccccggcccgcccggcccgagtacgaccccaagatcgccgagcgcaaggacggggaggccgcggtcatggtgtcgcagttcatggtcgagctggtcggcaccaaggccgtcgacggggaggcgccgcccaggatcctgcacttgaaccccaggatccgcggggactacagccggaagcccgtcgtcgagatgaacagctgctaccggatgcagtggggacagtcgcagcgctgcgagggcttcgcctcccgccccgtcgaggacaccgttgacgggcaactcaagtgtgagaaatggatccgtgacgatgacagcaagtcagaggaatcaaagatgaaatggtgggtcaagcgtttgattggcaggcctaaggatgtccgcatcatttggccatacccattcacggaaggcaagctatttgttatgactttaacagctggtttggaaggttaccatgttaatgttgatgggcggcatgttgcttcgtttccttaccgcactggttactctcttgaggatgcaactgcattatccctgaatggagacatcgatattgagtcgatttttgctagttctctacccaattcgcatccaagcttcgctcccgagcgataccttgagatgtctgaacagtggagagctccacctctgcccactgaacctgttgagcttttcatcggcattctttctgcagccagccattttgctgagcgtatggctgtaaggaaatcgtggatgatgtatacaaggaaatcatccaatgttgtagctcggttctttgtggctctgaatggaaagaaggaggttaacgcagagctcaagaaggaggcagagttcttccaggacattgtcatagtgccttttatcgatacctatgacctcgttgtgttgaagaccgttgccattgctgagtatggggtgcgcgtcgtccctgcaaagtacgtaatgaaatgcgacgacgacacattcgtgaggatcgattcggtactggatcaagtgaagaatgttggaaacgataaaagcgtttacgtagggagtataaactacttccatcgaccactaagatctggcaagtgggcagtaacgtacgaggaatggcctgaagcactgtatccgaattatgctaatggacctggctacgtaatttcatccgatattgctcgctacatcgtgtccgaattcgacaaccagacgcttcggctgtttaagatggaggatgtgagcatgggcatgtgggtggagaagttcaacaggacgcggcgggcggtggagatccggcacgacgtgcggttctaccagtcgggctgctacaacggctacttcacggcgcactaccagtccccgcagcacatgatctgcctgtggcggaagctgcagtccgggagtgcccggtgctgcaacgtcagatgacgcattgcgagagagagcctgattttgtactctttcttgatcaaagaggagagaaacagatggtggtggacgacgggtcggcagcccgtaagcgcagctcttctgcgatggacacagctgacgacgacccgttacgacggtgggtttgcaggaggaggttgctcttctggaccttgtgatgcgatgattctttcattcttttggtcggtggcccgtttgagctgctgattctgacagccctggtcggcgtccatggtcggggattctcttatgctgctgctgctgctaccacctgttgatatttttaggtggtagatccagtacatgaggctaagtagggctccggatcatatgggatctatccttgtgctttgcgtcaaacttctttgacctagaaattttaacttgggtgagttcggttggtaggctgtgcttgtctataaaaaatgattttctgagtt

SEQ ID NO: 276 - DNA, 711 bp, Zea mays
tgcgtggctgctgaatgggcatgcagcataaaggcagcaaaaaaaaaaaaaaaaggttgagacgggacgacacagagagaatcaatgactcgtattcccaaatcccaaaaggccaaaaaccatacgccgcccaaatgcaaaagctgaagagggcgggggggcgtccaggttcaatgcatgtacacgaccccccttccgtcttgatctgacctgtgggctgtggcctgtcgctgctgcctgcaactgcaatgcaggtcatctctttcaaaccccacacggccacacggcatgtttcaaagtcaggtccaaattccagcagctctgagctatagaaaaaacggcttgggggcgacggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttccctcagcaggtagctagagatgatcttgctttaattttgtgctgatctcttactcgtcgtgtacgctcatatgcatggggcgacggatttgtctctgatcgttcccatgccgcctcttgtatcttgacttggatctatatatcaatgcaaataaatcatcgatgggtgacaatcgatcc

SEQ ID NO: 277 - DNA, 590 bp, Zea mays
tgagcatggcatctcaccagactatgaaacccgctcgaataaggggtaggtgaggaaacctttgcttggcttcgattagaaaacggattgatactcagactgggaataaaagagttcaagctgagctagtgtaaactacgcatctggaggtgaaagctatagcttcaggatctcattcagagtagcagagtggagcctgagctttggattgctggaatggaaataacatctgctgtggactgctgggatctacctgcaaacctacgtggccatactccagaaccttatacccccacttccttttagaggttgttaatttgagatttttgagttattcttttgtctagctcgtagtttatttttgcttaatcttttgtttggtcagttgtttgttagggctgttgatttgtatagattcagactacatctcttctggcttgtggatttcgatagacttgttgtacattgacatatgctggtctcaaatgaggatgataggttcttggtcccaacttgtgactagttgcttgtgcttcttgtgaattctatctgatgttcagaaaaaaaaatgtccttgggttttgttgtct

SEQ ID NO: 278 - DNA, 1083 bp, Hordeum vulgare
tatatacggacggcgcacaccacgcgagccgcggcaaaggcacagagaagagaggggacaacagtcaaaagcgagcgaggcggaagaaatcccttgagatggacgcgcgaccgcgacgggcatcgtcctcgccggcggcggcgacggcggccttctccctgctgctcctgttccccatgctccaagggagccaggcgtcggcgcacggcaacgattcggtcgcctgcggcatgacggcgctgcagaagcacgcggcgttcttcgacggcgacaaggacggcgtcgtcaccttctccgagacatacgcagcgtttcgggccctcggattcggatacgccgcctccaccttgagcgctaccttcatcaatggcgtccttggcccccagaccagaccggaaaatgagacggcgcgctattctatctacatcgagaacatccacaagggtatccatggaagcgattcaggcgcatatgactcccaaggaaggttcgtcccggacaagttcgaggcggcgttcgccaagcacgccaagacggtgcccgacgccctgacgtccgccgaggtggacgagctgatcaccgcgaaccggcagcccagcgactacgcaggatgggcgggcgcgtcggcggagtggaagatgctgtacagcatcggcaaggacaaggacgggctcctccgcaaggacgccgccaggggcgtctacgatggcagcctcttcgccagggtggtgcaggagcggaggacgtcgtcgcaagaagaaacccaggcatgatgggttgttcggttcatcggagggcgtcactgtcccaagcgatggaggccagtctgaacactcgagtccgtccgaactgatgcgtcgctggctaggtacagagcattacgtacgagtaataattacttatccggtgtgattggttcgtcgcgtcacgccgtcacggtctgtcgccacatatagctatcggacagtagtagtactactgctaaattaatgttaaaataggcctgtgtgaacgggtgtgaacgcatgtgaacggaatcttgggatggggccgatgttcctcttgtttgtatcctgtggatgc

SEQ ID NO: 279 - DNA, 2422 bp, Hordeum vulgare
tggctagcagcaaggtagagagtacgtacgtaccatgatgatcccggcgaggcacatgccgtcgtcgatgatcggccggagcagcggcggcgcgccctacggatcctcgtcagcactgtcgctcggccagccaaacctgctggacggcagcaaccagcacctcctgcagcaccacctcctggagcagatcccggtgcgcgcggcggagagcggcgacaacaacatcggcagcggcggcggcggcgtgggcatgatccgcgggcgggagtcgatggacccgctgggggacgagttcgagagccggtccggcagcgagaacgtggacggcgacgccgtggacaacgccgagcaggaccaggaccccaaccagcggccgcgcaagaagcggtatcaccgccacacccagcaccagatccaggagatggaagcgttcttcaaggagtgcccgcaccctgacgacaagcagcgcaaggagctgagccgggagctggggctggagccgctgcaggtcaagttctggttccagaacaagaggacccaaatgaagaaccagcacgagaggcacgagaactcgcagctgagggcggacaacgacaagctgcgggccgagaacatgcgctacaaggaggcgctcagcagcgcgtcatgccccaactgcggcggcccggcggcgctcggcgagatgtcgttcgacgagcaccacctccgcgtcgagaacgcgcgcctgcgcgacgagatcgaccgcatctccgccatcgccgccaagtacgtcggcaagcccatggtgcccttcccggtgctctccagcccgctcgccgccgcacccggcgcctccgcctacgacgtcttcgccggggccgcctccgtgctgcaggcgccgcccgacgacaagcagcagggcgtcgtggtcgagctggccgtcgccgccatggaggagctgctccgcatggcgcgcctcgacgacccgctctgggccaccacggtggaccagacgctggcgttggacgaggaggagtatgcaaggatgttcatcgacccgcgcggcggccttggacctaagcagtatggcctcgtctctgaggcctcccgtgacgccaccgttgtcatcatgacccccgccagcctcgtcgagatcctcatggacgtcaaccagtacgcggcagtgttctcaagcatcgtgtcaagggcggcgacactggaggtgctgtccaccggcgtggctgggtgctacgatggcgcgctgcaggtcatgtcggtggagttccaggtgccgtcgccgctggtgccgacaagggagagctacttcgtgcgctactgcaagcgcaatgctgatggcgcctgggccgtcgtcgacgtgtcactggacggcctgcaaggggtcaagtgccggcgcaggccctccggttgcctcatccaggaggcgcccaacggctactccaaggtgacgtgggtggagcatgtggaggtggacgacaggtccgtgcacaacatctacaagccgctggtcggctccggcctggccttcggcgcccgccggtgggtcggcgtactgggccgccagtgcgagcgccttgccagcgccatggccagcaacatccccaccagcgacatcggagtgatcacgagctcagaggggaggaagagcatgctgaagctggcggagaggatggtggcaagcttctgcggcggcgtgacggcctctgtggcacaccaatggacaacactgtcggggagcggtgccgaggacgtcagggtcatgaccaggaagagcgtcgacgacccagggaggccgccgggcatcgtcctcaacgccgctacctccttctggctccctgtcccgcccaagcgcgtctttgacttcctccgtgacgaaacctctcgcagcgagtgggacatcctctccaatggcggcatcgtccaagaaatggctcacatcgccaatggccgtgaccatggcaactgcgtctcactccttcgcgtgaatagcaccaactcgaaccaaagcaacatgctgatcctgcaagagagctgcacggacgcatcaggctcctacgtcatctacgcgccggtggacgtggtggcaatgaacgtggttctcaacggcggcgaccctgattacgtcgcgctcctgccctcgggcttcgccatcctgcccgacggtcctgcggggacaatgcacgccgcggcaggggcaacaggcaccggtgggtcgctcctgacagtggccttccagatcctggtcgactccgtccccactgccaagctctccctagggtcggtggccaccgtcaacagcctcatcgcctgcaccgtggagcgcatcaagaccgccgtcatctccaatggcagcgcctctcccccgcagtagcttcgttcaattcatcaatcttcctatgttctgtatcagaggagcagcaaatag

SEQ ID NO: 280 - DNA, 1207 bp, Hordeum vulgare
tcgtcctgcacgttgatgcgtgcaagcgatctggttgctcgagataaagatgaagagcagcagcaatctcgaggccttcctccaggccgccacgccccggctcccatggcgctccgccaccatggaacgattccagggagcgcccagcagcgtgtggcaacacccggaaggcaagaacaaggacgcggtggagtacttcgccctctccgacctgtgggagcactacgccgagagcagcgcctacgggctcgccgtgcccgtccgggacgccggtgaccgcgccgtggtcaccacccagcacttcgtcccctacctctccgccgtccagctctacaccgccacaaagcccacctcccacaccctcggcgccacctccaggagcacggggagcgagacggattcatggagcgacgacagcgtgggcggcgacaggttcgccggctccggatcctcctcctgggacgccgcatcagacgaagacgacgcttcatccacgtacgacggcagcggctccaccggcgtctcagcgaagcagagtgggtacctgaactttcagtacagggagtgggactcgccctacgagagggtgccgctggctcacaaggtggaggagctggctcgggactacccatgcctcatgtcgctcagcagcgccgagctctcgccgtccagttggatgtccgtggcatggtacccaatctatcacatccctgctcatgtcaacctcaagggtacctctgcctgcttcctcacttaccatgccatctcatcggtcttccaagacaacatagatagcgggccggagcacgacgacggcgagatcgcggcgctgtcgccgttcgggctggcgacgtacaagatgcagggtgatttgtggaggaggccagggtcatcggaccccaggaggctgtctgagctccattgggcggcgtcctcctggctgaagcaagtcggcgcgcaccatcctgacttcaccttcttcacgacgtctcaccgtcgatgacacgacagcgacaccctgttgattccgcgtgtgtttcggttggattttgtatgtgcaccggaacacgtcaagatatgacaccaagaacttcatgtaggatttgatagaacggcatgcaccggagttttcttctttctgaatttgcaggaagatacagttacttgttgcatcgatcggattaggtgtcagattgcatgctctgtt

SEQ ID NO: 281 - DNA, 788 bp, Hordeum vulgare
tctgcatctcctcttctggttccagcttccttcaacaccttcgtccagaaactctcgcagacatggcgcgcaccatcggcctggccatggactactcgccgtccagcaaggccgcgacgaggtgggtggtcgagaacctggtgaaggccggcgaccggatcatcctcatccacgtcctccccaagggagcagacgccagccacaaggggctctggaagagcaccggttcaccgctgatccctctgctggagttcatggagatgaacgtgcaggcgaggtacggggtcaaccccgacaaggacgtgctggagatcctgcaagctgagtccaagtccaagcaggtggaaatactggcaaaaatatattggggtgatgcaagggagaaactttgtgaggcagtagatgatctcaaggtggactctgttgtgcttggctgcaggggcttagggccgttgaaaagggcactccttggaagcgtcagcaattatgtcgtcaacaatgcaacctgccccgtcacagtggtgcgcggaccaaatggatcacttgcttgaagatgtcacttatggattgatgggctagtttgtgtgttcattggtccgtcagcataggtgcaaatcgtgctatttaagactatagtgatatttttcctttttggattcctggctatccttgtagtgcaaattcagtgtgttttcctcagttatctctttagttatactatatttctgttgtttcttacatgctatttgtaaaaaagaagtgcctacagacttgttcagtggtgcatt

SEQ ID NO: 282 - DNA, 1443 bp, Hordeum vulgare
cccacaaaccctagcatcccctcgcccgagacagccatggcggagcacgacctgacggcgagcgtggcggcgtggatggacccccatctggtcctgcccgtgctggagttcctccaggagcgcggggtctacgccgacgaggaaatcctgcggggcaagatccgcctcctcggcggcaccaacatggtcgactacgccatggacatccacaagtcgctccacggcaccgacgaagtccccgccgacatggtcgcccgccgctccgaggtcgtcgagcggctcagggccctccaggaggcggtcgcgcccatcgtcgccttcctctccagcccgcagctcgtgcaggagctccacgccgacaagcagtacaacctccacatgctccaggagcgccaccacatcggcccggaccagatcgaggcgctctaccagtacgccaagttccagtatgagtgcgggatgtactccgatgccgctgatttcctgtcccagtaccgtgctctctgcaccaacagcgagaggagcctcagcgccctctggggcaagcttgcggcggagatactgatgcagaactgggatgtcgcgcaggaggagctcaacaggctcaaggagatgattgactccagcagcttcacctcgtcgcctgtcaaccagctccacagcaggatatggctgatgcactggagcctcttcatcttcttcaaccatgagaatggaaggaacgggatcatcgacctcttcttccaggacaggtacctgaatgctatccagaccaacgctccccatcttctgaggtaccttgctgctgcagttgttgtcaataagaggagaaggaacatgcttaaggagctcatcaaggtcatccagcaggagcagaacatctacaaggatcccatcatcgaattcctggagtgcctgtatgtcaagtatgattttgatggcgctcagcagaagctcgtcgagtgcgagcaggttatactgaatgatcctttcctgggcaagcgtgtcgaagagaggaatggcatcgctgttcctctgagagacgagttccttgaaaatgctcgcctgttcatctttgagacttactgccgtatacatcgctgcattgatattggtgtgcttgcggagaagatgaacatgacctatgatgaagctgagttgtggataatgaacatggtcaagagttccaagctagatgccaagattgattcagtgacgggaactctcatcatgacgaccaaccgtgttgatgtccatgagcagattattgagagcatgaagaacctcaacgccaggacctacatgctagcaaagagtgtcgtggatccagggcatgcagcagcacagcaggctgctcggtgagaccaacagatgatctgcagctttgaggcggtaaaaaatattttgggaacttcgttgttaggcagtgacttcgttgcttag

SEQ ID NO: 283 - DNA, 599 bp, Hordeum vulgare
ccacgctctaccatcaaacttcaaaaatgtcgggttggttcgggggcaagacgacggacgccaaggccgacgaggccgccaagacggggccgtccgtccaggaccgcgccatcgaggcgaaagaccagaccatcagcttcatcggcgagaaaagcgaggccgtcacgaaggcggcctccgacaccgccgatgcggccatgaagatggggggagacgccatggggaaggtctccgagacggggcaggccatcacggaccgcgccatcgagagcaaagaccagacgttcggcttcatcggcgagaaggccgaggctgccaagaagatggccgtcgacaccggcgacgccgccaagcagaagtccgccgaggccgcgaagtgtgtcgaggagaccgcggcgcagttcaccggggaacccgccgcccccaaggagcccgccggcaacatgttccagcaggctggcgggcaggtgatgggcgccgctacgggcgccagggacgccgtcatgaacacgctcgggatgggaggagacaaagccgacgccggcagcgccaaatgaagaccgttgccctcatttcgtttcgttattcgtgttgcttag

SEQ ID NO: 284 - DNA, 415 bp, Hordeum vulgare
aaacacacaggaagctcctagccaacaccaatcaaagcctccatccaatcccaaagaaacctcaaagatgtcttgctgcggaggaaactgcggttgtggcagtgcctgcaagtgcggcaacggctgcggcggctgcaacatgtaccccgaggtagaggccgccggcgccaccctcctcgtcgccgtcaccgccacccacaaggcgagctgcggcgcgatggagatggcggcggagaacggcggctgcggctgcacccagtgcaagtgcggcaccagctgcggctgctcctgctgcagctgctagatcatcaatcatggattcactgtctgcatcatatctataatctacctatccgtctaccaccatgaaacgctacctgatcaagggtctttgtatgtaagcacctgcctgtag

SEQ ID NO: 285 - DNA, 885 bp, Hordeum vulgare
tccacggcgaaaggcatcccggcggcgatggcggcggccgcggcaaggtccggatcccggcgcttgttctccatatccgccctggtgcctccgaagccgccaacccctcccccgaaggcagaccccttcgccagcctcttcatccccgggttaagcaagcgaacaacaactgatggacttagggaagcttttgcaaagtctggtgaagttgtgcatgcatcatctgtaaaaagttcaaggtggtatatgatcagtgcaaaccgttcaggtcctttgacagtgcgtaaagaataccgcaaagtgcttccttctttcataaggccatctgcatcttactccacaaaagcctcagaaaaaagaccaaaacaggagagaacagacttgacgactgttgaagatccctttaatgcccctacctacaatatacctgagaagccagtgacatttgtcgagggggcctcttacagtgttgtaatacttgctgggcttggagttgctgcattggctggatatgctgttctcaaagagcttatatttgaaccaaaagagtacaagatttttgggaaagctctagcaagagttcagagtgatagtcaggttacagccaaaattggttaccctataactggttatggtacggaatccagaaaccgtgcagctcggcagcgcatccaaaacagggtttggacagatgaggatggtgttgaacatgtggaggttgcctttcatatccgggggccacatggagctggaaaggtgtttgcagagatgttcaaagataacgccgacaggacatggaagttcacgtttcttctcgtcgagattacgtcaccgcgacccgcacaaatcatgttagaatcttacctaccagcataaggatgctaa

SEQ ID NO: 286 - DNA, 1325 bp, Hordeum vulgare
cggcgatgaggtgcctgccgttcctgcacggggacgccaaggcgggggacgacgacgaccagcgcacggggcccagcaccgccgccatgtcggcctccgtgcgctccttcagcaccaccacctccacggagcgcgacaacccgcgctccggctccgacctcaactccatcaacgtctccgacatgagcgccgagtccatacgccggacgcagtaccccagcttcaccgaccgccctgccaacctccgggtcttctcattctccgagctcaaggccgccacccgcaacttcagccgctccctcatggtcggcgagggcggcttcggctgcgtctacagaggggtcatcaagggctccgacgaccccacccagcgtgtcgagatcgccgtcaagcagctcaatcgcaagggggttcaggggcagaaggaatggttaacagaaatgaacgtgcttgggattgttgagcacccaaaccttgtcaaactaataggttactgtgcggacgacgatgagcgagggatgcagcggcttctggtatacgaatacatgcccaacggaagcgtggatgaccacttggcaagtaggtcaacttcaactctgtcatggccaatgagattgaaagtggctctcgatgctgcccgcgggctcaagtatctgcacgaagagatggactttcaggttattttccgggacttgaaaacatctaacattctattagatgagaactggaatgcaaaattatcggacttcggattggctaggcatggaccacaggaagggctatcccatgtctccacagcggttgttggaactctaggatacgccgcgccggagtacatgcaaaccggacgcctgactgcaaaaagcgacatatggggctatggtgtgctcctctacgagctcatcaccggccggcgtcccattgacaggaaccgcccaaagagcgagcagaagctcctggactgggtgaaaccgtacatctccgatgtcaaacggttccccatcatcgtcgacccgcggctcgagggccactacaacctcaagtccatgacaaagctggccggtgtggcgaaccgctgcctcctccggatgcccaagtcgcgcccaaagatgagcgaggtgtatgagatggtgcagaagatcgtcgacagcgtcgagatcggcccgccggagcctcccctgcactaccacggctcggtctccgggccgggcgcgaagcggaccaagaaagggtcattgaagaggaggctccaggagttcaagttcgggtgccgccagatcgtgtggcggggctggaaaccagagatcataaagacctgctgatga

SEQ ID NO: 287 - DNA, 1204 bp, Hordeum vulgare
ccgccatgtcgtccgccgcgccggcgccggcgccggaagagcagccgccgcgcccggtgcgcttcggcatcatgggctgcgcatccatcgcgcgcaagctcgcgcgggcgatgctgctggccgcgcccgccgccgccgtggccgcggtcggcagccgctcggaggccaaggcgcggctcttcgccgccgacaacggcctccccgcggacactcgtcttcacggctcctacgaggcgctcctcgacgacccggccgtcgacgccgtctacctgccgctccccaccagcctccacgtgcagtgggccaccgccgccgccgcgcggggcaagcacgtgctcctcgagaagcccaccgcgctctgcgccgccgacctcgacgccatcctcgccgcctgcgacgccagcggcgtccagttcatggactccaccatgtggatgcaccacccccgcaccgccaagatgcgcgacctcctccccgccgacgtcggcgacgtcagactcataaacagtctgttcagcttccgagcaaacgaagatttcctccagaatgacatcagggtaaagccagacctcgacgccctgggcgcactcggcgatgccgggtggtactgcatccgcgcgatcctgtgggccgtcgactacgagctcccgaagaacgtgatcgcgctccctgaccccgtcaagaaccaagccggcgtgctcatcgcctgtggggcgacgctctactgggccgacgggaagatggccaccttccactgctctttcctcaccaacctcaccatggacctgaccgtggtcggcacggacggcacgctccacgtcaccgacttcgtgatcccgtacgaggagaagtccggcccgttcagcgtggcgtccaaatcaaactttgccgagctccacaccggatgggctccgcagccgagcaagcacgttgtcatgacagacctgccgcaggaggccctgatggtcaaggagttctgcaggctggtgcagggcatcagagacgccggcgccaagcctgagaacaagtggccggccatcaccaggaagacgcaggttgtgatggacgccgtgaaggcttccattgacaatggattcaaatcggtcgacgtcgccagctgaataaaacacatcaccggtcattccggtattatgttcttccagaacatggcgtaatttgctcagactgtacttctacgcggcat

SEQ ID NO: 288 - DNA, 222 bp, Hordeum vulgare
aggaagatgcaggccaagaagctgacgctgctgcagacggtggctgccgcgggagtcttctcagccgtctcctgctggtacggcttcatgttcgggagggagtctgcgcggcgcgagctcggtggcatcatcgacgacctccgcagcggctccacgacaggctctgccgcgtcctcctccgactcccacgctcaccccaaaccatagtgtgatcctgcttaa

SEQ ID NO: 289 - DNA, 1562 bp, Brachypodium distachyon
aacacactcttcgacacgctcgctctcgctctcccccccggcccctgctgcccgcccccgtagacagccggcggatctaagcaaatggatttcaaggggttctgggagtccagattcgggggaaagaaggaggcggagcagaatgggcacgccaacggggaggccaacgggagcgtcaagaagaggaccgccgatttggccatctacgagcagttcgagcagcaggccaggcagccggagatgcgcgccgcggcgatccgtgatgggaatgctgatgtcatccagaagcctctcctaccttcatttgagtcagctgaaatgcgtaatctagcagagacactgttgcgggatattattcgagggaatccggatgtgaaatgggaaagtattaaaggactagagaatgcaaaacgacttctaaaagaggcagttgtcatgcccataaagtacccaaaatacttcactggtcttctgtcaccgtggaaagggatcttactctttggccccccaggaacagggaagacaatgctggcaaaagcagtcgctactgagtgcaacactacattcttcaacatttcagcttcatcaattgtcagcaaatggcgtggagattctgagaagttagtcaaagttctttttgagcttgccagacaccatgctccatccacgatatttcttgatgaaattgatgctattattagtcaacgcggcgaagctcgtagtgagcatgaagctagtcgacgcttgaagactgagctacttattcagatggatggcttgacaaagacaaatgacttagtatttgtacttgcggcaacaaatctaccatgggaactggatgcagctatgctccgtcgacttgagaagcggattcttgtgccgcttcctgaagctgaagcaaggcatgccatgtttgaggaacttttgccggcgatgacctcaaatctagaggtcccatacgatcttttagtagaaaagactgaagggtactccggttcagatattcgtcttgtgtgcaaagaagctgctatgcagccattaagacgtatcatgtcagttcttgaagccagtgatgagttggtgccagaggaagaactacctgaggttggccctctcagacctgatgacgttgaacttgctttgaggaatacaagaccatcagctcatctccaagcacaccgttacgaaaagtttaaccaggactatgggagccaaattcttcgttgagagcaagttcaggtcatgtttacatgaaaatctgcctggcgaaacatgtgctttacaggaaacaactgagaattttcatcttcgaagaatgtagaagattttttccctttatttctgtaggtttgcaagtggattcatctggatggtgcatttgaacatgctactggaacagagatatcttgacccagaacaatcaagttggctgtgtttatgcctttttttttatcattctaccgagaaggcccccaagcagaatgcaaacattgttactgcagtttatatcaagtttatatctgtaactacattaaattgactgaaggtgtgaagcaagtcac

SEQ ID NO: 290 - DNA, 719 bp, Brachypodium distachyon
ctaccaggtcccaactcaagtctgaaccttcatcctgcctcctccagcaggacgaaagaatggcagctgcaaccgcaaggcagctgctggtccacaggatcctttgctcctgctcttcagggacgcttccaaagcgcaccttcaacagccatggcagctctgcttcgagctgcttcaaagcaggaaagaccgagaagctccccgccagtttcaggttaagggtggccctgaatcctccgcgtgccgtgctggggaagggcggcattgtgcctgacgacggggtcagcctcggcaccgtcaagctgcctgccaacatcgatttggctcggttcgaggccttgctatttcagtggggaaacagcctgtgccaaggcgcaaccttgccactaccggtgcctctcaaggtggacaaagtcgacggtgggatcaggttagcatttgttgaaatcgacgacggcgcggtgcagctgctggcctacatcgattgcctggtgtctccagcgaccgatggctccgggtttgtgttccgggcgatcaggaacggtcccatgaaggacatggaaccacctggggaaccgaggatcatgagaagcctccttgaggcgcttcaaaaatctattcaaattgctcgagtttgacaagtttgctcaacttcctccaagttgacaaacctgttcaagttgcacaagtttgacagtcaagaagatgatgcagcatag

SEQ ID NO: 291 - DNA, 5930 bp, Brachypodium distachyon
gggtttgatttggaggcggggcggcgaggatggcggcgcctgggaggagggcggacttctcctcctcgtcggcgcagtcgcccgggccctcgccggcgggggcgtcgggcgggggcggaggagggaggaggctgctcaggacgcagacggtggggggaaacatgggggagtccatctttgacagcgaggtggtcccgtcctcgctcgtcgagatcgcgcccatcctccgtgtcgccaacgaggtcgaggccggcaacccgcgcgtcgcctacctctgtcgtttctacgctttcgagaaggctcaccggctcgaccccaactccagcggccgtggtgtccgccagttcaagaccgcgctcctccagaggctcgaaagggagaacgatcccacattgaaggggagggtgcaccagagcgatgcgcgagagatgcagcgcttctaccgcgagtactacaagaagtacatccacgctcttcagagtgccgccgacaaggctgaccgcgctctgctcacgaaagcgtatcagactgcagctgtcttgttcgaggtcttgaaagcggtcaatgtgtcgcagtctgttgaagtcgatcaagcgattctggacacacacaacaagattgaggagaagaaaaagctctatgttccttacaatattctgccactcgatcctgaaagtacagatgaagctattatgcaatatccagagattcgagcttctgtttacgctctccggaatactagaggccttccatggcccaaggagaacgaaaagaagcctgacgagaagaagactgataaagatcttcttgattggcttcaggcaatgtttgggtttcagaaagataatgtatccaatcaaagggaacatctgatactgttacttgcaaatgtacatataaggcagataccaaagcctgaccaacaatctaagttggatgaccgggcactggatgctgtaatgaagaggctgtttaagaattataagatgtggtgcaagtacctcggccgcaaaagcagtttatggttgccaactatccaacaggaagtacagcagcgcaagcttctctatatgggtctctaccttctaatttggggtgaggcggctaacttgagattcatgccagagtgtctttgctacatctaccatcatatggcttttgaactctatggcatgttggctggaaatgtgagcccaatgactggtgaaaatgttaaaccagcttatggtggtgatgaagaagcattcttgatgaaaattgtgactcctatatacaaagttatagaggaggaagctcacaggagcaagactatgaaatcaaaacactcacactggaggaactatgatgatctaaatgagtacttctggaaagttgactgttttcggctaggatggcccatgagagctgatgcagattttttcaaaacacccaaattggcttatcctaatcgtctgaatggagaggaaagatctgctggcagtgtccattggatgggaaagattaattttgttgagatacgttcattttggcacatattccgtagcttcgatagaatgtggatcttcttgatactatccttgcaggctatggttattattgcttggaatggtggcacaccgagtgatatctttgatagtggagtacttcagcaggttttgagcatatttataactgctgctgttttgaagttgggtcaagcaaccctggacattgtatttggctggaaagcaagaacaaacatgtcatttgcaagaaaactgagatacgtcttgaagttagtgtcagctgctgcttgggttgtgattttacctgtgacttatgcatatacctggacgaaccctacgggtcttgcaagaacaatcaaagattggcttggcaatggtcatcagccatcattgtacattttggctgtggttgtatatttggcaccaaacatgctcgcgtctgggttatttcttttcccgtgtatccgaaggtatctcgagagttcaaattttaaggtcataacattcatgatgtggtggtctcagcctcgagtatttgttggcagaggaatgcatgaaggcccattttccctcttcaagtataccatgttctgggttctccttttagcaatgaaattgacagtgagcttctatattgagatcaagcctctggtacaaccaactaaagatataatgggaacaccaattcggacattccagtggcatgagtttttccctcatgcaaataataacattggtgttgtcattgcactttgggctccaataattcttgtctatttcatggacacccaaatttggtatgcagttttttctacgttggttggtggtatctatggggcttgtcgtcggcttggtgagatacggacattaggaatgttgagatatcgctttgaatctttgcctgatgccttcaataaatggttgattccttctgatgcacacaagaggaaaggtttccgtgctgccttttccactaaaccttcgaagtcacctagtgatgaacaagagatagagaaaagagctgcaagatttgctcaaatgtggaacctaattatcacaagttttcgtgaagaagacctcatagataacagagagatggacttgctacttgttccatactgcaaagatcgtgaattgaatatattccaatggccacctttcctacttgctagcaagattccaatagcgctggatatggcagctgacagtggaggaaaagatcgcgatctgaacaagagaatggggtcggatccttatttttcctatgctatcagagaatgctatgcttccttcaaaaacatcataaataccttagtgtctggacaacgtgagaaagttgttatgcaagagatttttacagttgttgagaaacatataaacgagggaactctgataaaggatttgcacatgagaaatcttccagccttgagcaagaagctcattgaactacttgagttactgcaaacaaataaggaagaagacaagggtcaagtcgttattttgttccaagatatgcttgaggtggtcacaagggatataatggaggatcaagagctcggcggagtactggattcaatacacggtggaaattctagaaaacacgaaggaatgacaccgcttgatcagcaagatcaattgtttactaaagctattaagttccccgtggtggaatcaaatgcatggactgaaaagataaagaggcttcagcttctgctcactgtgaaagagtctgctatggatgtccctacgaacctcgatgctagaaggagaatttctttctttgcaaattctcttttcatggagatgccaaatgctccagaagtgcggaatatgttgcccttctcggttttgactccttattacaaggaagatgttttgttttcattgcataatctagaagagccaaatgaggatggagtttccatacttttctacctgcaaaaaatttacccagatgagtggaaaaatttcctcgaaagggtggatcgcaagactgaggaggaggtccgcgaggatgaaacattggaagacgagcttcgtctttgggcatcatataggggacaaacattgacaagaactgtaagagggatgatgtactaccggaaagctttggagcttcagggttttcttgatatggccaaagatgatgatcttatgaaaggctaccgagcaactgagctgatgtctgaggagtctccactaatgacacaatgcaaagcgatagctgacatgaagtttacttatgttgtctcatgccagcagtacggtatccaaaaacgttctaatgatccttgtgcgcatgacattttgagactaatgacaacatatccatctttgcgggttgcctacattgatgaagttgaagcacctagccaagacagaatcaaaaagattgacaaagtttactactcagttttagtgaaggcttctgttacgaaacccaatgatcctggacagagtcttgatcaggtcatctacaagataaaacttcccggaaatgctattctaggtgaaggaaagccagaaaatcagaaccacgcaataattttcactcgaggagaatgtctccaaactatagatatgaatcaggagcattatatggaggaggctttgaaaatgagaaatctattgcaagagtttctggagaaacatgatggtgtgagatatccatcgatacttggagtaagagagcatatatttactggcagtgtttcatcccttgcatggttcatgtcaaatcaggagaccagttttgtcactattggacagcgtgtgctggccaatccattgagggttcggttccactatggtcatcctgatatatttgatcgtcttttccaccttacaaggggtggtataagtaaagcatctaagattatcaatcttagtgaggacatatttgcaggattcaattctacattacgtggaggcaatgtcacccatcatgaatacatgcaagttggcaaaggaagagatgtgggtcttaatcaaatttcactatttgaggcaaagatagcaaatggtaatggtgaacagactctgagccgtgacatatatcgattggggcaccgttttgattttttcagaatgttgtcatgttactatacaacaattgggttctatttcagtacaatgattacagtttggactgtgtatgttttcctttatgggcgtttgtatcttgtcctcagtggacttgacgaagcacttgctactggaaagaggtttgtgcataattcgcctctccaagttgctcttgcatcagagtcttttgttcaacttggatttttgatggcattgcccatgatgatggaaattggtctagagagaggattcagaacggcattaagtgattttgtacttatgcaacttcagttggcatctgttttctttacattttcacttgggaccaaaactcactattatggaaggacgctactccatggaggagctgaatatagagcaactggacgtggatttgtggtgttccatgccaaattcgctgagaactaccgactctattctcgcagccattttgtgaagggtattgagctgatgattctgctcgttgtatatgaaatctttggacagtcgtacagaggagctatcacttacattttcatcactgtttccatgtggtttatggtgggcacgtggctctttgcaccgttcttgttcaatccttctggatttgagtggcagaagattgtggatgactggactgattggaataagtggatccataaccgtggaggtattggtgtggcaccagagaagagctgggaatcatggtgggacaaagagcagggccctcttcggcactctgggaagcgtggcactgttgttgaaatactgcttgcattacgcttctttatctaccaatatgggcttgtgtatcatttgaatataaccaaacagtataacaaaagtgtgctggtttatggcatctcatgggttgtgattttctccatgttgcttgttatgaagaccgtgtcagtcggcaggaggagattcagcgcggagttccagctcgtcttccggttgatgaagggcctcatattcatatcattcatctccacaatcgtaatcttaatagcactcgctcacatgacagttcttgacatcttcgtctgcatcctggctttcatgccaacaggatggggtttgcttctgattgcccaagcgatcaaacctgttgttgagatggtcgggctctggggatcagtgaaggccctcgcacggggctatgagatcctgatggggctcctcctgttcacacccattgcattcctcgcatggttcccgttcgtctccgagttccaaaccaggatgctcttcaaccaggccttcagcagaggtctgcagatctcccgtatccttggtggccacaagaaggaccgagccacccggaacaaggagtagtaa

SEQ ID NO: 292 - DNA, 1540 bp, Brachypodium distachyon
ttgcctttcccaccactgcccccgtccctcctccataaatggaagcgctcgctatcggatccgtgccttcccggccaggcctaccacctccgacccgccactcccatcttcggcgccccaaaaccctactcgcctccgcgcccccttgccgcatcatcgccgccgttcccatggacggcgccgccagccggagccccgcgcctctccgctgcactcccgccgagacggatgctgtggcgacgagctcggacgagacggcggccacggctgaagccacccagcagggcgacggaatcccagtggaagatgccgccgcaagcatcgagggggtcgacgggataaagattcggaggcgcccggtgacggggccgtcggtgcactacgttggcccgtttcagttccgcctcgagaacgaggggaacacgcctcgcaacatcctcgagaagattgtgtggaataaggacgttgaggtttggcagatgaaggagagaaggcccttgtacatgctgaaaggtccgctggacaatgcgcctccagcgagggactttgtagcggccctgaaagcatcatatgatcggactgctctgcctgctctgattgcagaggtcaagaaggcttcaccaagccggggggttctgagggagaattttgatccggtcgtgatcgctcaaacatacgagataaatggagcagcatgcttaagtgttcttacagatgcaaaatacttccagggaagttttgacaacttggaggctatacgcaatgctggagtacagtgtcctcttctgtgtaaagagttcatcattgatgcctggcaactttactatgcacgttccaagggagcagatgctgttcttctgattgctgctgtcttaccagatcgtgatatcaagtatatgctgaaaatatgtaaaatacttggcatggctgctttagttgaggtgcatgatgaaagggaaatggaccgtgttctagggatagatggtattcagctcatcggcatcaataaccgtaatcttgagacttttgaagttgatatctcgaataccaaaaatcttctggagggtgaacgaggacaacttatagcccagaagggaataattgttgtaggggaatctggactgttcacacctgaccatatttcatttgttcagaatgctggggtcaaagcagttctcgttggggagtccctcatcaagcaggaggatccagggaaagcaatagctgggctttttggtaaagatatctcacatgcgagtgctgtgtaaataacgaaatgccggatcgctcatattttgtataggaaaatggagcgtttcactttttttggagagtttcggccggcaattttgtttacttggccattatctgccttcttctttcgctgccttttcttgcaccttttttttttaaaacaaactagtaatacagtacaagagatgcaacacaaaagatgtgatccaataagttggatgtagcttttaggagctcgagttcatttaccttcatagatctgctcttggcacttgttagccagaat

SEQ ID NO: 293 - DNA, 2260 bp, Brachypodium distachyon
caaagcagcagctcgctcgcgcgcgcttgagcccaccccagcccacgcgcaaggcatggccgcagcggcgtcgcacaagcccctggccgcgatcaccgccgacgacctcgccgcggcgggggccgcggaggccgccgcgctccactcggcggtaagtcgagcgctcggtgccaaaggcagcggcgggcccgccgcggtgtgggcggagctctcgcgggccgcgctccgcccggacgtcccgttcgccgtccaccggatgctctactacggctgctacgccgggttcccgtcccccgcaccgcccgcctggatgcccgaccccgaggaggcggccctgaccaatgttggccgcgtcctggaggcgcgggggagggagctcatcggcgaagcgtacaaggacccgatcactagcttccgtgacttccacaaattctccaacgagaaccccgaggcatattggaagatgatctttgaagagatgggtattacattcagcgtggagccatcttgtatcttgcgtgacaacgatgcgtacccaggtggcgaatggttgccgggggctgtgctgaatgcggctgcaaattgcctgaatgctaaacctggaaggcgttccagcgatgttgccattgtgtggagggatgaggggaaggattccgagcccctcaacgttgtgactcttgaggaattgaggaaaaaagtctgccttgtggcaaatgcgctcgattcactggatctgacaaagggatctgctattgcaattgacatgcctatgaatgtgaatgccgttattatctaccttgcgatcgtgttagcaggctatgttgttgtctctattgcagacagctttgctgcacctgcaatatcgacgaggctaaagatatcggaagcaaaagcaattttcacccaggattgtatccttcgtgatgacaaggaactgccattgtatagtagagttctggaggccaaggcccctatggctattgtgatccctgcaaggggatccacaccgataaaaggactccgtactgatgacctttcatggcaagatttccttggaagggctgatcgtaccaaggctgatatttataccacagttgagcaacctgtctatgaatttagcaatatactattttcatcagggaccacaggggagccaaaggcgattccatggacacatttgacccctcttaaggcagctgctgatggatggtgtcacatggatattcggaaaggtgatgttgttgcttggcctacaaaccttggttggatgatgggtccctggcttgtctatgcttcgctactgaatggagcttccatggcactgtataatggttccccgaatagttcaggttttgcgaagtttgtacaggatgctaaggtgacaatgcttggagtggtacccagcattgttcgtacgtggaaaaatacagattgtactgcaggatttgattggtcaaccatcagatgctttagctcaactggggaggcatctagtgtggatgattatttgtggctgatgggaagagcttgttacaagccggtaattgagtactgtggtggcacagaaattggtggcggatttattactggatgcctgctgcaacctcaagcattgtctgcattcagtacacctgccatgggttgtaacctgtttattcttgacagtaacgggaaacccttaccacaggattctgctggcattggagaacttgcgcttgatccaacattatttggatcatcaacgatgctgctaaatgctgatcatcatgaggtgtacttcagcgggatgccagaatggaatgcgaaagtcctccggaggcatggggatgaatttgagcgtactgcagacggatattatagggctcatggacgtgcagatgacacaatgaaccttggtggtattaaggttagttccatcgaaattgagaggatctgcaacagggtgaatgatgacattctggaaacagcagctattggggttccacctgtagggggtggccccgaacaattaaccatagccgttgtattcaaagaccaaagaccacaagctgaagatttgaatcaactgaaactaatgttcaactctgctctgaagaaattgaaccctcttttcaaggtttcatcagtcatcgtggtgtcatcacttcctcgaaccgcctcgaataaggtcatgaggagagtcctacgaaaagagctcaccctggcaaaacattctaaaatctagatagttaggaagaattttccgcaccttttaaagtaa

SEQ ID NO: 294 - DNA, 558 bp, Setaria italica
cggttggagatttgattgtctcttctgctgcaatggctgccgctgctccgtctctggcgccggccccgtcccctgccccggcggcgaaggtcgcatcgcccaaggccggcgacaggaaggtggtgccggtgacggcggccgacgtggtggaactggcggagaagcacgtgctggcggtcgacgacagctccgtcgaccgggccgtcatcgccaagatcctccgcagctccaaatacagagtgaccactgttgaatcggcgacgagggcgctggagctgctcgcgctcggcttgctgcccgacgtgaacatgatcatcacggactactggatgcccgggatgaccgggtacgagctcctcaagcacgtcaaggagtcgtccaagctcaaggagatcccggtggtgatcatgtcgtcggagaacgtgcccaaccggatcacccggtgcctggaggagggcgccgaggacttcctcctcaagcccgtccgcccctccgacgtgtcccggctctgcagccggatcagataatcgcccggcatctgcagggactgattactct

SEQ ID NO: 295 - DNA, 902 bp, Setaria italica
cgtacggcagatccatcacccttccatggtgaccacggcggcggcgcccgacggagacgtcgaccagcggcagcagatcctgccggcggaagccagcaaaaagaagggccgccgcggccgacgcgagatgcgccggatcgaggacaccaccagccgccaggtcaccttctccaagcgccggagcggcctcctcaagaaggcgtacgagctctccgtcctgtgcgacgccgaggtcgcgctcatcgtcttctccccgcgcggccgcctctaccagttcgcctccgccaccgacttgcagaatacaattgatcgctacctgaaccacaccaaaggcacacctacaaatgaaaaagttcacgaaccaggtgtagagaagtggaaatatgaggttacaacgttgggacagaagatagacgcaattgaggcatacaggaggaagctgcttggggagagccttggatcttgttcaattcaggagctacaggaactggagttgcagttggagaagagcctaagcagcatcaggcaaaggaagcaaaagaagctgatggatcagattttggagttgagggagaaggagcagaaactctcgaaggagaatgcgatgctccgcgatcagtgtaaagccctgcctctgctggagctcaatgataagggccgtgtggatgctgctgctggtggcggcgaagaagaagaggatgatgtgcgcatggaggacgtggagacggagttggccatcggaatcggaaggagacggccgagtaatactagtgttggcgacgatgcatgatgatgactagcaatcaatcaactgatcgatgatgatgtgtttatatatgcatgtatgcccccgtgctcttggattaagatatacatacgtgttgataaagaagaggacacgg

SEQ ID NO: 296 - DNA, 997 bp, Setaria italica
gtctctcctcgtctgatctgcccaccaagccctagcaccaggtggatcggtgatcgacgaacagcagccatgagtaagttgcaaaccgaggtcctcaaggatgccatctcccaggtcgtctcagaggccagggagaagaacaggaagttcacagagaccgtcgagctccagatcggcctcaagaactacgacccgcaaaaggacaagcgtttcagtggctccgtgaagctgccccacatccctcgccccaagatgaaggtctgcatgcttggcgatgcgcaacacgtggaggaggctgagaagatcagtcttgattacatggatgttgaagctcttaaaaagatgaacaagaacaagaagcttgtcaagaagcttgccaagaagtaccatgctttcttagcctccgaggctattatcaagcagattcctcgtctccttggtcctggtctcaacaaggcaggcaagttcccaactttggttactcaccaggagtctctggaatcaaaagtgaatgagacgaaagctacagtcaagttccagctgaagaaggttctttgcatgggtgtggctgtgggcaacctgtcgatggaggagaagcagatccagcaaaacatccagatgagcgtcaacttcctggtttcgttgctgaagaagaattggcagaacgtgaggtgcctgtacatcaagagcaccatggggaagccaaacagagtgttctaagtcgctgtgtccattgcgtctaaaaccagtgccgtagacagtattgaagtttgttatgggatatatgtttatgcagtaatctgtcgtactgttatgcaaattttgtgtctgaagtgaacaagagtggttttgtgagcactaatgtttttcaccttgcacttgagctgacgggacaattgtgcatctggtgacgcggctgctagtggcgtaggtcttgtgaatggccgtgtacgctatgctgggttcatgctgctcggtgcatgtctgaatgttgatc

SEQ ID NO: 297 - DNA, 716 bp, Setaria italica
aagagcaagaagacacgactgcagctctgtacgtgcgctagctagctgttttacaagcaacgccagcgcgctccacaccccagcgaccgaccgagacgatgtatccggcgaagcccagcgtggcggcggcgtcggcgccggtgaccggcgtccccatgggcggcccgcctgtcgccgccggcaacgccaccagccagtggtcctcggggctcttcgactgcttcgacgactgcgggctgtgctgcctgacgtgctggtgcccgtgcatcacgttcgggcgcgtcgccgagatcgtggaccggggcgcgacgtcgtgcgggatgagcggggcgatgtacacgctgctggccttagtggcctacctcacggggttcaggtgccagtggatctactcctgcacctaccgctccaagatgcgcgcccagttcggcctccccgagaccccatgctgcgactgctgcgtccacttcttctgcgagcgttgcgcactctgccagcagtacaaggagctcaaggcccgcggcttcgaccccgacatcggatgggacctcaacgcccagcgcggcgccggcgccggacaagccatgtacgcgccggcggcacaggggatggggcgctgatggccgccgcatcccgttcgcaattgtgtttgcagggtaaattacatgtgcaactgcgtttgtttaatttcgtatggtgacggacaagggttatag

SEQ ID NO: 298 - DNA, 1732 bp, Setaria italica
aagttactggtggtggtggtagcgctgcgcggctggggaggaggaggaggaggaggatcggcggcggaggagggcggagatgaggatgaagacgctggcgtgctgccggcggcggccgcaggacttcagcatcgacatggaccaggagcccgacagggtgatgacatataatggcctcgagacctgcattatcaatagttccgcctatgacgatgatagtggcattagtgcaacaacaggtggagatggctgtgttaccactgattcccttgatgatgaagtctcaagttgctctagtaaagatgcctctggttcttccttctcttcccactgccttagcaagcaggaggagcatttatttgatgagttgggtacacccgttgcagttcatctacttcctttcaaagggaagaagccaatcacatataccttgagtgcttcagatattgaaaacatgaaggaaaaatttgcaaagctattgctcggtgatgatacttcaggaggagctaggggcgtttgcaccgctctggccttgtccaatggcataatcaatctctcggcaactgtttttggggaactttggaagctggaaccattgtgtgaagagaaaaaaatcaggtggaaaaaagaaatggactggttgctgtctcctacaacttatatggtggagctggttccgacgaagcaaagtggggctgatggatgcacatttgagattatgactccaaaggcccgttcagatgttcatgtgaaccttcctgctcttcagaagcttgatgcgatgctcattgaagtgatggactcaatgatagatacagagttctggtatgaggagagcggtagcagagctgatgggcgggggaaacttactggtccaaggaagagtaaaaagtggtggctcccatctcctcgtgtccctgagcaagggctatctcaatttcagcgaaaaaggcttgtttttcaggctaagcttgttcatcagatcctcaaagctgcaaaatccatcaatgaacaagtcctattccatatgcctattcctgcagctgttatggatgccctcccaaagtctgggagagctagcttgggcgaagatttgtatcaagctataaccacggagtatattcctatagaggaaatctttgtttctctcagtttgaaaactgagcatagtgtgctcgagactataaaccggttggagggtgcagtgtttgcttggaaccaaaggattttagaggaaaagagcaagaaatccccagcacggcattcctggaacttcataaaggatagttcgtcagaacttgacaagatgtcggtgtgcatcgaaagggtcgacactcttgtgcagctcctgaaatccagattccccaacctgcctccaacctttatagatgttctaaaggtccagtacaacgtggacgtggggcacgccatcgtagaggcctactctagggctcttgttggggtagcattcagcatactgtcccgggtggcggagatactgctggaggacgacctgatcaagaagcccaacacccccatggcgacgctcaagttcgacctctcctccgacgtgtaccttgcgggcatcacggagacgccgccgggccacatccggcggtccctcatggaccagatcagcatggtcgacgggcgcttcgacgccgtcgccaagaagaaaggggtgaagcagctgaggtggtgaggaccgagagtcggctgttgtgaatcttag

SEQ ID NO: 299 - DNA, 1018 bp, Setaria italica
attggaattgcttctctcctcctccaccgttcttgttcttcttcttcttcttcgccggcgtgccgcggccatggctaggaagtgctctagctgtggcaataatggccacaactccaggacctgcggcgggaacggcagggtcatgatggagaacggcggcggcggagtgaggctgttcggggtgcagctgcatgtggggtcgtcttctcccatgaagaagtgcttcagcatggagtgcctgtcgtccgcggcgccggcggcgtactacgcggccgctctcgccgccagcagctcctcgccgtccgtgtcgtcgtcgtcgtcgcttgtctcggtggaggagaccgccgagaaggtcaccaacgggtacctttcggacgggctcatgggcagggcgcaggagaggaagaagggggttccatggaccgaggatgagcaccggagattcctggcaggcctggagaagctcgggaagggcgactggcgaggcatctcccggcacttcgtcacgacgcggacgccgacgcaggtggccagccacgcccagaagtacttcctccggcagagcagcctcacgcacaagaagcggaggtccagcctcttcgacgtcgtcgagaacgcagacagggcggcgacgagcgcgaacgagcgtctgagacagagacgcggcggcgggctcggcgccggacacggagctcccggctctgtctctcggcatcatcagccggccggcgaagcccgagcgcatcctgcctccgagcctttcgtccctgctgccacggtgctcatcggcgatgagcagcagcagcgggagcacgtcgccgagcgggccgcaccgaggcagaagcacccttcgtccctgacgctgtccaagcctcatcatgcgagcctccagcaggcggcgccggacctggagctgaagatctcgacgaccgccgactaccaggccggttcgtcgccgaggacgccgttcttcgggaccatcagggtcacgtaaccggaaaggcgatcgacgatgtag

SEQ ID NO: 300 - DNA, 1594 bp, Setaria italica
gtcgacccaccatggctgcggccaaagtcgacccaccatggctgcggccatggcgtcgctcccgctgcacctgctcctcctcctcccactccttgccgtcgtctcattcctgtggctccaccgtgcggtgtcgcgccggcgagggcgaggcggcggcgcgcggctgcccccgtcgccgtgggcgctcccggtgatcggccacctgcaccacctcgcgggcgcgcttccgcaccgcgccatgcgcaacctcgcggcgcgccacggcgagctcatgctgctccgcctcggcggtctccccgtcgtcgtcgcctcctccgcggacgccgcccgggaggtgatgcgggcgcgcgacctcgacttcgcgacgcgccccgtgacgcggatggtgcggctggtcatccccgacggcgccgagggcatcatcttcgcgccctacggcggcgggtggaggcagacccgcaggatctgcaccgtcgagctgctcagcgcccgccgcgtccagtccttcaggcccgtccgcgaggaggaggccggccggctcctccgcgccgtggcgtcggcggcgccgccggcgtgggcggtgaacctgagcgagctgctgtccgtgtacgcggccgactcctcggtgcgcgccatcatcgggagccggttcaaggaccgggacacgttcctggccatgctggagcgcgggctcaagctgttcgccaagttgagcttgccggacctcttcccgtcgtcacgcctcgccatgctcgtcagccgaatgcccggccggatgaagcagcaccggcaggagacggttgtgttcatggacgccttggtccgggaccacgaggagagcagagcagctgacgacggcgacggcaaggaggacctgctcgacgtgctcctgaggatccagacggaaggcgatctgccggtgccactcaccactgacaacatcaagtcagtggtcggagacatgttcgccggaggcagcgagacggcggcgacggcgctgcaatggatcatggccgagctcatgaggaacccgagagtgatgcagaaggcgcaagacgaggtccgacgagcacttgccggacggcaaacagtaacagaggatgaccttggcgatctccattacatgcgcctagtgatcaaggaggctcttcggctgcatccacccctgccacttctacttccacgagagtgccggaactcatgccaggtgctaggattcgacgtgccagcaggcaccatagtgttcgtgaacgcgtgggccatcgccagggaccccaaatactgggacaagccggaggaatttgtgcccgaaagatttgaggatggcaagattgatttcaaggggacggacttcgagttcataccgttcggggcgggacggaggatgtgcccgggaatggcgtttgggctcgtgcatctggagcttgcactcgctggcctcctttaccattttgattgggagctcccgcttgggatggaggctgcagatctggacatgacggaggaaatgggagtcacggcccggcggcttcaagacctccggcttgttccagtagttcgagtgcctgtgccggtggaatagatgtaggaattc

SEQ ID NO: 301 - DNA, 958 bp, Setaria italica
gctaataacaatggcctctgcctcttgccttagcctgttggtgctggtggctctggcctcgtcggcgtcggcgcagctgtcgtcgacgttctacgacaggtcgtgccccagggctctggccaccatcaagagcgcggtgaatgccgcggtgtcgcaggaggcgcgcatgggcgcctccctgctcaggctgcacttccacgactgctttgtccaaggttgtgacgcatccgttctgctggcggggaacgagcagaacgatcctccgaatctaactctgagaggcttcaacgtcatcgccaacatcaaggcgcaggtggaggccatctgcaagcagaccgtctcctgcgccgacatcctcgccgtcgccgcccgcgactccgtcgtagcgctgggagggccgtcttggacagttccgctggggagaagggactcgctgaaagctgcaagcacgagcatggtgttgcagaacctcatcccgcctacatctagcctcactcaactgattcaagggtacgggaacttgggcctcaacccaaccgacttggttgctctctcaggtgcgcacacgatcggccaggcgcactgcccgagctaccaagaccacatctacaacgacaccaacatcaaccaggcgttcgcggcgtcgctcaaggccaactgccccgcgacaggcggctccaacgtcatggcaccgctggacacgacgacgcccaacgcgttcgacaacgcctacttcaagaacctgcagtcgcagaaggggctcctgcactccgaccaggagctcttcaacggcggcagcaccgacaacacggtccgcaacttcgcgtccaacccgtcggcgttcagcagcgccttcgtgactgccatgatcaagatgggcaacatcagccctctgacggggacgcaaggccagatcaggaccacatgctccgcggcgaacccgtaataacgtacaagc

SEQ ID NO: 302 - DNA, 643 bp, Setaria italica
cgtaggcagaggagaaacagggcagggctgttgactcgcatgcctctgagaattcggggcagaggcatcgcgtagctgctatcggaaaagctcgaggtgaagacatggattggttgcctggagagctgtgcctcaagatcttccagctcctggatcaccagtccctcgcctccgctccccaagtttgcaggaaatggagggcgttgacctccgacgatgagctgtggcgcaagctgttcagcgacaggtggggagcggacgccggggcgttctacgcgccggagggctccaagtcctggaaggacgtcttcgtcgtgcaggaccggtgcgaccgatacggactgggtgtcaggatcatcagggaagggaaagactactacctgatctaccagggcgagatccagaggtacctgggctcgcgccaggacacggacggtgacggcggcggcaaggacgcgccgcggcaggacgctgaggacgagcagcggcagatatccaaccggatcctgttcttcctgggggatctagaggcagcctgtgcggacgccaaacgtgtcaaggcgtgaacgtgacctcctctgcggctgcgcccctgtccaggattccaggagcacattgccgcctgtatgatgcatagctcgtg

SEQ ID NO: 303 - DNA, 3755 bp, Setaria italica
gttccatgtacggcatttgtgcacaacgaagtgatgggaaggtcttaaactgtgcgaatgcaaccaaagctgttaagccagacacattgttttcgtcaaggatccaaagtttgtgcccaacaatcactggcaatgtctgttgcaccgcagatcagtttgatacgttacaccaacaagttcaacaggctgtgccatttcttgttggatgcccagcatgcttgaggaatttcctgaatctcttctgtgagatgtcttgttctccaaaccaaagcctattcattaatgtgacttcagtaaagcagataaatagcactatgactgttgatggcatagattactatgtaactactaactatggtgaagagctatacaactcatgcaaggatgttaagtttggaactctgaacacacgtgcaatggattttctcggtggaggtgcgaaaacttacaaagagtggttggcatttattgggcggcaagcgaaccctaatgagcctgggtcaccttatttgataacattccgatcagattttagtgattcatctggtgtgaagcctctaaattctacaatttattcttgtggagacccatctttgggttgttcatgcggtgattgcccttcttcttctgtttgcacgggatccttgctgccacagctgaacactgatacctcctgttcagttaaaatgggttctttaaaggccaaatgcttagacttctcactagtggttatctaccttgcgttattatgcgcttttctgctgtggggtttgttacacagagcacgaggaagaactgcctcctccttgcagacaaaaccattgaagaattcagatgataagtcagactcaaaccaaaatggcaagagtcctcataactcggttcaggtgtctgaagctgcatcctctactgtcaaaccatcatatccctctattgttcaaacttacatgtcaattttctttaggaagcatggaatttttgttgctagacaccctctccttgtgttatgtgtatcattgcttatccctctcctcttatgtattggtctccttcgcttcaaggttgaaacccaaccagaaaagctttgggttagccctggaagtcgagccgctgatgagaagaactattttgacagccatcttgcaccattttataggattgagcagcttgtgttagccacttctgcatccagtgggtctgcagctccttcaatagtaaatgacaacaatatgaaattactattccagattcagaaaaaggttgatgatctgcgtgcaagttattccgggtcaacagtagcccttgctgacatttgcttaaagccactcagtacagactgtgctactcaaagtgttttgcagtatttccagctggatcctaaaaagtatgatgattcaggaatagaccatgctaaattttgttttcagcattacacttctgaagagacatgtttgagcacttttcagtcacctattgatccaagtacaattttaggtggtttttcaggaaacaattttactgaggcttctgcatttgtaataacttatcctgtgaacaacaaagttgagacaacaggacaagagaacgggaaggccgtggcttgggaacgggcatttattaatcttgttaaggaggaaatacttccgatggtattagcacagaacctgacattgtccttttcgtccgagagctctatccaagatgaattaaacagagaaagtacagctgatgctattacaatagtgattagctatattgtgatgtttgcatatatatcattcacacttggagaccggccttctcgttggttgtcattatttgtttcatcaaaggtactgcttggcttgtctggggtcgtcctggtgatgctttcagttttaggttcaatgggattctttagtgctattggagtgaagtctacccttattattatggaagtgattccttttcttgtgctggctgtcggtgtcgataacatgtgtatccttgtgcatgctgtcaaacgccaaccagatcagtcaaacttggaagagcggataagtgaagcactggtggaagttggaccatccattacattagccagttttgctgaagtactagcctttgctgtgagtgcaattaatccaatgcctgcgaccagagtgttttccatgtttgccgcactggcggtctttatggatttccttctccaagtgacagcttttgtagcccttattgtatttgactttaggagagcacaggatggcaggattgattgtgtcccttgtgcgagaatcgcgtcaagtccagctgccggtgatggtggtgatggacagaggctccacttgcttgctagatatatgagggatatccatggaccaattctcagttaccgggcagtgaagttcgttgtaatcactgtgtttgtaggattggcattttcaagcatagctttgtctactagactgcaaccaggattggagcagcaaattgttctgccacgaaattcctatttacaggactattttgatgaccttgcaaagtacatgaaagttggtccaccattatactttgttgtgaaagacttcaattacagctctgcatcggtgcatacgaatcagatatgttcgatcaaccagtgtaattcaaattctcttttgaatgagatagcaagacaatcgttatcccctgagactagttacattgctaaacctgctgcttcatggcttgatgacttcctaatttggatgtctcctgaagcattcggatgctgtaggaaatttgtgaatggaagttactgccctccagatgatcagcctccatgctgccaactcgatcaggattcaggcacttgcagcgcaagcagaacctgcagtaactgcacaacgtgcttcctacactcagacttggataatggacgtccatccacaacccaattcaaagataaactcccatggtttcttgatgcacttccatcgagtgattgttctaaagggggaaaaggagcttattcaacaagtttggacctcaatggttatgaaagtggcatcatacaagcatcagcattccgaacataccatactccccttaataagcagacggactatgttaactcaatgagagctgctcgggacttcagttctaaaatgtccaaagatttacagatggaaattttcccatattctgtgttctatatattctttgagcaatatctgggtgtgtggaagacagctatcatgaacatatgtgtttgccttggtactatatttgtcgtttgcttcctagtcaccagcagtttatgggcttcagcaatcattttaattgtgctggcaatgatagtcttggatttgatgggagtgatggccatccttggtattcagctcaatgcgatttctgttgtaaaccttgttatgtcaataggaattgctgttgagttctgtgttcatatcacgcatgcctttatgattggcactggggacagagaaactcgtgcaaggcaggctctatccacgatgggtgcttctgtattcagtggaatcactttgaccaagcttgtgggagttattgtcctgcgttttgcaaaatctgaagtttttgtggtctattacttccaaatgtacttggctcttgtcctcattgggttcctgcatgggcttatcttcctaccggtcgttctgagcttatgtggccctcctccaaaatcggtgaagccagttgaacaaaatcaaccaccttcagcttcaaccgagcggacttgatgggattttattcgataa

SEQ ID NO: 304 - DNA, 2777 bp, Setaria italica
tggagtggttggtgctcagggtggcctgccaataggggcaacatcgagagatggggggcggaggaggagtgttccgtttctcctccatggcctcctcctctcctcggctcctcgtcctgctgctcgcgtggctttgctgcgcggcggcgcaggcgcagacgacgacggacacgctgcggcagggggcgtcgctgtcggggtcggcgacgctggtgtccttgccggatagggtgttcgaggtgggcttcttcccgccggaccccaagcagccctcccgcctctacctcggcgtctggtaccgcggcatcacgccgcggaccgtcgtctgggtcgccaaccgcgccgcgccggccgtctcgggggcgccgtcgctcgcgctcacggacgccggcgagctccaggtcctcgacggggcggcggcggtgaacgggacggccgcgccgcggctgctctggtcctccaacacctcgcgcgccgcgccgcgcgggggatactacgccaccatccaggactccggcagcctccaggtgcgcagcgacgacgggccgctgtgggacagcttctggcacccgacggacaccatcctgtccgggatgcagatcgccgtgcaggcgccggggccgcccgggagggccggcaatgagcggatgctgttcacgtcgtgggccagcgagacggaccccgcgccggggcgctacgcgctcggcctcgacccgaacggctccggccaggcatacatctggagagacggcaatgacatctactggagatcaggacaatggactggggtgaactttattggcattccatggaggccactctatctgagtgggtggacactgtcaaatgatcgagacttaggcctacactacacatacactgcaacaaacacatctttacagaggtttgttgttctgccaaatggcacagacatctgctatatggttaaaaagtcgtcacaagagtgggagactgtctggttacaaccatcaaacgcgtgcgaatactatgctgcttgtggtccaaatgctaaatgtaccgtggggcaagatggcaaggctcaatgcacctgcctgaaaggttttcaaccgaagttgtgggaccagtggaatgcaggaaattggactgaaggttgcacgaggaacccacttctcggttgccaggtcaaccaatctggagatggatttcttcctatgggaaacataaaatggcctgatttctcatattggatgtctacggtggcggatgagaaagggtgcaaaagttcctgcctgaacaactgctcatgtggtgcctatgtttacacaactacaacagggtgtctagtctggggtgacaaactaattgacatccatgagttgcagactgggtcatataccctaaacctgaagcttcctgcttctgagttacgggtacatcacgcagtttggcacatagccatgataatatctgccgtggttcttgttgttttggtagcttgccttgttctgtggtggtggcgtggcagaaatattaaagatgcagtgcacagaagttggaggtcaaggcattcatctacctggtcccagcagaatagttcaatgctggatatctcacagtccattcgttttgatgatgatgtggaggatggaaaaagccatgaactcaaagtatattccctggaccgcatgaaagctgctacatgtaattttagtgactccaacaagcttggagaaggaggatttggtcctgtctatatgggaacattacctgggggagaagaagtagctgtgaagaggctctgtaggaattcaggtcaaggccttgaagaattcaagaatgaggtcatacttattgcaaagttgcagcaccgtaatcttgtaagactactaggatgctgcatacagagagaagagaagatcctggtgtacgagtacatgcctaacaaaagtctagatgcattcctgttcaatcctgaaaagcaagagcttctagattggagtaaacggtttgatataattgaaggcattgctagagggcttctatatctccaccgggactcaaggctacgtgttgttcaccgtgatctcaaagccagcaacatcctcctggatgcagatatgaaccccaagatatcagattttgggatggcaaggatatttggcggggaccaaaaccaattcaatacgaaccgtgtcgtcggcacatttggctacatgtctcctgaatacgcgatggaaggcattttctcagtgaagtccgacgtctacagcttcggagtcctgatcttggagatcatcacaggaaagagggctgtgagcttccactatcatcaggactccttgaatatcgcaggatacgcatggcgacaatggaacgaagacaaggctgcggagctgatcgatccactgataagagcatcgtgctcacttcggcaagtcttgagatgcgtccacattgcgctgctatgcgtgcaagatcacgccgatgagcgtcccgacatccctactgtaattatcatgttgagcagtgactcgagcctcccgaacccaaggccgcccaccctgatgctccgtggccgtgagattgagtcgaccaagtcaagcgaaaacgaacagagccactccattggcactgtgtcaatgacacagctgcatggaagatagaatagcaacaaatactgaagtcatgacacctctgttttttcaccttttctgctgtcgataatatgccatttggtgtagattagcttttctccctccccccctccccccatggtggctgttatacggtgactc

SEQ ID NO: 305 - DNA, 5810 bp, Setaria italica
aaaaggcctactagacaaccaccaccgactggaacccgaaccgcgcctcgctgccgcggggaggccgcgcgatggacggcgcgtcgtggcccgcgcggtggcctccgccggcgccccccgctgcgccggtgccgccgctgccgaaccagatggacggcgtcactctgcgccacctgctccgccccttcgccgcgcaggaggccgcggcgggtggccgagcgacggcagcgccagagcagctgatcacaaatccgtcgacctcgcagtccggccagcctgcgagagctgggccgagcaacgagttgcttgctcaagttccggggagctattccactttcagccttgcgccggaccttaaggcattgttcgataagccaaacgcgagcaatgctgctgatgtcattgatcttactcggacacccccgctctgtagtgctgccactctgcccaagtattcaagacatggattgacagctagcagtagcaatgagcagtcctctgctggagcactttttctgaataaaagtgctaatggaatgggtacttttactggggaagtttcaactaatgaaggaatggcaaatggtggcatacagttacaggattcaagtctgcatgcactgcagaaattgccattcagatcgacgactcatcatcatcctacgctgcttggtgatcgtatccatgtcacctgtctgaacgtcggtggagagttctttgtgggtgaagctgggctctttggaatcatttgcctgtgtcatcggttgagaatgtctgtagctaaattctgcgagcatgcgggtggaactccagaaaaagctggtgaaattgtccacgtggagaatggcatgactattgcgcaatggttcaaattctgcataggagtggcgggatctattgctaataccaggtgggattggccagactgggcatgtatgaaaagttctccagaagaatacatgttgaaaagtcttgcttcaagaaacagtggtacaggaaaagtaaggttgttaggtggatatggaaaaatcaatggacttataaacaacccagcttattccagcgatctgtacatcgaaggtggaggatgcactaatgttgataagcaaatgaatgggtcagttggaacaaattacaaaaagagcgttgatgtgcacgaaggtttaacaaaggactctgctttactacagaattccacaacaatgaatgtagggctcgctagaaaccatacggttcatgcattaaacctgaaccctcttagcacacctagtggaagcctacactctgaagcaagcatgggaagacattacaaaggaaatcacttggcacataattatggaatctgtttggagaaaaaccttgatgcctcttttcgtaatcctgagccacgttcctcaagagttgtgaaccatgatagtagggcgtgcagacctgatttcccccacaaaatattgcaggacactttgtgcaacacttcaaacactgaattaaagcttggacaatcttcttatcatcaatctatgaccactctatttccattggtacagtcggcggtcattgaatttcagaaacctcaatcacacaggccattgataaatcagaatccttgcccaaagcaagcaacaaaggtcaacaacaatctagctgaacctgaacataatggaccatccattagtactggaaataagcaaccacttctagttactaatggaacaaaacattctgaagttggtgagcttacggatgatacatccaagaattcatttatctcattatttctttcacaccttgagagaaatagtacacctgaacccattgacgatattctcaacagtaacgagcattatcatcctaaggccctggatgtcgcatgtggttctgatcatccaaaaaatgccagtagacatattgagacaagggttaatgataatcatccaaagttggccccaaccattattcatatgaaaaggagatcagaaggcatttctctttcagcatcttacagtggatataatcctcaagatgcatcccatggtaatagtcaggaacatttgattcatggggattgcccatcacatttgctgcctaatcaacctaatgctggaatctcaaattgtgcaagagtttcatgtcctgcaaattgcatgtgctgcactcacatgggtaataaatcccatcaggttgcacatggtgagattggggttccctgtttctatgataaaatggccaggggccatggtacttttgagcgagttgatgacttatgcacacatagaagtttgagagcttttgccaaaatcagttgtgagaatgggaaatcttgctgttcttctcaggagtttctacctagcttttgccaaaatgatccgtcaacactcggaaaatcgatttgtggatgctgttgcaaaattcaggaaggtgtttccaagcttggttttatacctggtcacttgtgcagaactcgtttttctagtgatcttggtccagttgtatcaagtaagcctacccttgaagggcaagatgaactttgtgcctgctccagttttatgcaaagatcgtcattatgttctcgagaacacatcttgcagtcttgttatgcatgccccattgatggattgcactacagaaattccatgggacatgcaacagacagcttgacaaaacactctctgtttgatggacgtagcacaaaagaacaaggtccttgttgcaatggaagatgttgctattctgtagtcccaaaatgtttgtctagttgtgcctttacaaagcactgtgatgtcagagttgatcaaattggtcatactgcacctataagcaaacaccagatgcaaatgcctaccagatgctgcacattagaggagaatgagaaattaacatgccaatgcttaagcaatagaattgcaggaagaagcttatctcaagcttctcgttgtaaagatgtctctgataaagtaatgaaccagccttctattgcaataacggagaggctgaagaatatatccgaagcttcagtggctgatgatagttcgtccaaagccgtaacagagagaaagggcccttctaaagattctgtagtatctaaaggacaaccaaagtttggtttctcttctggatcatcaagcattgtggttacaaagtttcagatgtcacctgaagttcacaaagtgtcatctactgctaaacataggaaacataaaaatgtatgtgatgaaggatcaagaattgagaaatgttcagcatccagctatgtgcctgccagtagtacaggatgtgaggaagccctaaatagttttaccagatctcagttggctccatctcgagtgaagcgcaagggtaatcagatttctgtgggaagtagactagaggaaaaggacaatgaggagctttgttttgggctgccaaaaagaatgagaacattgaggtgctctagtaaaaattctgaatcagaagattgtactaggactagttcccagtcgtcccagaaggggggttgtcaaccacaaaatgaggttaactcattttcttgcagggtgttgagaaccaagcgaaaacatcctaccatgcaactgaataagcctgtgaaacagcttcatagccagaacaaggttttcaaaggtgatggcaagctaccagataccaagggaaatttttttggtggattagattcctttgatagaaaaaaacaagtagaggatacgactccgggtagaacaaaacatcaccaggaagggagtcgagcatttgtccgcaaactacctaaatatgtgtctctaaactgcattgttaatgaacctaacagtgaagatgcttgcagtgggagtgctggaattgattcaagtttaattgccacgggaatggcaaatgataaccgaaaatctcccaaaatcgttccactcagtctggttcttaaaaaggctaagagatgtcattctgttaaactctgtaagaccgaaagcacccacttgtatgaaaaaaagggctcagattgttctgtgaacagctcatcagattgttctgtagataagtgccccattgatgatgaaggttgcagtccacaagctgaatatgaaatgcagggttccaaaaggagtaggtattcatctaatggtttgaggtcacattttatggctcactgcaaaagaccatctggtgttcttggagaagatgatcctcttggtctaaaagatatggaaacaaatcgcctgtcaataacatcatcaagaagtaatgggaccaagaatcgaagagcaagtgtatcccttactaggattaagaggcataagaaatttgcaaacaaatcagcatgctattccagcagtggcaaagaaaatgctgtgctaacccatgaagaaaatgttaggagagacagtggaagactcagcttagatgctccatgctgcgtttgtggaatctcagacccagagccttgcaatcaatttatagagtgctgcaagtgctatatcaaagtgcaccaagcttgttatggtgttctaaaagttcctagaggtcaatggttctgtagaccctgcaagactaataccctgaacacagcctgtgtgttgtgtggttatggaggtggagctatgacaagggcactgaaaaccaagaatattctgaaaagtttgctcaaaagtttgatgactacagcaagatcagaaaaaaatgttgattcattaagaaacggaaggagtgagtgtacaagcctgcgaaatccagtagacagtgcacgtggggatagcattgcgaatggggagaacattaccagcaattcctggacctctattaatcacaattccagtttacttggaccacgaacaatgcagtgggttcacatggtctgtggactttggacacctggcacaaaatgcccaaatgccaccacgatgagtgcttttgatgtatcgggtgcttcacctgccaagagaaatactgcatgttcaatatgtggcagaactgggggctcatttattaagtgccgagatgtaaattgtttggtgctctttcatccttggtgtgcacatcagaggggtttgctgcaaagtgagcctgaaggtgagcgcaatgaaaatgttggcttttatgggcgatgcatcgatcatgctaatgatttttctagtcgcattaatcctaaggaatgcttgagaagcagcagctggacatgcgcacgtacagagggttttaaaggtcgaaagggagaaggctttcatggtagtagtcacaagaaatctgaagagtacagtggtgagttcagtgtttcccaagaacagataaatgcttggttacgcataaatggttcgaagcctagcgggagaggacagaaggaatacatccattataagcagttaaaaggatggaagcatttggtagtgtacaaatctggcatacatggacttggtctctacacatcagtgtttattccgcgtggctctatggttgtagagtatgtgggtgaaattgttgggcagcgggttgccgacaaaagagagatcgaataccagtctgggaaacgactacaatataagagtgcctgttatttctttaagattgacagggagcatattattgatgccacccgcaaaggtgggattgcaagatttgtaaaccattcatgccagccaaactgcgttgcgaaaataatctcggtcaggaatgagaagaaggtaatgttctttgcagaacgtcacataaacccaggggaggaaattacttacgattaccactttaaccgtgaagatgaaggccagaggatcccttgcttctgtagatcaagatactgcaggcgttacctcaattagtaagagctcaaa

SEQ ID NO: 306 - DNA, 1161 bp, Setaria italica
accctgctccgagtttagtttcatgttcatagtggtggtggtggggagcgcacgtattactcatcctgattatcccgggcagttggggagatgggttcctcgcaggagtccaccttctcgtcggcctcgggggctgcgcaagtgaatgcttccactctggacttgctcccagtctatgccaaggagcttactgctggcggcgctgctggtgcatttgcaaagactgcggtggcgccactggagagggtcaagatcttattacagacaagaactgaaggtttccagtcccttgggatcctccagtccttgaggaagctgtggcagtatgagggagtccgaggcttctacaaagggaacggtgcaagtgtgcttcggattgttccttacgcggcattgcattacatgacatacgagcagtataggtgctggatattgaacaattttgctccatcagtaggtacagggcccgtcgttgatcttttagctggctcagctgctggtgggactgcagttttgtgtacatacccattagacttggctaggaccaagctggcataccaggtttcaaatgtgggccaatctggcaatgctttgggaaattctggtcgacaacaaacatataacggtataaaagatgtcttcaagactgtttacaaggaaggaggtgcacgatctttatatcgtggagtaggcccaactctgattggtattcttccatacgctggcttaaaattttacatatatgaagatctgaaatctcgagttccagaagattacaagaaatctgttatactgaagctctcttgtggagctttagctggtctatttgggcaaaccctcacttatccgttggatgttgtccggaggcaaatgcaggttcaaagcaagctgcctcaaaattcaagtgatgggttccgtataagaggaactttccagggtctcttgctcatcattaggtgccaagggtggagacagctctttgctggcttgagccttaactatgtcaaggttgttccttccgtagcaatcggtttcacaacatatgacatgatgaagacattgctaggagttcctccccgagagagagtccatgcatcatcaggtgctaacaaatgaagcaatgtttgcctccttatgttagggccaatgaaattgagatag

SEQ ID NO: 307 - DNA, 897 bp, Setaria italica
tcccgggtgctccctccacaagcgtctgccacccacgatcaaaaacaaaaccatcgccgacccactctccttgctgccaaccaagcacgcacagccacagccataccacaccaagtcaaggagaaggtcatggccggcgtgagctcatccagcgtcgtcgggctcaagcccgccgcggcggtgccgcaggccgcctcggcggcgaagcgggtgcaggtcgcgcccaaggagcgggccgccgagggccggcgcgccgcgctgctcggcctggcggccgtcttcgccgtcaccgccaccaccgggtcggccaaggccgggatcatcgacgagtacctcgagaagagcaaggccaacaaggagctgaacgacaagaagaggcttgccaccagcggcgctaacttcgcgcgcgcctacaccgtggagttcggcagctgccagttcccctacaacttcaccggctgccaggacctcgccaagcagaagaaagtgccgttcatcagcgacgacctcgagatcgagtgcgagggcaaggagaagtacaagtgcggctccaacgttttctggaagtggtgattggccgcgaactggagggactgcttgcggtgtgacgtgatgcccaaactgcagggaaatttggatgtgtgtaatttaccgtcattatatttgtatcatctcatttatctgatcatgcacgaacctcttgcaccggggagagtgaaactgtagcatcctttcttgcttggttgacgactcttttcatcggctttatttaatgacttcttccaaacaaaacgaggatgagaagattaaggaagcttcagtctattatgaaactctacgacaaaccggtacatgagaaaaggaataaaaaacaagcccaagccagcatgtaaacaa

SEQ ID NO: 308 - DNA, 1363 bp, Setaria italica
acacaaacacacctcctgattggatcaattcggctttccgtctccggctgatccacggagccgcgctgccgagcggaatcgtcacctgatttggcgagactagcagatatttgtaaagtaatggctcatgatgaagctgtggctacccagaagactggaaacacagcatcgtctccaaaggatcaaccagctccttctccatatcctgattggtcaaccatgcaggcatactatggccacggtgtcttgccaccaacatattttgctccagcaatagctccaggtcatccaccgccatatatgtggggtcctcagcctctaatgccacacccttttgggacaccatatgctgcaatgtacccacatggtgcagcttacccacacccccttgtacccatggtatcaaatccattgagcgtggagcaaaccaagtctgcaaacagtaaggagaaaagttccagtaagaaacttaaagaaattgatcggactgcagtatctgctggcagcggtaacagtaaaagaacaatgtcatccagtgaagattacagtgcagagggctccagcgatgtaaacgatcagaaggtgaacaaaacttccaggaaacggagcttagttgatggacctggtgctgaaacatctgaagccgcaaagctggcaaatacagccatcctgccacatcactgctttccagctccagtaattaagcccagcgctacaaatgttgctaactcaagggcaatgggtgcaacgatatctccatctcctggtgtgattgttccgcctcatactggaggaccaactgacttatcaatcaaggatgagagggaactgaagcgagaaaagaggaagcaatcaaatagagaatctgctagacgatcaagactgagaaaacaggctgagacagaggagctggctacgcaagtggagtctcttacagcagaaaacacatcccttagatctgaaatcggcaggctaacagagagttcggacaaactaagattcgagaattccgctctgatggtgaagctgaaggacactgcagcgccgacccctgcagaaccatctccgaacaaagcagccacatcctcgtcctctcccggcgccgccgccgcggagaatttcctgtcgatgattgacagcacgaacgcgccgggcgtcagccggcacacggagcacggcgagcccaagctccggcagctcctcgactccaatccgtcgacagatgttgccgccgtaagctaacgctgatctacggtatctctttcccctggcacggagaggccggctaatacaacacatgcatgtggcctggggatgtcggcatgtcgccagctcatgctgctcaccataacatcatcagcgt

SEQ ID NO: 309 - DNA, 1053 bp, Setaria italica
gtggtgcccatggcgtcgtggctgctgctccccctcccctccttcccctggcttccccctccgccaccgcccggatcctcctccggcggccgcggcggagggggcgggggcggagacggcggcgactggaggcccaacgtcgtcgcggccttcgccggcgcgcaggtcggcagcgccctccgccgccgcttcgcgggcctcctccgctcgccggaggtgcgacatcttgaagccttgccgaacatgggtgacatttgttttgggggatcacactcatttgcaacacacccaattcttggcgcgttggggaatgtgttccctgcgtcatatgtttgcagcttcactctattcaatgggaatgggtcaggtgggacatacatcggcaaaggaaaggtgctgtctagacgacctcgcagaattgattcgaagaagaggctgtggactaatgttcttcttgctattaatgtcctggcttatatcgctcaggtagcatcacaaggaaagcttcttatgtggggagccaagatcaacagtctgattgatagaggacaattttggcgtttggcaacatcatctctccttcacgcaaatgtcactcaccttgctttcaattgtttctctttaaactcaattgggcccatggtggaaatgctaagtggtcctagaagatttattgctgtttatatcagttcagcgctggcaggttcactgatgagttatcgctgttgtgagtcacctgctgttggtgcgtcaggtgccatttttggattggttggcgcccatgcagtttatatgtggaggcatagaagttattttggcaatgcaagggaaagtttagagcatatcgggcgtgtggttgtcttgaatatgggtatgggcctcctttcaaggggaattgataactggggtcatctgggaggcttgctagggggagttgctgtggcatggttcctaggtccggcatggcaatatcagtatgtgggaaaggatggcagagtggttttcaaagacagggctccagtcctccggctaataaaggggtaggcttaggct

SEQ ID NO: 310 - DNA, 1350 bp, Setaria italica
ctcaagccttctagcctcacaggccactgcagccgcctagctcgagttgtatagctagtaatataatccggctgcgacatcatcagccatgggcgtgggcaaggtcctgaacgaggtgaagccgtacctgtacatggtgctcctgatggtggggttctccgggatgtacatcgtctccgtcgcctccctccggcgcggcatgagccacttcgtcctcgtcgtctaccgcaacttcgtcggcaccgtccttatgacccccttcgcgctcctcttcgagaggggagtgaggcccaagatgacgccgctcgtcttcgtcaaggtcatggggctcgccttgctggagcctgtgctggaccagaacatgtactacctgggcgcgaagctgacctccgcgggcttcgcctcggccctcgtcaacatgctcccggcggtcaccttcctcatggcgctcgtcctcaggatggagaagctcaggctgcggagcctccacagccaggccaagatcctcggcacggtctgcaccgtcgccggcgccgtactcatggtcctctaccacggccccgtcgtgccgttcccgtggtccagcggcggcgcccaccaccacgctgcggtggccgccggcacggcggcgagccaaagcggcggtgcctggctctacggcgtcgccatggtcatcggcagctgcgtgtgctgggccggcttcttcatcctccagtcgaacacgctgcagagctacccggcagagatgtcgctgacggcgctcatctgcggcgtgggcacggtgatgagcggcgcggtggcgctttttgcggagcgccgcgacatgagcgcctgggtcatcggcttcgacacccgcctcttcaccgtcgtctactccgggatcgtgtgctccggcgtggccttctacgtgcaggggctagtgacgcgggtgcgcggcccggtgttcgtgacggcgttccagcccctctgcatgatcttcaccaccatcatgggctccaccatactcaaagaagagaccaccttgggaagcgtggttggcgcggcgatcatagtggtggggctctactccctcatctggggcaagagcaaggaccacctcggcgacggcaagcccggcgccggggtcgtcaccgagctgcccctgacctcggctccgacccccaacggcaacggatacggcaagcagcacgcgctcggcggccatgtcgttaccgacgtcgagacgccggcggccaccgtgaccaagtgcgcttactgacaagccgatcgatcgagcttccatcacactgcacactagtgtagtgcatccaacatcagtggctgtacgtgtaatccaggagagatgatgcg

SEQ ID NO: 311 - DNA, 2642 bp, Setaria italica
gcttagagcttgtctctcctctcccttccatctgtctcttcttctcaatccccgccgctgctcctcaatcctgcccgtgcgccgcgggaaggttctggaagctctccggagatgaggaggggtagaggacatggaggaggaggggtatccgcgtccctcgccgcgctgctgtgctgcggctgcgtcatggtcctcgccggcgcagccgccgcgcaggggccccggcttccctccgcgtacaaaaccctaagaggtgatgctccacgagttgtggccaaaggcgggttctcaggagtgtttcccgactccagctcagatgcctactcctttgcgttgatcgccagcgcacccggtacaactctgtggtgtgacgtccagctgacaaaggatggcgttggagtctgccttcgggacataaacatgaataattgcaccaacgtcgcccacacttaccaggcgagaaagcggacctatgtcatcgatggcgtgcggaaaaatggatggtttgctctggactttaccaaggatgagcttcagtctgtttctttaacacaagcaatttggtctcgcacctacagattcgattctgtcggatattctatcctctctgtcacagacttgctgtccattgtcaagcagccttctgtttggttgaatgttcagcatgacaccttctacaaagaacatggtttgaacatgaggaactacatactttccatccaaaagcgtgtatctgtggattatatctcgtcacctgaacttggcttcctccaaaatatatctggaacagttcatcgcaaaacaaagcttgtgtttagctttcttgataaatccctcttggatcattctataaaccaaacatatggttcacttttgagtaacctaacgcttattaagtctattgcatctggcataatggtcccgaagacatacatttggccagtgacaaaggataactatctacagccgtccacatcaattgtcgccgaagcccacaatgcagggctggaaatatatgcctctgattttgcaaatgatagaattattccctataactacagttatgatccattggcagaatacctaaactttatcagcgatggtggcttctctgttgatggtgtattgtcagaacaccctattactgcatcagaggctattggttgcttcgctaatctgaattcaagtgagactggtcatggggaacccttagttatctcgcataatggtgctagtggagattatccagactgtacggacctggcctacaatagtgcaattaatgatggcgcagatgtcattgattgtcctgttcaagtgacaagtgatggagttcttatgtgcatgagttccattaacctgcttgataccacgaatgtgcagggaacaactttcagctctcttagttctgttgttccagaaattcaggctacagcaggaatcttcacattcaaccttacttgggatgacattaatagtagcaccttaaaacccaaaatatcttccccagtgagtgattattatcttgtaaggaacccaaggtacacaaatcaagggaagtttctgaacttatctgactttctagcaatcggaatggataaggatttgtctggtgtcatgatcatcattgagaatgctgcatttgtggcaaagtcattaggaattgacatagttgattctgtaaatgctgccttaagtgctgctggctatgataatcagactaccaagcaagttctgatccagtcgaaagatagtgctgttcttgtcaaactgaagcagcagaaaacaaaatgcaagcttgtgtacactctccccttaggcattggggatgcttctacttcctcattagaagccatgaagaagtttgctgatgctgtagttgttgataggaaatctgtttttaccttaagtcaagattttgcgatccgacagaacagtcttgtgaaagatctacagtcagcagggctagctgtgtacgcacaggtgttccggaatgagtttgtatcacaaccgttggacttctttgcagatgaaactgttgagatcaattactatgttcaatcatttaatctgtcaggcatcataactgacttcccgaagacagtcagaagatacaaaaaaaacacttgtacaggtttgggaaatgacatgcccaactacatgcagcgcattgacgttggctccctttaccagttacttcaacccttcaaagcccagccgccatctgtgccgccaatgccgacactgaatgcttcaagcgtggaggaggcaccgcttcctcctgttgcgtcaagaaatgggtccggtggttcctcaagtggcgccgaaactcctggtgcgcctcctgctgctgctcacaaggctactgtaagtactggcatgctgtttgtaatggttttcacagctcttctgatctgagcaaaccatgaggctgtatagtagtctgatctgagcaaaccttgaggctgtatgattcaggcaagcttcgaccgatgttttggtgctcccaagcacttgtttctgtagctgtttcagtatgtccctgcatattcgtttccacctgtataaattccccggtagaaatgttacactattcagcgagcattggtgttatacattgctaatggaagccacagttcctg

SEQ ID NO: 312 - DNA, 648 bp, Setaria italica
aaagtcgaccagatcaccatggacctgcccaacgggcgagacgacgccccgatcccgaatggaggcgtcggcgcggaggagacggtggggaggaggaagaaggtggagatggtgcgggaggccatccatggcctcctggaggagaagaggatggacggccaaggggagaaggagatgccggccaggcagcggcaggaggacgaacacctcctgtcctcgttgctcaccaagccagatgcactggagagagatccagattcggacacgttggaaacacactccctgcacccgagtcatcagcctgggagaagcgaaaccagcaaagaggtggagctagccgacatcgccaaggacctgaacaagatcaagaggcagaacactgtcacccacatcctgctcggcgccgtcatcgtcctgacggcggtgtggcaggttaacgaggtgtcgttcctcctctgggtgcagaggaaactgagcaacccgttcaagtccctcggggacatgatcaagggatccctcatgctgaaggggaggaagcccgtgatcgagtcgtcgccgctgccgccggtcggcgtccccgatgtcagccggcctgatctgccgtcgttcgtcatcggcagcactgaaggcaggtagtaagaattcaaa

SEQ ID NO: 313 - DNA, 2051 bp, Setaria italica
aaactcgagataacgtcaccattcttcctgcacccagctctgcttcgctcgtccatcccatccatccatgggcctcttcagctcgccggccaaggtctacaagccggcggccgacgtcgacctcggcccggacagcgacgagcactacatcagccccaacgtcaaagctcctcgcgtcgcagggctcctggtgaagctgctggcctgggtgctggagatgcccgtcgtcggctggatcgtgctctccgtcctcaaacgcgacaacctcgtctacaagctcgtctccgacgccgagatcccggagccgccgctgttcacggccacccacacctggcaagacatcccggagcagaacgtcaggctgacgaagcccggcctgccgccgccggagcgcgtccaggaggccgtcgtctgcctcactgctcccctgccggagccggcggcggcgctcgctgatccgtcgccggggttcaggcgctggacggtacgggacttccacgaggcctacagctcggggcagacgacccctgtcatggtggcgcggaggttcttggcggcggtgaaggagtgctccggcccggaggtgaacatggccttgttcatcagctgcgacgccgccgacgtgatgcggcaggccgaggactccacacgcagataccagcaaggggcgccgctgtcggccatggacggggtgctggtggcggtgaaggacgagctggactgcgcgccgtacccgaccacgggcgggacgcggtggctggcggcggcgcggcggccgtgcggcgcgggcgacgctgcgtgcgtggcgcagctgcgggcatgcggcgccgtcatggcggggaaggccaatatgcacgagctcggcgccgggaccagcggcatcaacccgcaccacggcgccaccaggaacccctactgcctcgccagggtctccggcggttcatcgggcggatccgccgccgcagtctgcgcagggctatgccccgtcgccctcggcgccgacggaggcgggtccgtgcgcatgccagcggcgctctgcggcgtcgtcggattcaagcccaccgccggcaggctctccaactccgggctgcttcctctgaactggacggtcggcatgccggggatcctggcagcaaccgtcgaggatgcgctcatcgcttatgcggccattgttgatcagtctaaaccaagtcatttacagcctgaactgaacctgccaatgctgacgtgtacgagatccatgcctaacatcaggctagccaaatacgcaaagtggtttgacgattgctccgaggacatcaggagcctctgcggcaaggccctccagatgctgcgaacgcagtacggttgggagtgtgtggacgtgactgtccctgagatcgaagagatgcgtctggcgcactacgtgacgatgggctccgagtgcacggcctccctcgctaaatacctcgacaacatgagcaagtctgagatcgggtgggacgtgcggatcggcctgagcgcctaccgatccttcagcagcagggactacctcaacgcgcagcgcctccggaaccgtcagatgttcttccacaacaagatcttcgagaccgccgacgcgatcgtgacgccgatgacaggggtgacggcgtacccgctgcaggaggacgcgctgggcaccggggagctcgactacatcaacggagctgcgctggtgcggtactcgatcgcgggcaacttcctggggctgccggcgatcaccgtgccggtggggtacgacacgggagggctccccgtcgggctgcagttcatcggcaggccatggtcggaggcgacgctgctgcacctcgcctacgccacgcaggaggcctgcgccagggagcaccgcaagcccaaggtgcactacgacctcctcctcagcaaagagtactagccttcagtcttccacagagttgggatcgacgatgatccaacaggtgtatggtgaaattggtcagtgatttatttgttgactggcagtacaaagaaaaaagaaactgtgggttgcgattatgagtgcataagaattcttt

SEQ ID NO: 314 - DNA, 1239 bp, Zea mays
cactcttcccaagttcccatcccagtccgtcagtcaagcgagcgaaatcgaatggctcccctcttcgccgcggcgtcccacgcgtccctcctccccctctcctccctcgaccgccccgccgccggccacctagtccgtggcaccctcaggccccacacctcgagcctccgcctgcgccgccccccgggggcaaccgggcgcggccgcgggcgtggccgagggggcatcccagacgagtggggcgagcgctcgccgccggacaaccccgagccccccgcgcagcccgatcctcccatcgacaaagacgagtggggccgcgacgactctgccgacggcaactcacgccctatcgtcgtcgacgagtggggcgagcccggggtgcctgagcccgagccgccctccgccgcggacccgcctagcccctccgcagacgacgactggggaaaggagccggaggcgccggcgccggcccctgctccggcggcggaggaggacgagcaggaggtgaagagggaggagctcaagcggtgcctggtggacacggtgtacggctccgacctcggcttccgggcgtccacggaggtcagaggtgaggtcgtcgagctagtcacccagctcgaggcggttaaccctactactgctcccgtcgagtcgccggatctcctcgacggcaactggatcctcatatatacagcatattctgagcttctgcctattctagctgctggggcaacacctttggtcaaagtaaagcagatatcccaagaaattgactccaaaatcatgacgatagtcaatgcttcgacccttacgactccattcgcttcattttcattcagcgcaaccgcctctttcgaggttcaaagcccatcaaggatagaggtccaatttaaggaggggagctttcagcctccgacaatatcatcatccgtggatctacctcaacaagttgatatatttgggcagaagatcagcctggggccagtccagcaggcactgaatccattgcagcaagcatttgctagcattgctgggtccatttctgggcagccacccctcaaggtaccaattcccggcaacaacagagctcgatcctggctcttgactacctacctggacaaagacttaaggatctcgagaggcgatggaggcttgtttattcttgccaaagaggggagccctttgctagatcaattgtaaatctgtaattggttgctaccggaaaggatatccagatag

SEQ ID NO: 315 - DNA, 1121 bp, Zea mays
cacggcacgcagatacatatagagagaggttagctatagcttgcacatctatttaactaactaactaactggctagctagctcgatcggcagagcaaagcgaaagcagcaagaagcaaagcaatggagaaccctgcgagtgtgctagttctaccagcgcagttcaccaaactcaccttccgaaacctgtacatccgccgggccgggccgggcagcagggagataaccgaggagggcaggtgcgacctggacaagagatacgtgagtgacttccccgtctacgacggccgcggccccgacgccagccttgtggcccgcgtgcaggggatcaccagcgaaatcgggaacgcgcaccaactgttcgtcgttgttttcgacaccgacaggctcaagggctccacgctcgtcaccaatggcgtgataacggccgggtctgacgagtgggcgatctacggcggaaccggggtgtttgccatggcgaggggcgtcataaggagaaggtatctcgccgacagggccggcgggaacactgatgagctcaacatggatgtcttctgccggccgtttggctcacagtcagagctgcaagataagatgcaggtgcaggggcagggctctagcgtcaccaagattggactatggggtggaccgggagggtcggcacaggacatcacggcggagcggccgccgcagcgtctgcacagcgtcaccgttcgtgctggcgtcgccgtcgactccatcgagttcacctatactgacagcgcttggcagaggcgcgccgctgggcgatggggtggactcgggggcaatgttcgaacgatcgaccttggcgacgccgaggatgtcagggaagtctcgggaacatacggcgcatttgaaggtgccactacgctgacctcgctcaggctcgtcaccagcagcagaacctggggcccctggggtgtcgagaacgggacgcgtttctccgtcacggcgcccatcggcagcagcatcgtgggattctatgcgcgggcgggaaccaggctcgtcgatgctatcggtgtttacttgcgtcagatttaattcgaataatagcaggggagctactgctagctacgtacctgctccatcctccattatcct

SEQ ID NO: 316 - DNA, 442 bp, Zea mays
tgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcaggcagccacaccaataagctagct

SEQ ID NO: 317 - DNA, 1059 bp, Zea mays
gcgaagcaagacacagataagagagtccactataaagcaacacagctgcgatcatagcgacaaaatatctcgccgttcccatggacatcgacctcttccccgacatcgaccttgacgccctcctcgcctccttctccggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcaggagggggaggcggaactgggcggggaggtcgatgggatcagcgtggaccagttcttcgacgcgctgtacgacggcgaggaggcgaaaggtgagcgggaggcgggggcaagcgcggatgtggactccggcagggacgatgtgctggaagtcgtgacgccagaggcggggacggtggaggtggatggcgatgatcccatcagcaagaagaagatgaggcaaatgaggaacagagattccgccatgaaatccagggagaggaagaagtcgtacataaaggacttggagacaaagagcaagcacttggaggcagagtgccgtcgcctcagctacgcacttcagtgctacgcagctgaaaacatggcactgcgccagagcttgctgaaggataggcctcttggtgctcccacagccacgcaggagtctgccgtactcacggaaaccctgccgctggtttccctgctttggctggtgagcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctat

SEQ ID NO: 318 - DNA, 540 bp, Zea mays
gaagcgaaacagcctctggccgctgcccgaccccgacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgtcgtgatcgtgatgtc

SEQ ID NO: 319 - DNA, 2536 bp, Zea mays
tggtaccaccacacacagccccctgtgccctcctgccgtccgtgacgtgacgcagccgagccgcgcgcgcgctccgggccggacgcctccgctcgaatcgatggacgccgaggccggcgtcgccggcgccgaccagcttccgcggaggcagtactacctgaatctactgcttttagcttaccagagctttggtgttgtttacggggacctgagcacatcgcctctctacgtgtataaaagtacgttctctggaaagctcagacactaccaagacgaggagacagtgttcggcgtactttcgctcatcttttggaccttcactctgattcctttgcttaagtatgtcatcatcgtcttgagtgctgatgataacggcgaaggtggaccattcgctctctattcgctcctttgcaggcatgcaaaactcagcttgctgccaaatcaacaagcagctgatgaggagctatcttcatactatagaaatgggttcgcgcctcgcaatggatcttcaccttggtcaagaaggtttctggagaagcacaaaaaaatgaggactctgtttcttctcatagttctctgtggcgctagcatggtgattggtgatggtgtccttaccccagcaatctcagtactctcgtctatgtctggattacacgttcgagctactggtctacatcatagttctgtagttctcctttcatgcattgtgttggttggtctatttgcattgcaacaccgaggtactcagaaggttgcattcatgtttgcaccaattgtcatcatctggctgctttccattggaggaattggtttatacaacattcttcattggaacccaaatgtatatcaagctctctctccatattatatggttaagttctttagaaagacaggtaaagatggatggattgctttaggagggatccttctttctatgacaggcagtgaggcaatgtttgctgaccttggtcactttacgagtgcatctgtcagggtggcttttattaccgtcatatacccatgccttatgctacaatatatgggtcatgctgcatttctgtcgaagaacacatttcacatgccgacaggtttttatgatactatcccagaaccagtgttttggcctgtctttgtggtggccacacttgctgctgttgttggtagccaagctgttatttcagcaacattctccattgtgaaacaatgccatgctttgggatgtttcccgcgagtgaaggttgtccacacatcgaggtggatctatgggcagatatatattccagaaataaattggattcttatggttctttgcgtcgctgtcactattgcatttcgtgatactactcttattggcaatgcctacggtattgcatgcatgactgttatgcttgttactacattcttgatggcattaatagtcatctttgtttggcaaaggaacataatattttccctagttttcctggttttctttggatccattgaagctgtatatctttcgtcatctctcatgaaggttcctcagggaggatgggtgcctcttgtgcttgcattcatattcatgtcagtcatgtacatctggcactatgggtcaaggaggaagtaccagtttgacctacagaacaaagtatcaatgagatccatcctatctctcggtccaagccttggcatagttcgggttcctggtgttggattgatttacacagagctggtcactggtgtaccctccatcttctcccattttgtcacgaatctccctgccttccatgaagttctagtctttctctgtgtgaagtcagtgccagtgccatatgtttcaccagatgagcgataccttgtgggtaggattggacctaaagaatatcggatgtaccgttgcattgttagatatggttacaaagatgtgcagagagatgatgacaattttgagaacatgttagttatgagcatcgcaaagtttattatgatggaagcagaagatgcttcttcagcaagttatgatatcgctaacgaaggaaggatggcggtcataacaaccactgatgcctctggcagcccattggccatgagggatttcgacggcctagctgactccatgtctacgaggagcagtaaatcagaaagccttcgaagtttgcaatcctcctacgagcaagaatccccgagtgtaaaccggcgccgccgtgtccgctttgaggtcccagaggaggatggcatgggtcagcaagtgaaagaagaactcacggcactagttgaagcgaaacatgctgggatcgcatacatcatggggcattcttatatcaaagccaggaggaactcaaatttcctgaagaagtttgctattgatgttggttactctttcctccggaagaactgcagaggcccatcagtcacgctgcacattccacacattagtctgatagaagtcggcatgatctactatgtttagcttaaggcccattgccgaagctcacatgtggatacccggtcggggcaatgcttgtgctgtctgcggattgtggtgtggaaggagttc

SEQ ID NO: 320 - DNA, 1874 bp, Zea mays
gcaggatgttcgggcgggacccctggggcgggcctctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcgcagcgatccggtccgctgccgaagcacaacggcgtcagctggaggggcaattcctgcatgaaggatggcctctccgacagcaccgtccgccggagcttggtcggaggcttctacgatgcgggggacgccatcaagttcaactaccccatggcctggtccatgaccatgctcagctggagtgtgatcgagtacagggcgaagtatgaggccatcggtgagctcgaccatatcaaggagctgatcaagtggggaacagactacatcctcaaaaccttcaattcatctgctgacacgatagacaggattgtcgctcaggtgggtgtaggtgacacctctaaaggcagcagtcagcctaatgaccattactgctggatgagaccagaggacatcgactacaaaaggccagtcaccgagtgtcactcttgctcagatctagcgtctgaaatggctgctgccctggctgcagcttccatagtgttcaaggacagcaaaacctactccgacaagctcgtcaaaggcgcaaaagccctgtacaagttcggaaggctgcagcgcgggcgatacagccccaatgggtctgaccaggcaatcttctacaattccaccagctactgggatgagtttgtgtggggtggtgcgtggatgtactttgccacagggaacaattcatacctcacggtcgccactgccccaggaatggcgaagcatgctggagcctactggtttggaagtccaaactatggagtatttacctgggatgacaaacttccaggagctcaggttcttctcagcaggttgcgactcttcctaagtccagggtacccttacgaagaaatactgaggacattccacaaccaaaccgacaatgttatgtgctcatatctgcctctattcaattcattcaacttcactaaaggaggactaatacaactcaaccatggaaggcctcagccacttcagtatgctgtcaacgcagctttccttgcttctctatacagcgactatcttgaagctgcagacacgcctgggtggtactgcggacctaacttctacaccacagaagtcctccgcaagtttgccaggtcacagctcgactacatccttggcaagaacccattgaagatgagctacgttgtgggtttcggaaacaagtacccgaagcgccctcatcacagaggcgcgtcgatacctcacaacggcgtcaagtatgggtgcaaaggaggttacaagtggagggacacaaagaaggcaaaccctaacatccttgtcggagcaatggtggctggccccgacaggcgcgatggctacaaagatgtccgcacgaactacaactacacggagcctactctcgcagcgaatgctggtctggttgcagcgctgatctctatatccgatatcaaaaccggacggttcggcatcgataagaacaccatcttctctgcgattcctccgatgttcccaacacccccgccgccgccatcagcatggaaaccatagtag

SEQ ID NO: 321 - DNA, 716 bp, Zea mays
tgtgtcttggtaaacatcggtctctccccatcccacctggcagttgccatctcgcaaagtcgcaataacttgtcttctcgaatcggctgcaaccccaccccagaccccaccgccgccgccgctagggttttggggtgaggatcgccgatgtcgacggctcccaggcgtcccttccgaggccgcggcgccatgccctcgggcaccggctacgtccgccgcggccccgccccaggctccgccgacgccgccaagcccctgcgcaagcccgtcttcaccaccgtcgaccagcttcgcccccagacacacggtcacactctcacagcccgcgtcattgccgtccgcaccgtcctcgacaagccctccacgcacctcggccgcacccgcgtcgccgagtgcctcgtcggagacagcaccggcaccgtcctcgtcaccgcccgcaacgaacaggttgaccttttgaagccagatacaacagtgatcttccgcaatgccaagattgatatgttcaagggcaccatgagactggcggtggacaagtggggccggattgaggtgactgattcttctgttttcaaggtgaatgaagacaacaacatgtcactggtggagtacgagctggtggatgtggatgaagaggagtgagctgaagcgatattgcattgccatctgttgggccaagtcgtgctgcggatatgtatttccagctaaaggagggc

SEQ ID NO: 322 - DNA, 1114 bp, Zea mays
acctgccgcaactgaatcgggtcagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttgtggaactgtcaacagggtgacaatcttgactgacaagtttggacagccaaaaggttttgcttatgttgaatttctggaacaggaaggtgttcaggaagctcttaacttgaatgaatctgaattgcatggtcgccagattaaggtcgccccaaagaggactaatgttcctgggatgaagcagcgtccaccacgtgggtataatccataccatggctacccttatagatcatacggggcaccgtatttccccccatatggttatgggagggctcctagattccgccgccctatgcgctacagaccttacttctgaagtacggggtagggtaatgaagttcaatgcaaaaccagcccatggtcactggtcagtcccgggaataatcaactgtatcgtttgcactgttgcggctcaatgctcctgtatcagctgccttttctgacctttgtttcaagtgccgccataagcgacggacatgttgtattggcttgtaatacaggacgtagtaagtgcacacactttctgtaagcgtgctttcccacttcccagggttactactgtttgcaatttctgtagttctttgggtcggtcggttaggacatgggagtggatcgttctatgcccatttgaggtagattagttatatgaagagaaagcttcgcatgcggggctgtcttgtttgcagattgccactacctcagtacggttccaggttcctcaaggtat

SEQ ID NO: 323 - DNA, 2798 bp, Zea mays
agggaaagcaccgaaaggcgcggctttttttacctctctctcgctttgcttgccccttcttttcacttccctccctccctttcctctcctccccgctccatggcccccgcggcgccagcgggcctggcctccgtcgcggtcgcggtcgcggttgccgtgctcgccgccgcggcgtcggcggccgtcacctacgaccgcaaggccgtcgtggtgaacggccagcgccggatcctgatgtccggctccatccactacccaaggagcgtccccgagatgtggccggatctgatacagaaggccaaggacggcggcctcgacgtcgtgcagacgtacgtcttctggaacggccatgagccctcccgtcgacagtactacttcgagggtcggtatgatctggtgcacttcatcaagctggtgaagcaggccggactctacgtgcacctccgcattggcccctacgtctgcgccgagtggaatttcggtggtttccctgtttggctcaagtatgtcccgggcattagctttaggactgataatgaaccgttcaaggctgagatgcagaatttcaccacaaagatcgttgacatgatgaagtccgaagggctctttgaatggcagggagggccaataattctttcccagattgagaatgaatttgggcccttggagtgggatcagggagagcccgccaaggcctatgcgtcatgggcagctaacatggcggttgcgctcaacacaagtgttccatgggtcatgtgcaaagaagatgatgccccggatccaattattaatacttgcaatggattttattgtgactggttctccccaaacaaacctcacaagcctacaatgtggactgaggcttggacatcttggtatacaggatttggtattccagttccacatagaccagtagaggatctagcatatggtgtggccaagtttattcagaagggtggctcttttgttaattattacatgtatcatggtggaacaaattttgggcgcacagctggtggtccattcattgcaactagctacgactatgatgctcctattgatgaatatggtttgctgagagaaccgaaatggggtcacttgaaggagttgcataaagctatcaagctttgtgaaccagcattggttgcaggagacccaattgtaacttcacttggcaatgctcagcaggcatctgtttttagatcaagcaccgatgcctgtgtggccttccttgagaacaaggataaagtatcttatgctagggtatcattcaatggaatgcattatgatctacctccctggtccataagtattctcccagactgcaaaacaacagtctacaacaccgccagcgttggaagtcagatttcacaaatgaaaatggaatgggctggaggattcacatggcaatcatacaatgaggatataaactccttgggtgacgaatcatttgcaacagttggattactggaacagataaatgtgacaagggataacacagactacttatggtatacaacatacgttgatattgctcaggatgagcagtttctcagcaatgggaagaatcctatgctaactgttatgtcagctggtcatgctttgcatattttcgttaatggacaactaacagggactgtgtatggaagcgtagaagatccaaaattgacatatagtggaaatgtgaaactttggtcaggcagtaacactatttcatgcttaagtatagcagttggtctcccgaatgtgggagaacattttgagacttggaatgctggaattctaggtcctgtgacactggatggcctaaatgagggaagaagagatctcacatggcagaaatggacctataaggttggtctgaaaggtgaggctttgagtcttcattcacttagtggcagctcttcagtagagtggggagaacctgttcagaagcagcctctgtcatggtacaaggctttcttcaatgcacctgatggtgatgagccattagctttggatatgagtagcatgggtaaaggtcaaatctggataaatggacaaggtattggaaggtactggcctggctacaaagcttctggaacctgtgggatctgtgattaccgtggagagtatgatgaaaagaagtgccaaaccaactgtggtgactcttctcagagatggtaccatgttcctcgttcatggcttaatccgacggggaaccttttggtgatatttgaggagtggggcggtgatcctaccggaatttcgatggtgaaaagaatagcagggagtatctgcgctgatgtctccgaatggcagccatcgatggcaaactggcgaacaaaaggctatgagaaagccaaggtccacctccagtgtgatcatggacggaaaatgactcacataaaatttgccagctttggcacaccacagggctcctgcgggagctactctgaaggcggttgccatgcacacaagtcatacgacatattttggaagagctgcattggtcaagagcgctgtggggtaagcgtggttccagatgcatttggtggagatccatgccctgggactatgaaaagagccgttgttgaggctatatgcggctgagtcatatgatccatataacgtactggtttctacaataatgttaccctatatcaagctggcaagaggtgaaagtggcggcaactgcgacacacggattgccagggtttacaggaattagttgtatgttagatttaagcatcgtatgtgtatgtaacttaggtcacatgagacttgcatggaagaagtggttaggaccctagctgtga

SEQ ID NO: 324 - DNA, 995 bp, Zea mays
aagtcccaccaagctgtcccccgaccactccgccgcccgctccaatggcggcgccggccagctcctcatgcttccacccacgcgcgaccgccagcccgccgtcttctctcagcgtcggcaccaaggtcttcgtcgggctcagggcgcagaccaagctcggttcgtcggagtcgtcatgcccgaatgtcagcgctgggttccacactgcggtcaaccggagaatctctctcaggttgtccaaaaagaaggcgaccagagcccgcatctcgatgatgcctattggtactccacgtgtgccttaccgaacacctggtgaaggaacctggcaatggcttgacatatggaacgctctgtaccgtgagcggattatcttcattggggacaatatagatgaagaattcagcaaccaagtgttggcaagcatgctctatcttgacagcattgataattccaaaaagataatgctatacattaatggaccaggaggagatcttactccgtgtatggcactatatgataccatgctaagtctaaaaagtcctattggcactcactgcttgggctttgcattcaacctggcaggattcatccttgcagccggtgaaaagggttcacgcactggtatgcctctatgccggatttcactccaatcacctgccggagcagctcgaggacaggctgacgatatagaaaacgaagcaaacgagcttatccgcatcaagaactatctctatggcaagctcgcggggcacacaggccattctgtcgagaagatccatgaggacctgtctagggtgaagcgcttcgacgccgaaggggctctcgagtacgggatcatcgaccgtattgtcaggccgtctaggatcaagaaagagggctccactgctcaaaggagggacatgcggaatctgggacttggctaataatagacgatcgaaatcctgttgtatcagaattttttgtgcaagggatgcgcttattatgggagagcgagc

SEQ ID NO: 325 - DNA, 3008 bp, Zea mays
aagctccatcccgttcttgcccagtgttcatcaggtgcagcttgcgcggatccccctcatgaactgagcaatcgatagaagaaacaaaaagggccatttccgctacagaaaataaatcatcaggaatgggaaaacgaggccacaggcggtctgcatcacaagacgacgacaatgtgggctgtgtgtggggcctcatgcgcatgctttacttccgccgagaccccaaacttttgctggatgcgaagcagttgagtgggaggcatgcgttccgggaggtcagcgggagggggcattcagcaaagaggccaaatgattttgacgggatagaagaagatggtaacatagaagatcgcactttgcagaaaccgacagtaaaaaaccttatggaggatgaattggaaaaattaatgctgctgaagaaatttccaaatgatgaggttcagagaagaaaagccgacctgggaattgatgtctctcttgatacgatttcagagcatacaaataaatcaacagataactcatatcaccaggcaggaatctctacgccttcaactccatcaatggattatggggttttgaattatactgaagaatataatcttgaatctgtgctggtgaattttctaggtgaaatatatagttgtcacaatgaatgcccacacagtgattgcaagaacaagaatgaattgtgtccttcactgaagtccctaatccataaaaaggtcaatgaattgaataatcttccccacaatattggccgtgggcaatctcaagagggcagtgatgctaagccatctgaccaaaataatctttataacaccatggcagcccaatccaaacaattcaaggatgcattggaaatactgggttcgaacagtgaactttttgtgaagctgcttcagaagccaaatcaacatatagctgatagtatccaacagcatgaaaacagtaaggtgtctgctggattagagcctgacaaaattcatggacagaccaattttgttggaggaagaggaagctcaaaacagcatcctttggctacaaaagagcaggctaaagagagaaaatatatgttcttctggaggaagagtaaatcaaatagaaggcagatgcttgacgcaacagatggagctcagactgttagcaaaattgttattctgaagccaaatccagaaagagggattaatcagaaagcagctactgcaagaactttacatcaacagccatgtacatcgaatgctcctggatgcagtggaagggaaaactcaaagttttcaattaaggaagtcaagaaaagattcagatttgtgactggtgagagaagtgaaagaaatttgtcacctgcagaggaccttcaaggagacccacgtaagatcaaagattctgttgttgcaattaataaatattttagacatctccctgaagggagcttggcaaacaagtctgcatcagacattgagaatggcatcaaaccttttatcagcagtaagcaaaagaatcaaaatgggagcataactgaaatcagtggccatatagtagcaccaaaaggtgcatctgtattttatgaagaggccaggaggcatttatcagagatgctaaaaggtaatgactgttccataaactatccagaagttcaaatatcaaaatccttggaaggcatactttctcttcctcatggcaatgtgtcaaccactgggagtagcctgaggggaaaggattaccttgacccctcacctggagaaacagatgtttacgatgcatgtgaggttgagagagaagaatgcacacaagagagaagccaatcacaagaggattttggaagcattgctcactgtacttgcacaacagttgatgatcaggtgacagttcgagaaggatattacacgaatgaagcacaagaaggaccaagacatgctcatgatgagccagacactctgtatattgaaggacttgataaattcatttgccgcgaaaacattcgcaacgaagagtccagtccagcagaacaaagcagagacgatatacgtcaagagatactagaagaaataaatcagggaaaagagcatgttaaaatgtccctagcttctgttgagggcatagatgaaaagttggggcagcaagagccagaaacaccggaaccaagagcatcagccaaattaatctcagacggttctcctaatcaaagcgatgaaaagcaagagaggcccagtccagtatctgttcttgagtcatccttcgaagatattggcagtccagactgcataaacaagaaagagtgtgagctgcatggtctccaaaggaccctgtattttccagataatgaaccagacgttaatgtcctttgggaggacaagaatgtcaggttggactacataaagctggtgctagaactctcagaactgtgcgcagaacaaaatctagaggtatggtacctagaagacgagttgatcagcccctgcttgtttgaagaactacagagccagggtgatcagacggatgatcgaatgcttctgtttgactgtatctgtgaagctctaacagagatccaagagagatattttagactctcctcttggctaacttttctaaaacacgacatacggacacctccgacaggagagaacctaatcacagaagttgataggtacgttaacgggtatattatccagtacagtcttccaagtactctagagcagacaattaaaagggatctggaagttcagacgtggatgaacattagatcgaaaaccgaagggattattatggagatgtgggagtttgtattggatgagttgatagatgagactgtctccgatttgtggatttgaagttctgattaggcttcgtccatggtgcctctgtggcgagcatagtgagtaggatacaggagttctttcgtgctgaaaaataaccagttctatgcggcagaatagcatgggctaccgctagccaagtgtgtaactgcagtggagatcgttctcgtgtagtcgtgtggaggagaacagaag

SEQ ID NO: 326 - DNA, 3110 bp, Zea mays
tccagagcactcactctcctggcaaaccccttcgtctcccaaccctagagagcagcagcagctaccgcagcccctgccatggcgccgagctccccgtcacccgccgcgcccacacgcgtctctgggcggaagcgcgccgccaaggccgaggagatccaccagaacaaggaggaggaggaggaggtcgcggcggcgtcctccgccaagcgcagccgcaaggcggcttcttccgggaagaagcccaagtcgccccccaagcaggccaagccggggaggaagaagaagggggatgccgagatgaaggagcccgtggaggacgacgtgtgcgccgaggagcccgacgaggaggagttggccatgggcgaggaggaggccgaggagcaggccatgcaagaggaggtggttgcggttgcggcggggtcacccgggaagaagagggtggggagaaggaacgccgccgccgccgccggcgaccacgagccggagttcatcggcagccctgttgccgcggacgaggcgcgcagcaactggcccaagcgctacggccgcagcactgccgcaaagaaaccggatgaggaggaagagctcaaggccagatgtcactaccggagcgctaaggtggacaacgtcgtctactgcctcggggatgacgtctatgtcaaggctggagaaaacgaggcagattacattggccgcattactgaattttttgaggggactgaccagtgtcactattttacttgccgttggttcttccgtgcagaggacacggttatcaattctttggtgtccataagtgtggatggccacaaacatgaccctagacgtgtttttctttctgaggaaaagaatgacaatgtgcttgattgcattatctccaagatcaagatagtccatgttgatccaaatatggatccaaaagccaaggctcagctgatagagacttgcgacctttactatgacatgtcttactctgttgcatattctacatttgcaaatatctcgtctgaaaatgggcagtcaggcagtgataccgcttccggtatttcttctgatgatgtggatctggagacgtcatctagtatgccagcgaggacagcaacccttcttgatctgtattctggctgtgggggcatgtctactggtctttgcttgggtgcagctctttctggcttgaaacttgaaactcgatgggctgttgatttcaacagttttgcgtgccaaagtttaaaatataatcatccacagactgaggtgcgaaatgagaaagccgatgagtttcttgccctccttaaggaatgggcagttctatgcaaaaaatatgtccaagatgtggattcaaatttagcaagctcagaggatcaagcggatgaagacagccctcttgacaaggacgaatttgttgtagagaagcttgtcgggatatgttatggtggcagtgacagggaaaatggcatctattttaaggtccagtgggaaggatacggccctgaggaggatacatgggaaccgattgataacttgagtgactgcccgcagaaaattagagaatttgtacaagaagggcacaaaagaaagattctcccactgcctggtgatgttgatgtcatttgtggaggcccaccatgccaaggtatcagtgggtttaatcggtacagaaaccgtgatgagccactcaaagatgagaaaaacaaacaaatggtgactttcatggatattgtggcgtacttgaagcccaagtatgttctcatggaaaatgtggtggacatactcaaatttgcggatggttacctaggaaaatatgctttgagctgccttgttgctatgaagtaccaagcgcggcttggaatgatggtggctggttgctatggtctgccacagttcaggatgcgtgtgttcctctggggtgctctttcttccatggtgctccctaagtatcctctgcccacctatgatgttgtggtacgtggaggagcccctaatgccttttcgcaatgtatggttgcatatgacgagacacaaaaaccatccctgaagaaagccttgcttcttggtgatgcaatttcagatttaccaaaggtacaaaatcaccagcctaacgatgtgatggagtatggtggttctcccaagactgaattccagcgctacattcgactcagtcgtaaagacatgttggattggtccttcggtgagggggctggtccagatgaaggcaagctcttggatcaccagcctttacggctcaacaacgatgattatgagcgggttcaacagattcctgtcaagaagggagccaacttccgcgacctaaagggcgtgagggttggagcaaacaatattgttgagtgggatccagaaatcgagcgtgtgaaactttcatctgggaaaccactggttcctgactatgcaatgtcattcatcaagggcaaatcactcaagccgtttgggcgcctgtggtgggacgagacagttcctacagttgtaaccagagcagagcctcacaaccaggttataattcacccgactcaagcaagggtcctcactatccgggagaacgcaaggttacagggcttccctgactactaccgattgtttggcccgatcaaggagaagtacattcaagtcgggaacgcagtggctgtccctgttgcccgggcactgggctactgtctggggcaagcctacctgggtgaatctgaggggagtgaccctctgtaccagctgcctccaagtttcacctctgttggaggacgcactgcggggcaggcgagggcctctcctgttggcacccctgcaggggaggtagttgagcagtaaaaggatgacagatctgagctgagctgggcaacatccagcggcaggagcatttctggttcggttcgattcgggctcacgagcgcattgtgctgattcgcagggtgcactcgagctcgagtgcggagttgttgtaatgtaggttgaggtttcaaaacatccatccatccatcggccccgcctatttgtggatggtgtttctcgtgccattttagttcagctgtattgatgcttcgtcatgtatgtgtattgtaccattcgttcttgttacctactggtaaggcaacatttgatcc

SEQ ID NO: 327 - DNA, 748 bp, Zea mays
cacaggagtgcagaattgaccgcgcgcacgacgacgacgaccaccaacagcaacaggagagaggaggagatcgataagggatggagggcggcgagacgacgctgtccgggttcggcggtgccggggcccccggcgtggacaccaaggtgctgcacgcgttccagaccagcttcgtgcaggtgcagacgctgctggaccagaaccgcctcctgatcaacgagatcaaccacaaccacgagtccaaggtgcccggcgacctctcccgcaacgtgggcctcatcagggagctcaacaacaacatccgccgcgtcgtcgacctctacgccgacctctcctcgctcttcgccgcggccgacggcggcggcggccgcgccgcgtccgagggcgggtccgtgggcaccgtccgccaccaggcgggcgccggccacaagaggatcaggtccggcctcgactgatttgttgccaggcatttcttcttcgcagagaaaaggagtagcagtactaagtacagtagctagccacgtaccaccagccgcagcgaaaccacctcccttttgtcttctgacttgagctcttcttgtatctatcgacatacgctatatatctatctatctatttatatgtctccattacgactgttaccatattcttgttgctaagagctactactacttagtatgcgattagtctgtattttcgatgcaatgcaattcatggacgatgcacgcaacatacagggtgaacttgt

SEQ ID NO: 328 - DNA, 2722 bp, Zea mays
gcgttcaggctatgaactaagctgagcagcttcttgcgttttaattgagctctcttgttcttgctcccgcgtcccctgcatttcaggaaactgatatcggggagcaagcaaggcaaggtttctctcggaagaagcattacagtgccccacttcggcctttctgatttatttgctttgctagtcctcgttaaagttctgaccattttggtggcttggaagtgataaagtttaccaattcactaagccaattgagaaaggatagtgctaactgagctccaatggcttggcaccttgatatccttgtcatggtcactacttgtttgatttttttctcaataagcgagcaatcttcacagagcgagctgctgcagcagctcaggaagcagctggagtaccctaggcagctggaggcttggggcagcccaagcagcgatccctgctacactcaacccactgcagtgcttgcggtcacgtgtgaggaaaatgccatcagagagcttaagataatcggtgacaggatcaccaaaccgccaaagttcagtggcttttctgttcctaatgtcaccctctcagaagcctttgttttggattcgtttgttactacgctggcaaggctaactaccctaagagttgtcatcctggtgtctttgggcctatggggtcccctcccagataagatccaccgtttatcttcactggaagtgcttgatttgagctccaattttctctatggatcgatccctcccaagctgtcagtcatgtcgaagctccatactgtgacactggatggtaactacttcaatggaagtgtgccagactggcttgactcattctcgaacctcactgttcttcggttgcagagtaaccagctgaaggggtccataccggcatcgattggcaaagctgccatgcttacggagctcgcgcttgccggcaatagcatctcgggggatgttccaaatttagtcaacctaaataagcttgagatgctggatttaagggacaacaagttggatggagagcttcctgagatgcctacatcagtggtaacaatcttacttagtaaaaattcactaaagggtgaaattcctgagcagtttggtcagttgaaccggcttcagcaccttgatgtctcgttcaacttccttgtggggagtcctcccgcagagctgtttgctctccctaacatcagttatctgaatttggcggcaaatatgcttagtggttcattgttaagtagtttaacatgcagcagcaccctgggatttgtggatttgtccactaaccgactcacaggcgatctgcccagctgtctgaacggtaatttgaataacaaggtcgttaagtttgatgggaattgctttagagttgaccctgcccaccagcatgaagataaatattgccaacaatctcataatgggagaggatcaaaaaaggatgttggacttgtagtcactgttgttggcatattgtttgttattcttgtgctttctctgttgttaatggcttccaacaaaagaagctgtcagaaagttctggccgaacaacagatccagcaaaagcatacacaagataatttgttgtcaggaatgtcgtctgaactgctggtgaatgcaaggtgcatatctcaagctgtcaagttaggaacacaaatacaaccgtcatatcacatattttctttagaagaactcaaggaagcaacaaagagctttgaaaggtcagcatttttaggcgagggagcaattggaaagctgtacaagggaaggttagagaatgcaaccctgattgccataagatgtttgccattgcaccagcgatattcaattaggaatctaaagcttcgtttagatctccttgcaaagcttcgtcatccaaatttggtttgcttattggggcactgcattgatagtgcggttgatgaatcaactgtgaagagggttttccttgtgtatgaatatgtgcctggtggaactctttcttcttatctttctgcctgcagtccagacaagactctgaaatggtgtgataggctgcaagtgctgattgccattgctaaggctgttcatttcctacatacaggaataattcctggttccttatccaatcggctaaaatcttccagtattttggttgacgaacaccatacggcaaagttgagtgactatggattatctataatcacagaggagatatacagacatgaggtaataggacaaaaggaaaaatacttgcaaaatgatgctacagaaatggaaaatttggaggatgatgtatgctcttttggttatattctactggaagtacttatgggcccaaaattacatgagaaaggtggccctttcattttgaaagatctggttgtgtcaatgtctactttggaagagcgcgatcaagttgtggatcctgtcatcattggcacttgttcacaggattcgttatccatcgtggtttcaattatgataaaatgcctgtccatcgaatgctcggctcgaccttccatggaagaagttctctggaacctgcaatatgctgcccaggtccagacaatggcggacagcgaccaacgatcagaagtttcctcacaagcttgttagcatggaaactggaaatagctcgaaactgtaatctagatcggatcaaagatgataggaagcaagaatcatgtttatatgatcttgatttgagaacaggggatgaccggatgagtgagctcggctaactg

SEQ ID NO: 329 - DNA, 1340 bp, Zea mays
gagtgtgagggcaggctaaccgaggagctagctagccagcaacgcgtagcaagcagcgcaagcaaagctccgagcgcccggccggctagcttcgccatgaacatgggtggaaggtccccggcggcgacgacgatccggtgcaagtactgcagcgcgagcctgaccgtgtgcgccggcgagcgcgccatccagtgcgcgcaatgctgcggcgtgactcgcatccggcggtcgctgtcctcgcggctcccgctgccggcgctgacgaggccggcttccgtcgcgggcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcgggggccaggcggtgcttatcagcggctacagcgacggcaaaagcaagttcagcatgacgccggaggcctgcgcgacggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgcaattggccgttgccttcgcagactaccacagattcccgtctggactctatatataaattcccgtgacggaataataaaccagacgggtttatattgtatatgatgatatgaggcttgcttgctcataatgtgtgccttaattgtcttgcggccaata

SEQ ID NO: 330 - DNA, 708 bp, Zea mays
gattctcgtcggtcgttctgtgccctatccgtcgtcggctatcgcaacagcagcgcctcttccctgtcgccctgactcctccctagcagcagaaaaccggcggcaagtcttcggtggcggcgagggaaggccaaggctttgcctgagagaatgcaagacccaagggatgatgatttcttggcgccaaagttgcataagaagaaggttgtctaccggccgcagccatcaggccatctgaagggtgaacctgaactgttgcggagagagtttccgcaatcatcaggcatggtccaaaagccacccaaaagaagcttgaagggtgagcctcgcacgcccccttccgacagggggaccccggattccctgccggaatctggtcctaccgacgaataccgtgcgttaaggaggaagtacctgatgctggaggaagagaactttgcactggacaaagaactgagcatggaagatgaagaaatgaaggccctagaggatgaaaagcttgcactgcttgatcagcttgttgtcttggaaggccttgtcgagccatcccagttgcagtctcaacctaggccgtaaggtgttttggtttatgtataatcgttgtcgttcattataattcagctactagtagctgttatactatctgggcttaaacagtgtgtagaaacagcatagtagacctgttacttctatcggacatcgacgaat

SEQ ID NO: 331 - DNA, 2675 bp, Zea mays
aaagtcgacttgtttctcgtcgccggcgtccgtcccccggcgtccggcaaccggcaaccggcgacgacgatggaggcggcgctgggggcgctgtgccgcgccggaggctggtcgtacgctgccgtctggcgcttccacccccaagaccctcgattgctcacattgggggactgctactgtgaagatgaggcaaaagcaatggttcaggagatgcttaatcttgttgaagttgttggagaaggcatcctaggacaagctctagtaagcggagagtgtcaatggatttacgacgatacttgccacgcgttgaatcagacaagccatgctgataacggagacttacatctgggttatacttggtggcagcatcagtttctcagtgggataaagactattgcactgttacctcttcagttgcatggactggtgcaatttggttccacacggaaggttcccaggagctcagtttttttgaatcaggtccgagatatatttgatcggatgaagaatgcttcaagcgatggtccaatggagtatacccagaataactctcttgcatgcggtcagcaacctatccttacttcatcgagacctgtcaatgacatgctcgtacatagcaaggtcaacccattgcaaactgagaaacttttggaggatattgagagaacagaatctataaggagttcgatctgttctccaagcaattcacagagatctttaaatgatctaacctcccatggtactggtaacagcagcatggatactaatatattagccatgcctgttaactccaagtctatatatgatctcaaacgatttgataacgtcacagagttgtttcatcgaagttctaatgacagaattggttttcaagtcaactctagtaaagagcctggttctaccattgctggtgtaatgtcaggatacaaaagtttgaacaatattcatatgacagaaaatgattcatgtgatcaaaacatagaatataccccgtacctttacactaccaccaactcttcaaattctggccttgatgaactttcttattctggcgttgctttgtcgtcatcgtttacagcagtatcagggaaagttaaagattgcctgcaaactgagagtgacaagtttctatgtaaatctgtatcattcggcagcaacccttgtgcttctaaattccaagaaaatcgcctatcaccataccatgccctcatgcacgaacaatccctgatacctgaccctggagaatctgtgaggctcctctcacaagaagaatccttcattgttcaaggtgactcaagtcaattcaaggatactgccgactttacaagccagggtaacagtacatttcctgaattacctaacagatcacctgaagaagctactgctgaaactctagaaaacaacatgaaggactgtagtggaaacaacagtctgctggaaactatgatgcttgatcttagcactaacagctttgtgcaagattggtgggacaacagtgttctactggcagaaaaccttccaaattcaagcgaaaaggacccagagcctgctatggaattggccaataggcattcattgccaactggggagagaggctcgcctttcatacctgtcatcgaacaaatgctaggtgatgttgcacatccacctacacctaccgggcatagttcacttgaggctgaagctactgctttagctggccgtatttcagattatcagctgccccagtttgctttccgagactgcctaacagtagacaacgcacaaatcccagcattggcctgcagtaattatacatgcagaagtagaagtgcacaaaatggttcttcagaggtgccatcagcaaacgtatctgtggacgacacctgcagtttgaacacagcaaactccaatggcagtcagtcgagcaatcctgagggaacgaaggttgctaagagaagagctagagctggggagagtacccgacctagaccaaaagaccgacaactgatacaagatcgcgttaaagaattacgagagattgtccctaatggtgcaaagtgcagcattgatgctttgttggagcgaacaattaagcacatgctgtttctacaaagtgtaaacaaatatgcagagaaaattaagcaagctgatgaaccaaagataatcgacaaagggagcggtgttatcttgaaagacaacccagttgctggcacaaatggtggtgccacgtgggcctacgaggttgctggccaaactatggtttgcccaataatcattgaggatctttcaccacctggtcagatgcttgttgagatgctttgcgaggaacaagggctctttctggagatagctgacaacatacgtggaattggtctgacggtcttgaaaggacggatggagctctgtgatggcaagatatggtcgcggtttcttgtcgaggcaaacagagaggtcacaaggatggatatatttctgtcgcttgttcagttactggaacagaacagccttgttcgatctactgaccagatggccaaggtcatgaataatggggttccatcctttgcaaaccaccaacggtctccgctgctagttccagtgggcattcctgagagactacagtgacatgcagatgcttcaactagatagagttaggtaccacgactgttaacatatctggtagccatggatccttt

SEQ ID NO: 332 - DNA, 2544 bp, Zea mays
aaggatcctaacagcatacacagggcagacaaagctgcgattttgggggggctgttggtccagccgtggttgttggtggagataaaccacgtgaaggctggtgctctggtacatgttcgccaggcactgatggcatttggccgaggtggaaagatggacggccgccggccgtcctcatcgtcgtcgtcgtcgtcgttctgcacaaccaccacggtcgtgctctttgtggcgctctgcctagtcggcgcgtggatgatgacctcgtccactgtcttcccgctggagatttcgtccaataagaagccggtggtgaagcaacagcctgcgcctgtcaatttcggggcgtcgcaggaggcatcacctggcattgctggtgaagggtccgagaaatttgaggacaccgacaacaatgatgccacagtcccagaggaaccgaataaacaggatgcttctgagcaagagaatttcaatgagaagcctgaagagaaagagctggaagtgccggtagagaaagcggagaccaaggatatgtttgatgacgcaaatggaaaatcagaagggctgtcagatgaaacgaagaatgatgatggggagaagagtgtggagaagaaagacaatgaaatcacaaatgagagtggtgatgaaaaaactgatggtgagagtaaggacggtcaagaagagaagcctgatggcgatgccgctcaggaggagcaacctaaaatagaagagaacgtggaagaaaatggagagaaggatcagagctcaaactccaacgaggtatttcctgatggggcccaatcagagcttctgaaggagtcaaatacccagaacggttcattccccacacaggctgcagagtcaaagaatgaaaaggaagtccaagcgttaccgaagtcttcaggcgatgcaaccagctatacctggaaattatgtaatagtagtgcctcaacagattacataccttgccttgacaacgagaaggctatcaagaagcttcgaactaccaaacattatgaacatcgtgagaggcattgccctgaggagcctcctacctgccttgttccactcccagaaggatataaacggccaattgagtggccaaagagcagggacaaggtatggtacagcaatgttcctcacactaggcttgcagagtacaaggggcatcaaaattgggttaaggtctcaggtgactatctcttgttccctgggggtgggactcagttcaagaatggtgccctccactatattgatactattcagcaggcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaaggtggcatgcttttgctggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagcccgccattgtgcaaggaatctgatgatgcagatgctgcttggaatgtaccgttggaagcatgcatgcacaaactgcctggtggctcaaaagtccgaggatcaaaatggccagagttatggccgcaaaggcttgagaagacccctttctggattgatggttccaaggttggtgtctatggaaagcctgcaaatgaagattttgaggcagataatgcccactggaaacgggttgtaagtaaatcgtatgtgaatggcatgggaattgactggtccaaagtgagaaatgtcatggacatgagagctgtctatggaggttttgctgcagctctgagggaccaaaaggtctgggtcatgaatatcgtgccgatcgattcaccagacacgctgcccatcatctacgagcgcggtttgtttggcatgtaccatgactggtgcgagtctttcagcacttacccaagaacgtatgaccttctgcacgcggaccatctgttctcaaagctcagaaagagatgcaaactggctgcagttttcgccgaggtcgaccgtgtactgaggccacagggcaagctgatcgtgagggacaccgcggacacgataaatgagctggagagcatggccaagtccgtgcagtgggaggtgcggatgacctacaccaagggcagcgagggcctgctctgcgtcgagaagtcgatgtggcggcccaaagaactcgacgctagcacgtgaactgtgttgaggaggaactgctactagggtaccttt

SEQ ID NO: 333 - DNA, 1469 bp, Zea mays
gagagcaccttccgattccgcccaagaaatctccacccaatctctctgtcctctcctcccttctcatcatttcgccatgctgccatcgcacctcaacggccactccgccctcgggcgccgtcgcccgcgcctctccgccgccgccggggagtctccggcggcagcgggggtagaggcggcggctccgctggaggagcacgaccgcatctacttccaggcctactcccatctcggcatccacgagactatgatcaaggaccgcgtaaggaccgatgcttaccatgcagcgatcatgcgccaccagaaatttatcgaggggaaggttgtgctggatgtggggtgtggtactggaatactctctgtgttctgtgctcgtgctggcgcaaagcgagtgtatgctgtcgaagcctgtgaaattgttgtccaggctcgtgaaattgtaaaagcaaacaacctaactgatcagattgtggtcatccatggacgtgttgaggatgttgaccttgaggaaaaggttgatgttataatatcagaatggatgggctatatgcttctctatgagagtatgctgccaagcgtcctatttgcaagagataaatggcttaagcccgggggtcttattcttccttctcatgctacgctcttcatggcccccgtaacaaatcgtgagagatatgaagacagcgtcgatttctggcgtgacgtctatggcataaacatgtctgctcttgtgccacttgccaaaaagtttacatctgaggaaccctccattgaaacaattggtggagagaatgttataagttggccatctgtgttcaagcgcttcgattgctataattttacagctgaggaattcaaatctatcacttcaaaatacaaagtttcatcaatgatgttagctcccattcatggctttggtttctggtttgaggtggagttcaacgagcctatagagtcctctcataattttccttccagtttggatccacttgagattatacagaagaaaaggagacgatcctcagaagatatagttctgtccacagccccagaggatgagccaacccactggcaacagaccattttgtatttcccggatcctatagaggtgaagcaggaccaaattatagaaggttctgtaacagtgtcccaaagcgaggagaatccacgttttctgaatattcatctagagtgcttcacaggaggacagacattggttaaggactgcgccatgcgatgaactggtgtttttatgcttctagtggcttgatttcaggcgcgcaatggggtgttggcagggaggagctgacaatatttcagatttctttaatggaagtggagaatttgtactatttatgccaattatccgtctaatacgaaggcaggattttagtaattgtactccgtcttattctatagagtatatactggttgttgattttggatccgcacgctgtgacctaagtctc

SEQ ID NO: 334 - DNA, 873 bp, Zea mays
tctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaacctccgggtgctcatgatcaagggggccgtgccagggaagcccgggaacctcctccgcataacgccggccaagatcgtcggcaagaacatccccaagaactagacttcttttttcaggggggtgaatgttgagtgtttgtgtttgttaccctgctag

SEQ ID NO: 335 - DNA, 881 bp, Zea mays
aagccatgtcggagcaccccgcgtcccgcagctccgtaggaagccgcagctccgcgctgccccctcaccagcagcgccttacgcctgcgcccgacccgctcgcctccgtctggatccgccgcctccacctctcccccaacccgccgccgccgccgcggcccccacccctgcacatccgcgcgccgccgcctgcacatcaggatgccatctccaccgacgagtcccacacgacgcctccgccgccgccgctcacgctgcgcggcaccgggttcggccccttccgctggagcccgcgcccgttgctgggggcgccggccggcgcatgggacgccgccgccgccgcttccgttggggtggctcctggcggtagtgccgtcggcggcgaccaaacgatgctgtcgccgttcttccgtctcccagcgccgctgccgtcagtcgtggattttgaggaggccatgcctttgaggccgttgatcgggctcggaagccacagcggcagtggtgggtttcctggactgtcacgacagatggtcggcggcggcgacccctgtgacggctggctgtcgtccagagttgcaggtgctgcatatcctggccatgctttggacatggttcccacaagaacccttaatgatctgcgtgacagacagcatggcgcaataccagcacaaccaaatctcgcaaggcatgatcctagctctagcagccaacgtgatgaacctttctcatactggaacatggggaggttccgaagaaatactgcaacttcgtcggtcacacctttgggtgccgctcctgccaatttcggcacgaagaggaacgctgactcgaacgatttcctccctctgaagctcaggaaactaagcggggctatttagtag

SEQ ID NO: 336 - DNA, 569 bp, Zea mays
ctgcaacccttcttcccttctccgtcatcgtgacggcatcacgcgcgcgctctcctctcccacgagtccgtcagcctgctaagtcttaagatggcgtcaagcaatggtcagacagaagctccagcaccatctgtccccaaaaatcccgctatggcatcatgccggaagaagaaaacagatgatgctaccttccttgaagatctgaaagaccacatggatgagttcattcatgcctctatggatgagcacaagacctgctttaagaagacaattcagaagatgtttgggatgtcgaaggctgttgcagagagatccgcggaagcaaacaaagctgaagttgaaagtgctttgccacttcagaccagtgtctcgcagtagaatttcatgttggtagtttcttgctcgtgccaatagttttataagggtttttgttgctgtgttttctgaaacgcataagcgtgtcagtagcatgttttcataaccggattgtagtgcttcattatctatagttttctgtacgtgtaaaatagaccagcgtaacagcgtagtttgcttcattctccgaagtc

SEQ ID NO: 337 - DNA, 659 bp, Zea mays
tgtccctcaattgtcagtcagtagcatccaattgattgttctatcctcttctctgttctcacccccttgcaagcaacaatcgttcaccgatcgatccagtgcgtcctgcatggaaactgccgccgtcgccgcctccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgccgaccatccgcacgtcaaggtggagacgatggtggagagcggggacccgcgggacgtcatctgcgacgcagccaacaagatggccgcggacctgctcgtcatgggcagccatggttacggcttcatccaaagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatggcgac

SEQ ID NO: 338 - DNA, 1353 bp, Zea mays
cggagcagtactaggttggtaggtggttgtagctttgcgcgtgacccgagcgcgcgctcgctcgctcctgtgcctctctacctcgcttgcgtgcgccgggaaggcagtgggtggctggtcggttctcgcaagaggttgctggtgctgttcctcctcccccggttgatgagcatggggcattgctccgagcagcggacggggttcgaggtgactaaggactggaacggcgccgaccagttcgcgatccggtccccgcggggggcgtccgttcgggtctgcctgcacggcgggcaggtcgtctcgtggaggaaccaccgcggcgaggagctcctcttcagcagcagcaaggcaatcttcaagccgccaagagcgacccgtggtggcattccgatatgcttcccacagtttggaaactgtggaacattggagcagcatggatttgcaaggaacaagatatggacaatagacgatgaggctccacctctaaattatggtgataataacagcaacaaagcttctgttgaccttctgctaaagccatctgaagatgacctgaagtgctggccacactgttttgagttacgtctcagagtctctctttcaatggatggagacctttcactgatatcacgggtcagaaatgttaatgggaagccattcagtttcgcatttgcttaccatacatacctttctgtttctgacatcagtgaagtgaggatagaaggtctggagacccttgattatcttgacaaccttagccagcgggaacgttttaccgaacagggagatgccataacatttgaatcagaggttgatcgagtctatgttggctgcccaggcgtaatagctgttcttgaccatggaaagaaacgcacattcatcgtgcggaaagaagggcttcctgatattgttgtgtggaacccctgggagaagaagtccaagacgatggcagacttcggcgacgacgagtacaagcagatgctgtgcgtggatgcagccgcggtcgagagggccatcacgctgaagcccggggaggagtggacggggaagctggagctctccgccgtggcgtcgaccaactgcagcgaccacctggatcgcccgggcaggctgtagagcgctgggtgggtgggttcgttcgcccctgacgaaaggcatgtactagttttttttcatgtacatgggggcgctaggtccggcccttgcaggctgcagtatcatctacctgtcaggtgtgtcatgtgtgagtttaaacttatgtcagatccaagtattgctgtgatcgacatgttcgatgttcctggactgcgaagtctcaagcgcaggctgttcgtttggctggctttaatctag

SEQ ID NO: 339 - DNA, 1130 bp, Zea mays
ggaaggaatcgacacagagttcagttcacatggctgctgaatcagagaacggcaactgcaaagcctgggcagcgaaagatccttctggagttctctcaccacacagttttaaccgcagagcagtgcaaagcggcgatgtttcgttgaagatcatatactgtggagtctgttatgcagacgttgcttggacacggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatggctaccctttggcgaaggcagcacctcttctgtgtgctggaataaccgtgtatactccaatgatgcgacacaacatgaaccaacctggaaagtcacttggggtcattggtcttggtggtctgggtcacatggctgtgaaatttggtaaagcatttggtcttaaggtcacagttttcagtacaagtgaatcaaagagagatgaagccatcaacctccttggagcagataattttgttatatcatcagacacacagcaaatggagtccctgaagaactccctgcacttcataattgacactgcttccggtgaccatccatttgatccgtatttctctctccttaaggttggtggtgtgatgacattagtgggctttccaagtgagatcaaaatgcatcctgcaagccttatacttggtgcgcggaccttgtctggcagtgttgttggaggtataaaagacatccaagaaatggttaacttctgtgcagccaacaatatctatccggagattgagatcattaagatagattatatcaacgaggctctcgcgaggcttgttaatcgagatgtgaaataccgctttgtaatcgacatcgagagctccttcaagtagcgtgctagcgcacatgctctcgtctttctgttatag

SEQ ID NO: 340 - DNA, 1757 bp, Zea mays
ctccgatggggaagtctccggcgaagtggatcaagtccgtgctcttcgggaaaaggtcgtcgtcgaggtccggctccaccaaggccaaggatttatcgaagggtacgactaacaaagcagcagctgctgctgctgctgccgggaaggagcccgcgttctctgagagctctccggtcatctcggagcctgtgcttgttagcgcccacaacaatgagaccgcgcgggaggccgctaagggtgagaattccagcgtgcaagaagtgccagagactgatgtcagtcaagacttggagaagcagggcactgttgggtctgatacgtctaatgatgctgagaggttgagggaagagcaagcggccgtgaaggcacaagctgccttccgtggttatctggcacgccgagcattccgtgccctgaaagggatcataagactacaggcactgattcggggacatcttgtaaggaggcaagctgtttcaactctccgtgccacatggttgattgtgaagtttcaagcccttgtccgtggaaggaacgttagactttctaatgtttccattcaagcaactacggaactttcccaacagaacttcgggggttctaaacctggttcctggaaggagaagttgtcttcaaatgcatttgctcggaagcttctctcttcaccaattgtggttgaggctcttcacgtccagtatgatgagatggaccctaattcggccttcaattggttagagaggtggacagtaagtcatgtctggaagcctatttcccaaccaaagagagttggtgctgatactaagcctcatacaaggaaggccagttatgcaatggaaacagagtcagcgaaattaaagcgtaatgcacggaagagccctgcagtgccatttgagccttctcaaacaaacaccaccattgaaaatgagaagacaagacggaatccaaggaaattaagtagcactcctgctgagtcagttcccgatggccagttaacagaacttgagaaggttaaacgtagccttaggaaggttactagttccatggttgaaacctcaaaggtgcctagcccaacaactgagattcctgaccgtcaagaggtacaatgtgagagaccactaagaagtgcaaagcaagctccaattcatgttgagaatcaagaacctcagaatgttaatctatcggagaatgcaaagatggatattctggtaccagatatccagcctgacgtggaagttgcttcagatctagtcacaatcacaaatgaagaaaaagttgatgagacaccgtctgttgttgctccagcggctgaaattatgccactgcaagacatcaacagcgaagaaaatgctttggtgaatgatgtggaagagagatccaaagaagaacattcatctactgataacctgaaaggcagcaagaggaggtcttcattctcagctaaacctgaatatccagaaaatggctccaaaaattctccagccctgccaagctacatggctgctacacaatctgcaaaggcgaaactgcgggggaattgttcaccaagacttagctctgattcagcagagaaaaacgggttcactcgtcgtcactcccttccgtcccctaacaatggtaagataatttcacattctccacgtacgcaaaggccaacccatgctggtggcaaggacggagcaaaaggcgacaaggctatgctgtcatcaagagatgcgagcgagagaccactgaaagctgagtggagacgctgaggttaa

SEQ ID NO: 341 - DNA, 2301 bp, Zea mays
acgagaaactccggcgagtctcgccccctcttcccccactcgctcgtaactcgccgcgcggcggaaaccccacgcccggggtgagatccgcgcgggccctcgcctgcctcgtcaccgtcccgcgacctccgatctccacagggcggccggaggagtcggacgggcagagggagatggcggcggaggagggggccatgtcgccgacgaggatgcttgcggaggggcacctgcgggtggccaccggcgggggcgcgccggcggacggcgggatcgccgtcagacacctcccgcaccatcaccccactaagaaagacaatgttggtgggaaaactgaaaaagacgatcatgaaggtgtaaattctttactatctgaggagttgaaaaaactagctaatgggaatagcaagattcctggtacattagatgagtatagaaagcttgtcattccaataattgaggagtattttagtactggagatgtggaattggcagcttctgagctgaagtgtcttggatctgatcagtttcatcattactttgtgaagaagcttatatctatggcaatggatcgccatgacaaagaaaaagaaatggcatcgattctgttatcatctttgtatgctgatctactgagctcctacaggatcagtgaaggttttatgatgcttctggagtctacagaagatctaactgttgatataccagatgccactgatgtattggcagtttttattgcacgggctattgttgatgaaattttgcctcctgttttcctcactcgagctagggcactacttccagaattttccaagggcattcaagttctgcaggttgttgaaaagagctatttgtcagctccccaccatgcagaattagttgaacgcaaatggggtggaagcacacactctactgtagaagaagcaaaaagtaagattaagaatattctaagagaatatattgagaatgaagacatagatgaagcctttaggtgtataagagagctcagccttccatttttccatcatgaggttgtgaagcgtgctctcacctttggtatagagaacatatcctcgcaaccatcaatccttaagttattgaaggaggcagctgcaagttgcttgatcagtcctaatcaaatctcaaagggtttttctagactagctgagggtgttgatgacttgagtcttgatattccttctgctaaagctctttttgacaagctggtttcaacagctatatctgaaggatggcttgatgcttcttttggtaaatcagctgcccctgacgaagagatacaaagtacaagcgttgtaaaggtgaagcgttttaaagaagaatgtggccacataattcatgagtattttctctcagatgatgtcccagaacttattcgaagccttgaagagctttctgctccagaattcaatcccattttcctcaagaagcttgtgacgcttgctatggacagaaagagcagagagaaggagatggcctcagtactcctttcttcattgagattagaattgttttcaactgatgacatcattgagggttttgtaatgctcttgcagtccgcagaagacactgcactcgacattgtggatgctcctagtgaacttgctctcttcctagctagggcagtgattgatgaagtattaattccgctcaatttggatgaaatcagcattaagcttcggccgaacagcagtggcagccaaactgtccagatggcgcgtgctctactgtcagctcgccattctggtgagcggatactgcggtgctggggcggtggcactggatgggctgtggaagatactaaggacaagatcactaagctattggaggaatacaacactggtggtgacctaggagaagcctgcagatgcatccgtgatcttgggatgcccttcttcaaccatgaggtggtaaagaaggcactggtcatggcgatggagaagcagaatgacaccagcatcttggtcctgctgcaggagtgtttcggcgaggggctcataaccatcaaccagatgaccaaaggctttgcccgtgtcaaggaaggccttgatgatctgatcctcgacatcccaaatgcccaggagaagtttggagagtatgtggagctggcaacagagcgcggctggctgctgccgaccttcgcctccgttccctgagcatccaccactggcgataccttccttatgtgtacatttgtgcccatgatgtcattagctccgtaccaaagttttcctattcctagtttacttatgttaccgtatactggaggattgtaggatggatgtg

SEQ ID NO: 342 - DNA, 975 bp, Zea mays
cacacaaggagctgaagtgcacgccactatccatcctgctctggtgctcccactcccctcactccctcagtccctcactcccacgcgcacgcataggcatacccagccggccgcacctccgctccgcgctctcgccccgcccacaacacaatgcgccgcgctgccgcgctcctcctgtccctcgccctcgcggccgccgccaccaccacggcggcggcgtccgtggcgaaggctcccgtggcggcggccgcgccgccgccggcgcctccgaacgtgacggcggagatggcgaagggcgggtgcaaggcgttcgcgggcctgatcgcggcgtcccccgacgcgtcgtccacgtaccagtcggccgtggagggcggcatgacggtgttctgcccctccgacgacgccgtgcgcgccttcctgcccaagtacaggaacctgagcgcggacgccaaggcggagctgctgctgttccacgccgtgcccgtgcactactcgctggggagcctcaagtccaacaacgggcccatgaacacgctggctaccgacggcgccgccaggaacttcaacttcacggtgcagaaccggggcgacgtcgtcaccatctccacggccgcctccggcgccgccgggcccgcgcgggtcaagtccacggcgctggacgaggacccgctcgccatctacgtcatcagcgccgtggtggagcccgtggagctcttcacacccgcgccggcgccggtgccggcgcccgcccccgcccccgctagtgtcgcggacgcgcccaggcccggcaaggccgccgcgggccggcgccacccgccgcccgccgcggccgacgcgcccggccccgccgcagaggacaacgcggctcccgtggaccagaaggacgccaagaagagcgccgccgccggcgcgccgtgcgctctgtggtggctcgccgccgcgctggccgcggcctcagcattggcttagcgatag

SEQ ID NO: 343 - DNA, 714 bp, Zea mays
ccaaactaccaaagcgagagacaaccgctgcgccactgcggaaacgatttcgtcgccatgaccatgacgtctcgtttcgttgcggcggcctcttcctcctcgtcctcgtgccccctcgcccgcctaatctctcgccgcggccttgccggtgccgcagacggccatggacctgcgaaggtgcccttgtggaaagatccgttgagcccgagcaagtggaaggaagagcactttgttctagcaagcctctctatgtggggggctcttttttatggtggtttcaagttttttggtggaaagaaggaagacaagattgaggcggcatcaggacagacataggtggctgggatgggagttcttgcctatttctgtggccaggcaacaatgttaaataaaaggaatgtgttatattgtgctttcaagttgataaattgtggcagccaggttttgattatgtaggcaatattttgacaagctactcttatccagcatgaatgacttcatgttagtgaatgctgcaaatgttgtacttctttcatgcgattgagtagatgttttacttctgttgccatcaccagttcaacgctgtactttcaattgattcgatcccgtgttttctagtttgcgttgttacagatgaatttgacttgagttttattgataattctatttgtgttgcttgcaattagaaattgcaatgtgggttgttggatgtat

SEQ ID NO: 344 - DNA, 1285 bp, Zea mays
aagctcacctcatccctctttcaccccacctctgcaattgcaagcaaagctccggcctccggatcaggatcacactgaccaccgcgagcgcgtgccggcgtccagtggttacgtcgagggagcctaggctagcgaggaacaagcagccaccagcccgccacgatgctcgtgaggagcgcctccacgccggtcctcggcgcgctgcacccttccggctgccactcgccggcggtctcctccccggccgtgcacttcgccgagtcgccggcgtcggccgcctaccacgcgccgcccatctcctgccacctgggcgggcccgggtccgggtccgaccacgagcgctcgcgcagccgcggcgccggcgccggcatgcgccgcacgtgctccgaggacaacctcgcgtctctggccggcggccgcgcggacgaccacgaccaccaccaccttctcctcccgccgtccggcaagggcgcgccacgggcgcggccggtgccgctcgagaccatccagtcgttcaggggcccgcatgcgtccaccgacgacgaagaggaggaagacgacgacgacgaagacgcgtacgaggtggagcgggagctgcgcttcggccagttcagctttgccggcggcgcctactcgcaggagcacccgctgttcctggccaggggcctcggcatcgaccgcctcggctcgggcctcctcagcgccgacggcggcggcgggttcggcggcagcgacggcagcgggagcggcggcggcggcgggaatttggtgacgtcggggaacggaggggaccgctccggcatcgagacgcactacaagaagatgatcgaggaggacccctgcaacggcctctttctcaggaactacgcacagttcctgtaccaggtgaaaggggactacaggagggcagacgagtactactcccgcgcgatcctcgccgaccccgacgacggcgagctcctgtcggagtacgccaagctggtctgggaggtgcaccgcgacgaggaccgcgcctccagctacttcgagcgggcggccaaggcgtccccgcagaacagccacgtgctcgccgcgcacgccgcgttcctgtgggacacggacgacgaggagggcggcgccgacgcgctcagctacgcggccttcgctcagccggcgcactcgtctctggcttcggcgacggcaacaacctgaactctctcgccatctcacgagtctcgagagcggttcctccgcagtcgaaatggagcgtgacagtggcctctgctcgtctctgtctgtagtagca

SEQ ID NO: 345 - DNA, 822 bp, Zea mays
tccggcagcggtacgatggccgctgcgagaatggcgctcgtctcttgcgcccgccgcctcccgtccttaccctctccgctcaccctctcgaggccccgcgccggcgccgtctcatttctggctgcccagccgtcgccggcgacggcaccgagatccggcaggaatcttgctctcttctgttctttatcaccgacgtcgccatcgctaactgaggccgccgtagcactgccgccaccgaaggctgcggtggaagagacgaagccccctgtgccgagcggggacgagaagggggaaccgactgtggaggagctagcgggcctgctggacgtccgggtgggccgagtggtgaaggcgtggaggcacccggaggcggacaccctctacgttgaggaggtggacgtaggtgaggcggagccccggaccatctgcagcggcctcgtcaacttcctccccatcgaagaactccaggacagaaacgtcattgttcttgctaacctcaaaccaaggaacatgcgtggcatcaagtcaaatggcatgctcatggctgcctctgatgcttcccatgagaatgtggagctgctcatcccttcagaaggttcctttcctggtgaaagagtatggttcggttccgaagaagaaaagaaccgtcaatctgaccctgcatcaccaaatcaggtccaaaagaagaagatctgggaagctgttcagcctcatcttagaacaacagataactgcattgcggttcttggtgataaacaaatgcgtacctctgcaggcctagttttctgcaaatcgcttcagggtgcaagagtgtcataatga

SEQ ID NO: 346 - DNA, 438 bp, Zea mays
gctcgatatcggagtccagtaggcggctcctgctgcttcggcggtccctaatccctctctcggcagtgtacagatggcgtccggcggtccggcgctcgagccgctcgtcgaccaggtcatctccgtcatcaccaacgatggccgcaacatcgtgggtacgctcaggggattcgatcaggccaccaacattatactcgacgagtcccatgagagggtctattctagaaaggagggagtccaacaacttgttcttggtctgtacattatcaggggtgacaacataagcgttgtgggcgaggttgatgaagagctggattcaagattggatatgtcgaagctaagggcgcacccactgaagcctgttattcactgaggtccgagtatgtctttgggtaatatgtggactggatggatgggtcactgttgaatgcaggatgt

SEQ ID NO: 347 - DNA, 2014 bp, Zea mays
atctactcctcgtcttggcgtccgcggcgccatggcgtgcctcgcgatctctctgcagccggtgaacggcccggacatcctactgcaaacgcggtcctggttccccgtctcccgcgccctcgccgccgtctccgcctttcgcctcgcgcgcctccaccttgcacgcggcaagcaacagtcctcctcatcctccgcctcctcggcctcgctcgacgccatcggcgacgacccgctcgccgccgcgtccgggcagctcgttgtcggcgtcgagtcacagtaccgcgtggtgtaccgccttgtcaactccatctacgttctgggtgtcaccaccgcaggctctgaccatgctgcccctgctgtcaacgccttcgccgtcgccgacgctgtcaaccagtccgtctccgtcgtcgttgcagcctgccgtggcgtcgacgtcacccctgagaaggtgcaccgcaagtaccctgaggtctatctcgctctcgacctcgtcctccacggcgttggctccgtccgcctctctcagatcctcgccaccatccatggcgacaacctcgcgcgcatggtcaactcctcgcccgacgccgaagcccgggcccgtggcgcggatccctggcccgtcgtcgaacacctcgcgcaggaccgccacgctgcgagggagggcttctcgggcgcctctttcgagcttccccaggagacgctcgcggctggtgacgaattctcgtctaacatcgcccccgcgaccactgttgctactggggatgaaccaccacctgaggaggcagcacctgtggaaaaggatcctttcgcagccagtgacctgattaacaacaaaccggaggaggcattggtgggtgggttcaaaaagaacaaagagactgcccttgtggttgctgatcctgcagctgcgctagctggattggaggttacgactttgccaccagctgaggcgactaagccgacatttattggagttgaagggtttgagggtgattatggtggcattgagtttggcaacgatgagacttcacttgctgaggcatttgaagggctcaatgcgccatttggtggtggcctggatgcttctgagtttgttacaacaacgaagaaggatcacaaggacaggaccgtcactgggcttgagttgctagtagcaagtgggcagccaccgaatgcagctgctggtactccattggagaatctcttgctgactaagcgcgcagaaatgaccgctcctgagttgtttattgctgaggagatcaatgcagaattcaaggagtctattcttgtgcgtgttggattgaagggtacaatcttcctgcggaccttgccactgaataaggcagcgggtaaggagacagagttctcatttcgtcttgagggcacatcaggaatgaagagggctgcattgcagagtaatgtcttgagtaacctacaaaatggactgttccatgtcaggaccgtgtcgaaagaagaacccattcccctcatgaagtacagcttcctgccgaagcactcacctctccctttgaggatgcgcctagtgaagcgccatagtggaacgttactctcagtgatgatacagtacgcatccaatccaatgctgccccagcctctgagcaatgttacattcgttgttaagcttcctgtggatcctactctgctcaatgtttcacccaaggctgtgctaaaccgggcagagaaagagcttagatggcatatttcagacattcccctgaaaggtccagccggcaggctcagggcgcggatgcctgttgaccaagactccaaagatggtgagctagaggttgttgggatggtgaagtttgcttaccaaggtccattcacattgtctggcattaaactatgcccagccactgatggcattgcccaatttaatgaagttggccataccttctccagtgggagttacctgtgcatttgataggtgctgctgcgcagaagcaggccgcttgctgttgactgtcaggaggatgcaggtgacaattgagct

SEQ ID NO: 348 - DNA, 1707 bp, Zea mays
ataaatgcgtccgcaaatgccgccagtccgctctctctcgctgcgcctccgcccccaaatctgcgcaaaggcctcccactcaaattcctcgcggcgaccgatatggttgggagcgtgggcaacgggctggccgatctgggtgcaagagccgtctccatgaacggggcaaggaaggcgctgcgtcctaccgaggcggcggccgccgccgccgccgcggagacgctcccgatggagctggatccgtcggaggccttagttgccgctgcggtggaggcgaagggcgaggaggctgccaacgggaggagggagttcgtgatggggaggaacgtacacacctcctgcttcgccgtgaaggagcccgacgcggacgacgaggaaaccggcgagcgggaggcaaccatggctagcgttctcgcgctctaccgccgctcgctcgtcgaacgcaccaagcaccacctcggttacccatacaatctggactttgattatggtgcactgacccagctgcagcacttctcaattaacaaccttggtgatcccttcatcgagagcaactatggtgtccattcccggcagtttgaggttggagtgctggattggtttgctcgcctctgggagttagaaaaggacgagtactggggatatattactaactgtggtacagaaggaaatctgcatgggattcttgttgggagggaggtgttccctgatggaatattgtatgcttctcgtgagtcccattattcagtattcaaagcagcaagaatgtacagaatggattgtgtcaaagttgacacccttatgtctggggaaatagattgtgctgatttccagagaaagttattgcagaaccgagacaaacctgccatcattaatgttaacattggaacaactgtgaagggggcagttgatgatctagacttggttatcaaaacccttgaggaaaacggctttaaagatcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcatataaatgccctttctagcaatgtggagtatctggcgtcaagggatgcaacaatcatgggaagcaggaatggccatgcccctatcttcctctggtacaccctcaacaggaagggctacagaggctttcagaaagaagtccaaaagtgcttgagaaacgcacactacctaaaagatcgcctcaaggaagcaggaatcggagcgatgcttaacgagctcagtagcacagtcgtgtttgaaaggccaaaggatgaagaatttgtccgaaggtggcagctggcttgtgaagggaatatagctcacgttgtggtgatgcccagtgtcaacattgacaagctagactatttcctgaatgagttagtggacaaacgggcgacttggtaccaggacgggataagccagccaccctgcattgccagagacgtaggtgttgagaactgtctctgtggccttcacaagtagcgagccttttgctttgcaagtgggttcactcttgagtcgagttaaaaagtgttatgttgtactgtgttcattcttgagttgagttaaaaagtgttatgttgtactgtgttcgtgcgttct

SEQ ID NO: 349 - DNA, 548 bp, Zea mays
gaaggcataagccatcagtttccaccgcacgtccgcaccccctctccggcgtgccgacggtatccatggcggcggtggtgcgcggcgtcttgaggggcatcaaggagaagggactcaccaacttcatccgcgacgtccgcgacgaaggatacttcaaatgccttctggacgggaaccttttgcaaacgaaaatccacaatattggcgcaacacttgtaggagttgacaagtttggtaacaaatattatgagaaactacatgacactcagtatggaaggcataggtgggtagaatatgcagagaaaggtcgttacaatgcatcccaagtgcctgctgaatggcatggatggctgcaccacatcacagatagcaccggggataagctgctgaaccagaagactgctaggtaccttgtagagcacaagcagaactactccggtgagggtgaagagcttatctaccactccaaggggcatgctttgaatccgggacaaagggactggacgaggtatcagccctgggagccaaagaaagagcaagcctagtag

SEQ ID NO: 350 - DNA, 897 bp, Zea mays
ggcagtgatcttcttgcgtcgaaggcgaggccggagcgtcggtttgagcgctcgtgcgatatgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccagggatcatgttcaacgacatcacggagctgctgctgcggccgggcgtgttcagggacgccgtggacatgttcgtcgagcgctaccgcggcatgagcatcgcggccgtcgcaggcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcgagcgcgcaggagctaacgtggttgagtgtgcatgcctcattgggcttcccaagtttaaggatttctataagctcaacgggaaaccggtttacatcctggtggagtcccgcaaataggacgcagtaaatggtcagacaaaaaagctttctagcttcccgtccaaagaagctcacaacttcactcatttgcacgcgcaagcaaggtggtatgggggcaccgagaaactccgcagtaatctgtgttgaggccacggccagatgatgctatgtatcttcatggagagggtgatggactgggtgaaacgtagt

SEQ ID NO: 351 - DNA, 3398 bp, Zea mays
tcatcccctatccgcgtaccgccccccgggcgatcgatcgaacgcggctagcctcgccgccgacccgtcgaggcagccatggcggagatcgccgaacgggccgtcgcgggcgaggtgccggaggagccgcggccgccgcacggggaggaggacgacgaaggggaggaggagggggacgtgtgccggatctgccgtaaccatggcgacgaggatcacccactgcggtacccgtgcgcctgcagcggcagcatcaagttcgtgcaccaggactgcctcctccagtggctcgaccatagcaactcgcgccagtgcgaggtctgtaaacatgcattctccttctcacccgtgtacgctgataatgctccgacaagacttcctttccaggaactgatggttggtgttggaatgaaagcatgccatgtgtttcagttcatccttcggcttgcctttgttctctcagtttggctcatgattatcccattcataacctattggatatggcggttaacatttgtgagaagtctcagtgaagctcaaaggctgttcctcagtcacatcagcgctcagttgatccttagtgattgccttcatgggttccttctctcagctatcattgtccttatatttcttggagccacctcattacgagactacataaggcatttgcgtgaacttggtggacacgatgctgagagggatgatggtgggcgtgaaaggcatggtgctcgggctgttaggaggctagctggtcctaataatagggttcctgcagatggaaatgttgatgaattagcagaagcccaaggaatcggtgctggtgaacttctgaggagaaatgctgaaaatgttgctgctcgattagaacgacttgaggctcaggttgagcagatgcttgatggtctagatgatgcagatggtgcagaggacgttccttttgatgaacttgttggtatgcaaggccctgtcttccacttggttgagaacgcaataacagttttggccagcaatgctatattccttattgttgtgatctttgttccattctcattgggaaggattatcctgtactatctatcctggtttttctcttcggcttctactcctatgctggcaaaagtgatgcccttcacagaaacagctatttctatagctaatgatacattaaagagcgcacttaatgttgtgaagaatttttcttctgacagtaataatgaaggtgttatcgggcatgtgattgaggttgttactcaatccttgaagataaatgccactggacttagtgtaattcaaggcactgggaagaacagtctgatgaaaggaacaacaattgcctcatcttatctttcagatctgacaactcttgctgttggatacatgttcatcttctgtcttgtgtttttgtatattggatcactggctttacttcgatatgccaggggagaacgttttaccattggaagactctacggtatagctactatattagaggccatcccttctctatgcagacagttctttgctggaatgaagcaccttatgactatggtcaaagttgcattccttctggtcattgagcttggtgtatttcctcttatgtgtggttggtggcttgatgtttgcactctaaagatgctgggcacaacaattgcgcagagagttgaattctttacaatgtcacccttggcgagctcatctatccattggctagttggtattgtgtatatgcttcaaataagcatatttgtgagccttcttcgaggggtgctgcgcaatggagttctttattttctgcgggaccctgctgatccaaattacaatccatttagggatttgattgatgaccctgtgcataaacatgcccgacgagttcttttgtcagttgcagtgtatggaagtttgattgtgatgttagtcttcttacctgtaaaagtggccatgagagtagctccttcaatgtttcctctggacataaccatatttgacccattcactgagattccagttgatgttcttctgttccaaatatgcatcccattcgctattgaacatttcaagcctcgtgcaaccattaaagctcttttacatcattggttttctgtggttggttggggccttggcttaaccgatttcttactgccaaaatctgaagaaaacggtgggcaggaaaatttgaatgcaagggcagaaagaagagacagaggacatggtgggagggaaatggtcgccccacaggttgaacaactcatgatacaacatgttgccgcagaagataatggcaggggggattcaaatgaagccaatgatgtaactgaggactctgatgtagatgaccagggagactctgagtatggctttgtgcttcggatcgtgctcttgcttgtactggcatggatgacattactaatattcaatgctggaatgatagtttttcctatctcacttggccgtctggtttttgaggctgttccccgcctgccaatcacacatggcatcaagtgcaatgatctgttctcctttagcattgggtgctatattctctggagtgtggcagctgggaccagatatgcgattgattacatcacatcacgacagctggggtttttggtacaacagatctgcaagtggtgctcaattgttttgaagagctctgttctcttgtcgatatggatctttgttattcctgtgctgattggactcctttttgagctgctggtcatcgtacccatgagggtgcctattgatgagagccctgtcttcctattgtatcaggattgggctctggggttaatattcttgaaaatatggactagactggttatgttggatcagatggcacctttggttgatgaaagctggaggtcaaagtttgagagagttagagacgatggcttctcccgtttaaagggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgccctcttcttttggggcaagagatttcatgtctggttcaccaacctccacaactctatcagggatgaccgctatctgattgggcggaggctgcacaactttggcgaggactcacactcacctgagcggagtgaatctggagcaagtatagggtcagatgatcaggacagagatattgtactgcgagatcaggaagaggaagtggggttgaggatgaggcgcaataatatgcatgcaaaccaacaacctaggtttgctttataagtaggaagtagttttggacaaagagctcataaccatggtataagcttcggtctgcaggttct

SEQ ID NO: 352 - DNA, 469 bp, Zea mays
ggatacgaggaggggaaggaacaagatgagttccaagaaagcaacaaaccggggtttggtacttgtccttctgctcgttgttttgcctgcgctttcggtcgccacgcacgcaggagaaagagagttgccagatgaaaaggatcacaagggccattccactgttgcttctggaaaggggggaacggcttcaggagatatggtgaagacgaatgactatgggcgctacgatccaactccggcgttctccaagcctcgctccaagcttatacccaactaattacactcacacttgctgcatctacatgcttactatatggatggcatgcatagaaatatagtcctgtagagaatataatgctcactttgtttttttttgtcgcgttctagttcaaaaataaactaatcggcgataaatatttaagaacggaggtagtatctagtatctagccttgacgcctctactgaatgt

SEQ ID NO: 353 - DNA, 1025 bp, Zea mays
ggagttgcctccttcaagctactctaatgtcctttctattcaagtctagcaatggcggcaccactgaaaaaatcccatccccagaagaacagcgagaaaaaataaatgaattacgcaaggagcttggtgaacactcatcagcagccattaaagacttcctttcagatgcctcgttagcgagatttcttcgagcaaggaactggaatgtgcagaaagctagtaaaatgatgaaagcagctgtgaagtggcggcttgcattcaaacctgaaaacatctgttgggatgatattgcagaggaagcagagactggaaagatatatagggcggattataaggacaaacatggcagaactgttcttgtattgaggcctggcttagagaacactacctcagcaataggacagatcaaatatctagtctactctctggagaaagcaattatgaacctgacggaagatcaagagaagatggtatggctgacagatttccagtgctggacattgggaagcacaccactgaaggtgacccgtgagactgtcaatgtcttgcaagactgctatcctgagaggttggggcttgcaatcctttacaaccctcctaggatatttgaatcattctggaagatagtgaagccgttcctagaccatgagacccgcaagaaggtgaagtttgtgtactccaacgacaaggagagccagaagataatggcagaagtctttgacatagaggagctcgactcggcattcgggggaaagaacccagcgacatttgagtacaacagctacgcagagcagatgcaggacgacgacaagaagatgggatcttcgcacggctcagccaatagcttgcttggatcagctgggaaggaggctaatggcgcagactcggacgcctcaagcgaggcctccttctacagtggaactgactctccgacacatgagaacggtgaacacagcatcgcgaagaagaatggttgagctgagctgaactgctttgattgctcaaactgagggagctgactaatg

SEQ ID NO: 354 - DNA, 953 bp, Zea mays
actctttcgttgggccagcgctgcatgcttccttgcttgcttttttgtcgcgcctgcttctcccccctctgcctcttggtgctgcttcctggtgggggaagggaaggagaaggctgtgtgcgtcctgcgccgataacgcgatggtgtccattgtcactgaggtatgggcgctcgctggatgcggcccggcgtccaaggcggcggcggtagcggtagcggcgcaggagttgccggcgcagcatccttctcctgccgcagcgggaggagggaaggccaagaagagagccgtgccagtgtcgttcagaggcgtcagcagcggcggtggtcaggaccaccagcgtgaggccgccgccgtcgtcgtcgggcggcggcgcggcctcgcgtcgtgcgcgctcgccgccgtcgccgcctcgttctccgcccgcgctgaccgccccgcgcgggcgcttgtcctcgaggaagacgacgacatcgagctgctggagcgcgtgaaggaggacaggaagaagcggctgcagaagcagggcatcatcagctcctccggcgccgagaccgggtatttgcaggacctcatctacaggctcagcaaagtcgggcaggccattgacaacgacgacctcccagccgcgagcagcgtgctgggaccaagctcagacgcccagtgggtgcagaacatcaatgcagctttctccaagctcagctcaagcccggagcagaggaacgtggtcgacagcttcaacagctcgctggccacactgtttacatcagtgagcaagctcgaccctgaatcctccaagtcggcgttcgtgtcgtccgcgacggcgttggagaaatggatcgcgttagctggactgggcggccagctcaagggctactgatgcgtgcgaggggaagagaagcactgggttgttctatgtttgggtccggcatttgtgaatctcctgaagaggtag

SEQ ID NO: 355 - DNA, 996 bp, Zea mays
agaacaagtcgcagccaaagagccccgtctcccagcgaagcttgagcttgcatccatactaccatgtcttccatggagctgctccacgccgtcgtcccggagaagcagagcgaggaggaggtcgcgcccgcagcgacgaccacgagcagcagcgccaccgccacgggcggggacgagggcgcccacgtgctccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgcgtcaagctgcccacccctcctcctcctcctcctgctgtaactgtcccggcagcagtgcccgtcccggaggcccccgccccgaccaccgtcgtcgtcccgccgctgccgccagtcgaggtcggccgcgagccggccacgtcatccaccgccgcgtcctccgacggggcggcctcgagcagagtccaccggtgctccatctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcgtgaaaccgctgcgcgcgcgggcggcggatctcatctcatcacccgtccaagattttggtccgcagctgccgagttcagcggtggaagtggaacacactattctag

SEQ ID NO: 356 - DNA, 1850 bp, Zea mays
tactcagcctactccgtcttcccctgtctagcagacaccctcttcccctctccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagtggaggtattgtggttactaatgatggtaatgccattttgagggaaatagacattgcacaccctgctgccaagtctatgatcgaactaagtcgtacacaggatgaagaagttggtgatggcactacatctgtcattgttctagctggagagatgctacatgttgcacaggcattcatcgacaagaactaccatccaactgttatttgccgagcatataccaaagcgcttgatgatgctattgctgtacttgacaaaattgcaatggctgttgatgtgaatgatcgtggggcaatgctaggccttgtgaagagctccattggtacgaaattcactggccagtttggtgaccttattgctgaccttgctattgatgctactacaacagcaggtgttgaccttggtcagggtatgcgtgaagttgatatcaagaaatacattaaagttgaaaaggttcctggtggtcagttggaggattctagagtccttaaaggagttatgatcaataaggatgtcgtggctcctgggaaaatgaggagaaagatagtaaacccccgtatcatcctgttggactgccctgttgagtataagaaaggagaaaatcagaccaacgctgagttgatgaaggaagaagattggcaggttctgttagagatggaggaagaatacataaagaacctgtgcggtcaaattctaaaattcaagcctgatttagtcataactgagaaagggctcagtgatctcgctatccattatttgagcaaggctggggttagtgcaatccgtagacttaggaaaactgacaacaacaggattgctaaagcttgtggagcagttatagtgaacaggcctgaggagctccaagaatctgatgttggaacaagagctggcctgttcgaggttaagaagataggtgatgagttcttttcctttattgttgactgtaaagatcccaaggcatgtactgttctgttgaggggagcaagcaaggatgtattgaatgaagttgagagaaacctgcaggatgccatgtccgttgcaaggaacattttgaaaaatccaaaactccttcctggaggtggcgctacagagctgactgtatcagcaacactgaagcaaaagagttcttcagttgaaggtgtggaaaagtggccctatgaagctgctgctctagcatttgaggcaattccaaggactttggcccaaaattgcggtttgaatgttattaggataatgacacaacttcaaggaaagcatgctaatggtgaaaatgcgtgggttggcattgatggaaggactggtgatattgtcgatatgaaagagcgaaagatctgggattcctacagtgttaaagcacaaacgttcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgattccagagtagaggctgtggcgaacctgcactggcaaagttatttactagtgtcaaggtagcacttcgagcagagttc

SEQ ID NO: 357 - DNA, 1287 bp, Zea mays
tagaaatcctgtcctgtcgctccctccaccacacactgaactgaacacgcgcgcgcgcacgccattcccctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcgcgctcaccgcggtgggccgcaccctggtgccggggcccgcctcgggcgcgtcctacgccgactacgtgctgcagcaccaccaggacgcgctggtggcggcgtggccccgcctgcacgaggccgtgcttgaccccgcggggcccgagccgttcgcgcgcgccaacgccggggtcaccgcctacgcctactacggcaaggaccaggacgccaaccgggtcatgctccgcgccatggcgggggtatccgagcccttcatgggtgccctcctcgacggctacggcgccgccggcgggtttcgcggcgtcgccacgctcgtagacgtcgggggaagctccggcgcctgcctcgagatgatcatgcgcagggtccccacaatcaccgagggcatcaacttcgacctccccgacgtcgtcgccgcagcgccgcccatcgccggagtgaggcatgttggcggagatatgttcaagtccatcccctccggtgatgccattttcatgaagtgggttctgacgacgtggaccgacgacgagtgcacggccatcctgaggaactgccacgccgctctgccggacggcggcaagctcgtggcctgcgagccggtggtgccggaggagacggacagcagcaccaggacgagggcgctgctggagaacgacatcttcgtcatgaccacctaccggacgcaggggagggagcgctccgaggaggagttccgccacctcggcgtcgacgccgcaggcttcaccgccttccgagccatctatctcgaccccttctatgctgtcctcgagtataccaagtgatctccactccatccgcccaaatctccttgcgagttgaatagcagatag

SEQ ID NO: 358 - DNA, 1829 bp, Zea mays
tatttcgatcgtggtgtgagtctccgctttcccacttggcgctagggtttcccccctctcatttcccctcctcctcctgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcagaaaatacaaaggttgttattgatcatggagctgttcctatatttgtgaagcttcttgggtctggtagtgatgatgttcgtgagcaggctgtgtgggctttgggtaatgttgctggcgattctccgaagtgccgcgaccttgttcttgccaatggtgcgttgatgcctctgctagcccagttgaatgagcatgctaagctctccatgctgcggaatgccacctggactttgtctaacttctgcaggggaaaaccacagccatcatttgatcagactaagcctgctctgccagcacttgcacgacttatccattccaacgacgaggaagttctcactgatgcatgctgggccctgtcatacttatctgacggcactaatgataagatccagtctgtgattgaagctggtgtttgcccccggcttgtggagctcctcctccatccatcaccatcggtgcttatacctgctctacgaactgttgggaatattgtcactggagatgatttgcaaactcagtgtattattgatcatcaagctcttccccgcctcatgaatctgttgacgcagaaccacaagaaaagcattaagaaagaggcatgctggactatttcaaatattactgctggaaacaaagatcagatacaggctgtcataagtgccggtatcatcgctcctttgttgcaactgcttcaaacagcagagtttgatatcaagaaggaggctgcttgggccatctcaaatgctacctctggtggttctcatgagcaaatcaagtacttggtgtctgagggctgcatcaagccattgtgcgaccttcttgtctgccctgatccgagaattgtaacagtttgtctggagggtcttgagaatattcttaaagtagggcagcatgacaagaccatgggtgcaacaggtgacactaacgtcttagctcagatgattgatgaagcggaaggcctggaaaagatcgagaacctacagagccacgataacaatgaaatctatgaaaaggctgtgaagcttcttgagacatactggatggaggaggaagatgacgcaatggctactgccggggaagctgctcctgctgtttttgactttaaccaaggtggcaaccctcctgctgctggtggtctgaacttcaactgatacagtctttgatcagaatggtgttaatgccttcagtgatgggcttggcattg

SEQ ID NO: 359 - DNA, 1158 bp, Zea mays
ccactctccagtctccactagcatcagtcgccgccgcctatcctcgagcgccatttccatcaacagcatccgcctctggcaagctagcgacagcaactcatggcactccgcgcgctcgacaatacgaagcccgccgccgtcgaggagcggcccaagaaggtggctaaggtgggcgtccccgccgccgccgccaaggccgccgcctcccccgggagtggcggcaagaagaagaaggggaacgacgagaactcggcgccaagggccacggccgcggcggcggagcaggccgtggagtacatctcgtcggaggagctggaggcggcggccagccccaaggccaaggccgcggggctggtcgcggacctggactccaaggactgggtcaggacctgcgaggcgctcaacgacgcgcgccgcctcgcgatccaccaccccgcgctgctgaacccgatcctggagaaggtggtgctggcggttgtgaagacgatgaagagcccccgcagcgcggtgctcaagacgtccatcatggcctgcgccgacatcttcagctccttcggcaacctgctcgcctccgtctccgacgacgccttcgacaagctgctgctccagctcctgctgaaggcgtcccaggacaagcggttcgtgtgcgaggaggccgagaaggcgacgcgcgcgatggcggcgtcgatgccgccgctgccgctgctgaagaagctcaaggcgtacgtccaccacgccaacctcagggtcagggctaaggccgccgtcgccatctcccactgcgccgcccggatggacatcggcgcgatgaaggagttcgggatgtcggcgctgctgcagctggcggtggagctgctgaacgaccggctgccggaggcgagggaggccgcccgcggcgtggtggcgtcgacgcacgcggccttcgtcaaggaggccgccgcgagcggccaggaggacgacgctgccgcgtcctgggagagcctctgcgcgctgagcctcccgcccatctccgcgcaggccgtcgccaagatcgctgccgccgccgccgcctcctcgcagtagccacggcacgcgtgcggacgtgcgccgctggcgttgtttttgggggtcgtctggttcggttcagaagtagcgctcgtgagtcttcagacagagtag

SEQ ID NO: 360 - DNA, 1691 bp, Zea mays
cggcgatgaagatgcatcgcttcgctctgcgtggcctggggtttctcgtcctgtggatgctgcattgcggaagcgagctcgccgcggcggtgcctccagatggctggtacgattactccgcctacaccgactgcaggggccagccggagccggcgctgtacaacggaggcattctcaagttcggcagcagcggcggagacccggacggataccgcacgacggagaccggcgtcttctccccggcgttcgtggtgtacaacctcaacaagaccaccatgtacaccttctcatgctgggtgaagctggaaggcgcgtactcggctctgatcaccgcgaggctggcgccggacaacaccggcgccaggtgcatcgccacggtcgttgccaggagcgactgctgggccttcgtcaagggcggattcgtcctggactggccgacgcagacctcggtcatcttctttcagaatgctgacaagacgcccatgaagatcaccgtggcgagcgggtcgctgcagccgttcaccacggaccagtgggcgatgcaccagcaggataccatccggaagaggaggaagcgcgtggcgaccatccacgtggccgacccgcagggcgcccgcgtggtgggcgcgtccgtgtcggtgcagcagacggccaaggacttcccgatcggttcggcgatcgcgtccaccatccttgggaaccaggcgtaccagcagtggttcgtggaccggttcaacgcggcggtgttcgaggacgagctcaagtggtactcgacggagcccatgtcggggcagctgcgcttcgacgtgccggaccagatgctggcgttcgtgcggtcgcaccgcgtgatggtgcgcggccacaacatcttctgggagaaccaggacgcgacgccccggtgggtgaagaacctgacggcggacgacctccgcgccgccgtcaacacgcgcatccagagcctcatgacccgctaccgcggcgagttcgcgcactgggacgtgaacaacgagatgctgcactacaacttctacgagcagcggctggggcccaacgcgtccgcggagttcttcagcgtggcgcaggacgccgacccgctggccacgctcttcatgaacgagtacaacgtcatcgagacctgcgacgaccccttctccaccgtcgacacgtacgtgtccaagctcaaggacctccgctccgccggcgccatcctggaagggatcggcctggagggacacttctccaagcccaacatcccgctcatgagggccatactcgacaagctcgccaccctggggctgcccatctggttcaccgagatcgacatcagcaacaagttcgacgcgcagacgcaggccgcctacctggagcaggtgctgcgggaggcatactcgcacccggccgtcagcggagtcatgctgtggacggcgctgcaccccagcgggtgctaccagatgtgcctcacggactggaacctcagcaacctgcccacgggggacgtggtcgaccgcctgctcaacgagtggcggacgctgcaggcggccggccagaccgacgcgcacggcgcctacagcttcaccggctacctgggggagtacgtcctcactgtcagctacaacaacaggacgacgcaatccaccttctcgctgtcgccgggagacgagaccaggcacatcaacgttcagatgtgatga

SEQ ID NO: 361 - DNA, 1933 bp, Zea mays
aatccactctacatgtcccacgctcagacccgggtccctcaccgccgtctctcccgctccggtaaccgcctccacctccgcacctgacccctccgcctccttgaaaattccttttgctgctccaacctgcgaagctagttcactgtactcttgcttgcttagaacgtagcgtgcggtggatggggtctgccagcgactttaagaaaggtagatataatttgatgggaagatgaatggtgcagaggaggaggagccgcctcacgtcagcagcatgcccaagacacaagacggtgttaccaagcccagtctagggaaagagcccatcccagggagcgagctctggacggatgggctcatctgtgcttttgagctggtcaagagtcacaggaagcctgttcagcacaaatcatggctggcaactgagcagatacaggagaagggccccactatgtgcacgaggaagcactcaagaaggaatgggcaccagatcactgagccgaaagtggatgagagcattgtgttggaaaacccccagcagactgatttcagtaacgatccttcagtgctcaaagataggccattgtatgctggggagattttggatcataaatgggtgcctattggatggaataggatcgccgagctggtcctgagggttcagtcagactccagctgggagaatgagttgatggagatgagtgatagcgaggatgattacaccgtggctgatcttgcagctccatactggcagcgccctgtgggacctacttggtggtgtcatgtcaccgcaggccatccttcaatagatgcatggttgaatagcgctcactggatgcatcctgccatcagaattgcactgagagatgagagcaaactgataagcgaccggatgaagtacctgctctacgaggtcccagttagagttgcaggagggctgttatttgagcttcttggccagtcaataggagacccaaatcatgaagaggaagatatacctattgtgcttaggtcttggcaagcacaaaattttcttgttacaacaatgcatgtcaaaggcccttcatccaatataaatgtgttaggagtgactgaagtgcaggagttgcttcttgctggtggaagccaaacacctagatcagtgcatgaagtaattgcacatttggtcagccgtctttcacgttgggatgacagattattccggaaatatgtatttggggaagcagatgaaattgaattgaaatttgtgaataggagaaatcatgaagatcttaatcttgttagcatcatactgaatcaggaaatcagaaggttagcaacacaggtaatcagggttaaatggtcacttcatgcaagggaagagatattaattgagcttctcagacatttgaggggtaatgccacaagagctattctagagagtattagaaagtgtacgagggacatgttggaagagcaggaagctgtgcgcgggcgcttgttcactattcaggatgttatgcagagcactgtccgtgcatggctacaagatagaagcctcagagttacacataatctggcaatttttggcggcggtggcatggttttatccataatcactggccttttcggaatcaacgtcgatggcatacctggagcgcagaacaccccctacgcttttggtttgttcgcgggacttctcttctttgtagggatcgtcctaatcggcatggggatgctgtatcttgggttacagaatccagttaacagtgagaaggtgaaggtgaggaagctggagctccagcacctggtttcgatgttccagcacgaagcggagcagcatggcaaggtcagggaaggtgttagccggcatggcgcctcgccgagttcatccacggcctctgatgaagggtacattcttatctcctgagatgggagatttatttgctgacgtgca

SEQ ID NO: 362 - DNA, 674 bp, Zea mays
gttccctgtctgcaatttcgggcaagcctaggggcccaagcggaaaaggtaagctgactccggcggcggcggcggcggcgatcatggccgcgcagagggagaagtccgcggacgtggcggtcgccccagcacacggcgctgcggtttcggggtctccttcttcctcatccggaggcccggcagtgtcggcgtcctcgtcgggagaccggtggagcgccgcgatcggtaaccttggggagctcggcgccaacgtggacgcgctgcagaagctgctcgggcggaaagccgtcttcgtagacgatgacatcttctccaaggcctccctcgccgccgaccaggcccgcaccattaaggttcttgaccagagggtgcagtctctggaacgtgaactcgatgctgccatttcagcagctgctcgagctcgtgtagagaaacgtcaggcggaagctgcgcaacgagctgcagagttacgcacacgggaggtcacagaagaactggagaacactgctaggctgtttgagctgcacatggaggagttgcggctgaagcaagaggatattgcgaagaaagatagcgatatcaaggtgttagaagcgatcatacgaacccttagtagtaaagatgatgatggatccagcgaataattgccatgcacagggagcgaataaattgtt

SEQ ID NO: 363 - DNA, 1181 bp, Zea mays
tgcgtttcttctcctgttcatcacccgtgcgtgctctctctctctctctctctcgtgcggcaactgcgaggccgccgacgcccgacggcagggtgcccaggccttcttcggtcccatcgcgaggccatagttgcatcattcgcctgagacgactgcccagcaccaggactgatctcctcactaggggcgtagaggtgaagagaagaacttgacaatgagcagcataggcacaggttacgatctgtctgtcaccaccttctccccagatggtcgcgtcttccaggtcgaatatgctaccaaggccgtcgacaacagcgggactgttgttgggatcaagtgcaaagatggcattgtcctgggtgttgagaagctggtaacctcaaagatgatgctggaagggtcaaaccggaggatccattcagtgcaccggcactctggcttggctgttgctggtttagcagcagatggcaggcaaattgtttcaaggacgaagtcagaagctgccagttatgaaaaggtctatggagaacccattcctgttaaggaattggctgatcgcgtggcaagttatgttcatctttgcacgctgtactggtggctcaggccttttggctgcggcgttattcttggaggttatgatagggatgggccacagctctacatgatagaaccctcaggagtttcttataaatactttggtgctgcattagggaaggggagacaggctgcaaaaactgagatagaaaagttgaaactttcagagcttacgtgccgggaaggcattgttgaagttgcaaagataatttatggagtacatgacgaagcgaaggataaagctttcgagttggagttgagctggatctgcgatgaatcgaaccaccagcatcagaaggttccaaatgaactgttggagcatgccaaagctgctgcccaggctgctcttgaggagatggatgccgactaagagacacgatgatttgcccaaacttggtgttttcggtggtgttgatatctctgatccctttgggggggacccactaggggtaggcacatttcaaccgaaaaccgagccgaactggaatcaagtttttttcgttttttcgattcggtgtcggttttcctttcttacgaaccgaagagatcggctcggcttcggtttctatttgctggacaccgataca

SEQ ID NO: 364 - DNA, 1367 bp, Zea mays
caagcccttctcaactcaagtctcatctcatcatctcccacccacctaaactaacagcccacggccaacttgcaggacgcatgggcgcatggcatgtggcggcatataaatggaggcagccgagcgcgcaaggtctccacacgcctctcttgctcaccattctcttctaaccagccaagccaaggcgcatctagcgagctgagcagcaatggcggctgctacttcttctaggcgccctgcagctgctctgctggtcctggcagcagccgtcgtggccctggcggccgagggggccaggtacccgccgctggcgccgggcctgtcgttcgacttctacaagaagagctgccccaaggcggagtccatcgtgcgggagttcctggcgtcggcggtccggcagaacgtggggctcgccgcggcgctgatccggctccacttccacgactgcttcgtgcagggctgcgacgcctccatcctgctggacgccacgcccacccagcccagcgagcagcagtcgccgcccaacctcacgctccgccccgccgcgttcaaggccgtcaacgacatccgcgcccgcctcgaccaggcctgcggccgcgtcgtctcctgcgccgacatcgtcgcgctcgccgcacgtgaatccgtcgccctgggtggcggcccggcgtacaagttgccactgggcaggcgcgacgggctggcgccggcatcgaacgccgccgtcctagcggcgctcccaccgccgacgtccaaggtgccgacgctgctgtccttcctggcgaagatcaacctggacgtgacggacctggtggcgctgtcgggcgggcacacggtgggcatcgcgcactgcagctccttcgacaaccggctgttcccgacgcaggacccgacgctgaacaagttcttcgcggggcagctgtaccggacctgcccgaccaacgcgacggtgaacacgacggccaacgacgtccgcacgcccaacgccttcgacaacaagtactacgtggacctgctcaaccgggagggcctcttcacgtcggaccaggacctgctgaccaacgctaccacgcgccccatcgtcacgcgcttcgccgtcgaccaggacgccttcttccaccagttcgtctactcctacgtcaagatggggcaggtcaacgtgctcacgggctcccagggacaggtccgcgccaactgctccgcgcgcaacggcgccgctgctggtgacagtgacctgccgtggtcgtccgtcgtcatcgagaccgtcgcggacgccgccggtagcctcgtgctctagataataagcaaataagcagtttgaagcttgcttcgcatgcatgttgcaacaaataagcagctagtagcgatcg

SEQ ID NO: 365 - DNA, 523 bp, Zea mays
cttcagacttgagtccacccagccagccagcaactgcaaggcagcacccaagacacgcagcgcaggcgcagcccagccagattcgacccgagttcacgacgagagcacgagatggcgatgcgaaccgcgctgacctccctccccgcgcgcctgcgcgctcctgcgccccccgcggcgacgggcggccggcgcctcctcagcgacgggaaggggcgcgtgctcagcgaggaggagcgcgccaaggagagcgtctacatccagaagatggagagggagcggcaggagaagctcaagaagaggctcgagcaggagaaggccgactccgacaaggccaagcccgccgacgccgacaagaaggccgagggatctacctagctaggattggcatggcgctgttggaaggcaatcacttttcgcatgtatccgaatccgatggtcagctttgtgaatgaataaattctgtaaaacgtcaacagcactggatatgctgttgcttcggttgcttgcatgttgaagttgaaga

SEQ ID NO: 366 - DNA, 1527 bp, Zea mays
aaaggatccctgccacagagacatcagagagcggtcctccttgtgagtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcagggcgcgcacgcggtgcggctgggcaacgaggcgtcgatccggcagcgcctggccgtggcgcgcggcgcctactacgccatcacgttcagcgcggcgcggacgtgcgcgcaggcggagcggcagcggctgaacgtgtcggtgagccccgagtggggcgtgctgccgatgcagaccatctacggcagcaacggctgggactcgtacgcctgggcattcaaggcgaagatggacgcggtgacgctggtcatccacaacccgggcgtggaggaggacccggcctgcggcccgctcatcgacggcgtcgccatccgtgcgctgtacccgcccgcgctcgccaggcgggcggggggaaacaacctgctcaagaacggcgggttcgaggagggcccctacttcctgcccggcgcgtcctggggcgtgctcgtcccgcccaacatcgaggacgaccactcgccgctccccgcctggatgatcgtctcgtccaaggccgtcaagtacgtggacgccgcgcacttcgccgtgccccagggcgcgcgcgccgtcgagctggtgggcggccgggagagcgcgctcgtgcaggaggtccgcaccgtgcctgggtggacctaccgcctcgccttcgccgtgggagactcgggcgacggctgcgcgggctccatggccgccgaggcctacgcggcgcgcgccacggtcaaggtgccctaccagtccaggggcaccggaggatacaagcgcgccgtgctggacttcacggccatcgccaaccgcacccgcgtcgtcttccagagcaccttctaccacatgaagcccgacggcacgctctgcggcccgctcgtcgacgacgcctcgctcgtcggcctgcgcaagaagaagcccgcgcgccgcctcatgcagctcctgtaagcgctgcttccacgtgcactacgcccggacggaccgcgcaagcgatggtgtaatacggctggtatgtgttttttggtttggtgtgtgcgtgcgtggtatacgcgtgccgtgcgcgccctgtggctgtggctgcagtggcgtcgcgttgggtgttttcttgttgtgacgaagaaaaaagggtatgggttggggtggtccgctggccggcgcaccggggttttaatcaacttatattaacctgatgaaggtgaaggtgaagggtaccttt

SEQ ID NO: 367 - DNA, 1169 bp, Zea mays
cgcccatgtccgccgccccgccccgccgcgtggtcatctgcggcggcggcgtggtgggcgcgtgcacggcctacttcctcgccacccacgccgcgtcccccaccgtcccgacgctcgtcgagaggtgcgccccggcgtgcgccgcctcggggaaagccggcggcttcctggcgctggactggtgcgactccaccccggcgctctccaggctcgcgcgggcctccttcgcgctgcaccgccgcctggccgacgccctcggcggcgccgacgcctacggcttccgccccgtccacaccctctccgtcctgctccccccgcaccccgccgcctcctcctcgccgccgcacccgctgctcccgccctgggtcgacccctccgcgtccgccgccccgccgagggagctcgggacccccgacaccaccgcgcaggtccacccgggcctcttcaccaaggccgtcctcgccgcgtcgggagccgaggtcgtcatcggcgaggtggagcgcgtcgccgtggcctgggacggccgcgtcgccggcgtcgtggtcaaggggcgcgacggcgtgctggacgccgacgccgtcgtgctcgcgctcggcccgtggtccggccgcctcgaggtggtcagcgaggtgttcgacgtgtccgggctcaaggcgcacagcatcgtgctccggccgcgcgagcccgagaaggtcacgccgcactgcctcttcctcagctaccagccggagcccggcgccaagatgctcgaccccgaggtgtacccgcggcccaccggggaggtgtacatatgtgggatgagcaaggacgagaacccgccagatgacccagcaacgataacaggcgagccagactcgattgcaatgctgcataagatcgcagggaaagtgtccagccagctgaagaaggaggagggcgctgaggtggtcgcggagcaggcgtgctacctgccgtgcaccgccgacgggctgccggtcatcggggagataccaggcgtgaaggggtgctatgtggccacgggccacagctgctggggtatcctcaatggtccggccaccggcgcagccctcgccgagctcatccttgacggcaaggccaagatcgttgatctcgaacctttcagcccggcaaggtttctcaagagaaggagcaggcgtggagtctgatga

SEQ ID NO: 368 - DNA, 1658 bp, Zea mays
ctactcgcatcccaatctccgtcgtcccccgcggccccgcctcactccttacgccgcactccacctccacatcgccgcccacacccgaccgcgtggccggcctcatgtgggagcgcggcaggccgccccgcaagccgcgcccgtccccaatcctcgtgccgccgccaccgtcgtcgccgcctccccgcctgaacctcctcctcccgagatccctcctcgcgctcgccgcgcgcgccatgccgtcgcgccgcccctccccggtcctcctcctcctcctcgcgctctcgctcgccctcctcttccttctcctctccccttccttcccctccacctcccgcttctctcgctccctcagctctggctccgctttcgcctcctcatctccggcgtcaacctccgcctcgcctgcacccgtcaagatctacctgtacgacctgccggccaagtttacctacggcgtcgtccgtagctacaaggctgcgcgtgcgacatctggctccgcgaacgccgctgctactctgcccgacgagcaactgcggtacccgggacaccagcactcggcggagtggtggctcttcaaggacctgctccgacgcaggccgcaggaccgccccgtggcacgcgtggacgacccgagcgacgccgacctcttctacgtgcccttcttctcctctctcagccttgttgtcaaccccatccgctctccgctggcagcaaacgcctctggggcggggacagcgtacagcgacgaggccttgcaagaggagttgctagagtggctggagcggcaactttactggcagcgccacagggggagggatcacgttttcatctgccaggatcccaatgccctttacagggtggtcgatcggatcagcaatgccgtactcctggtttctgatttcggcaggttgcgcagcgaccaggcatctctcgtcaaggatgtcatcctgccctactcacatcgaatcaactccttcaagggtgaggtcggggtggatggtcgcccctctttgctgttcttcatgggcaataggtaccgcaaggagggagggaaggttcgtgatgcactttttcagattcttgaaaacgaggatgatgtaaccataaaacatggaacacaatcgagggagagtcggcgtgcagctacacaaggaatgcactcatctaaattttgcctgcatcctgccggagatactccctcagcatgcagattatttgatgcacttgtcagtctgtgtgttcctgttatagccagtgattacattgaacttccattcgaagatattatagactacaataaaatatcaatatttgttgggacaagcaaagcagtacagcctggatacttaacttcaactcttcgaagaatcagttcagagaggattctggagtaccagagggaaataaaaaaggtcagacattactttgagtacgaggatccgaatggaccagtgaacgagatttggcgccaagtatcccttaaagcaccactgataaagttgttgactaaccgctacaaacggttgcttgaaagaggcaccaatggaacagattgttcgtgcatctgctctacaactccaactgacataactgcggcaagttaaacaagatggaactcatcggcctacaagctctgtgcctatttcctgtgatca

SEQ ID NO: 369 - DNA, 2035 bp, Zea mays
cgaagccctactcaacttctccttttcccccggcgattattccggccactgaccttcgttgcgtgccgctcgagaacccggttcgagaatcgacggcgcgcggctgcatgagagggtgatataaaatcgataaaaaggacgagcagcacgactctcatttttttgggggagggttgcggtggaagaggattgcgctggagagaacccaattttagggcggtgccggcgcgaccgttccgggatcgggagctttatctggggggcgcgagggatcacggccgcggcgacgaccgaccgaccggccggccaacccaaccccaccaccaccagtccccgcggcccgcgtcgaggaagaagaagggataggagacggagacggagacggagccggtggtcgcaaggatggccgggggcatgcaggcggcggacgcggcgggccggctgagcgcgctgctctcgctgctcgcgctgcgccggctcctcgccgtgctccagccgctggccctgctcctgctcctgcccttccggtggcgcgcgcggccggccggggccgtggccgcggccgtggcgtccgatgccgccacggcctccgcgccgggggccagcgggaggaaggggaaggcgtcgtcgtcgtcgtcggtggttctgcgggtgccggccgggtcccccatggtcgccgcgcggaggcaggcgtccgcgcgcagggagatcgccgtgcgccgggcgcgggaggccgggcgggagtacgagctcgtccccaccgctcgcggcgagacgctcttcacgcagtgctggtggccgcacccgccctccaccgttaaaccgagggcgctagttgttgtcatgcacgggctaaacgagcacagtgggaggtatgaccatttagcgaggcgattgaatggcatcggcatcaaggtgtacgggatggactggactggtcatggtggaagtgatggtctccatggatatgtgcaatctcttgatcatgctgtcagtgatttgaaaatgtacctcaagaaagtgttagctgagaaccctggtcttccatgcttctgcttcggtcactcgactggtggaggtatcattctgaaggctgcacttgatccagaggtagaaactctccttagaggtattgtcttgacatcaccagctgtccgtgttcagcctacacacccaatcatagcggtcatggcaccgatttttgccctcatcgcgccgaggtatcagttcacggcgtcccacaggaacggcccgccggtgtcgcgcgaccccgaggccctgcgggccaaatacacggacccgctcgtgttcacgggcgccatccgcgtgaggacgggctacgagatcctccgcctgacgtcgtacctgcagcagcacctgcaccggatcgcggtgccgctgctggtgctgcacggcgccgacgacctggtgaccgaccccaggggctcgcgggcgctgtacgagcgggcctcgtccgcggacaagtccctcaagctttacgacgggctgctgcacgacctcctgatcgagcccgagaaggacagggtgatggacgacatcgtcgcgtggctgagccccagggtctgacgccgccggcgcgttgcggtgctggccgtaggacgcgagcggcttttcgatcatctgcaggccaaggacgcctcgcctccggatggtgggtgatgacgcggtctggtctggtaggctgcggaccgagggagagcgggtgtgccttctcgcccccttggtgtgctgaactgctgagtgctgatacgatacgaggagcaggacaggagtacggagaactactactacctacggctatgggcgatggctttactcgcgcctcccggtgtgtcccgagattttttttcggggacacgtacgaattatgtaacggagttcgtttcgccgtgccacacgcacgagcggtgtccgatacacctatagaaaacgactttccatattgcgagttgtgtgatgtattcacacaattctgaatcagagttgcaacttgcaacggattcttatcttctgc

SEQ ID NO: 370 - DNA, 1779 bp, Zea mays
aaaggatccaatacacctcttcttccctcaccttcctctccctcccagctgcggcgccaccctcggcctcgggccgtccgccgtcggcggccacgaccctggtgtaatctgctccatacgtggcggcgcctgcaaaagccacgctgctgccagtgccagccatggatgcagtggcggccagcgacgccgtactcctccttgctaccgtagctatctccctgctcatcactgccactttctggagcaggcatcgtcgtcagggcgaagcgccgagcccgccgtcgctaccgctgctgggccacctccacctgctcggcaacggcaagccgctgcaccacacgctggcggcgctggccatcgcgcgcggcaccgggggcgccccggcgccgctcctgtcgctgcgcctgggcgcgcggcgcgcgctgctggtgtcggagcacgccgcggccgaggagtgcttcacggcgcacgacgccgcgctgggcggccggccgcggctgctggtcggggacaggctcaactacgggtacaccacggtgggctggtcctcgcacggcgaccactggcgcgccctccgccggttcatggccgtggagctgttcgccgcgtcccgcctcgccgcgcgcgccgccgaccggcgcgccgaggtcgccgcgctcgtcggcgccctggtccgcgacgccccccgcgccggcgccgcggtggcgctccggcccaggctcttcgagctggtgctgaacgtgatgctgcgcgcgctcaccggcgcgcccggccacggcggcggcgatgtgcgcggcctccaggagatcatcgaggagaccttcgcggtgaccggcgtcatgagcgtcggggacttctacccggcgctgcggtgggtggaccgtctgcgcggggtcgacgcggccctgctccgtctccaggcgagacgcgacgcgttcgtcgccggcctcgttcacgacggacgccgaagccgcaatcgcaaagctggcggtggcggtggcccaacagacacggagaagaggagcaccattgacgagctcctgtcgctgcaggaaactgatcctggctactacaccgacactgtcatcaaaggcattgtctcgatactgctcagtgcgggcacagacacgacggcgctgacaatggagtgggcaatggcgcagctgctgacgcaccgggacgcaatgcagaaggcgagagccgagatagacgccaacgtcggcacatcccggctggtagacgagtcggacacggctcacctcccgtacctgcaatgcgtggtgaaagagaccctgcggctctgccccgtcggcccagtcatcccggcgcacgaggccatggaggactgcgccgtgggcgggttccgcgtccggcgcggcaccatggtcctggtgaacgcctggctcatccaccgggaccccaggctgtgggaggcccccgaggagttcaggccggagcggttcctggacgccactgccacggtcgccgcccccttgctgccgttcgggcttggacggaggcgctgccctggggaagggatggccttgcgtctcctcagcttgactctggcggctctcctgcagtgcttcgactgggaggtcggtggcgctgctgttgacatggccgaaggcgttgggctgtccatgcccatggccaagccgttggaggtagtctgtcggccccgggagttcgtccagaccgtgttgtctgcttcaacatgagtagccggatgcagttctttccccccgaagaataaataaggattgggtgggtaccttg

SEQ ID NO: 371 - DNA, 922 bp, Zea mays
tgttctctttctcctaccgcttcgtggcttccctgcttccgctccaatggcgtctctcctcttggtcccgcgcctcacccggagcccatgttccaacccaggacccagtgccggtcacaagcctaggcccgtgtccatcacctgcgggccgcgcgacaaccgcgggcccctccagcgcggccgctccctctctacagaggccatcctggcgatccaatccctgaagcgcctcacctccgccgaccgctcgccggcggctgcctcggccgcagcagccaccgccctgggccgcctcctcaaggccgacctcgtggccgccatggccgagctccagcggcagggccactggtccctcgccctcgccgcgctccacatcgcccgcgccgagccctggtaccgcccggacccggcgctgtacgccaccttcgtgtcctccgcgccgcactcgccctccggcggcgagggagacgccgaggccgccgttgacgcgctcgtggaggcgttcctggaggagaaggcgcgcggcggcgggttcgtggacggggaggaggacgtgtacaagctcacgaggctgctgcgcgcgctggtggccaagggcaggggccgcgcggcgtggagggtgtacgaggcggccgtcaggaagggaggcctcgacgtggacgagtacgtgtacagggtgatggtgcgggggatgaagcggctgggcttccaggatgaggcggcggaggtggaggcggacttcgccgaatgggagaccacggtctcaccgcccgccagggacgtgctcgacgaaatgcgagcgagagacgagatcaaaaccactgccgctgcctcctagcccaccttggtttttttagctgataaatgggtttggttggtgctagaatttgtcatgctcatgctactgcaacaacggtgatac

SEQ ID NO: 372 - DNA, 981 bp, Zea mays
actaatccgactccctagctcccacactaccaccatcccaccatctttaaaaagcccccaccactacatcctgcgctgcaaacgccaagctcgcctcgcctcgcctcgcctctgttcagctcacggtggaagaggaggcacaggccgacagcacacgagagggagctagcactagcaggagctcaagcagccacacgccgaccagcaccaccgcgcgatggcgtgcatcaacatgtacaacccagacggcgcggcggggttcggcggcggcccgcagcagccggccgcgctgggcccgcgcatctccttctccagcgacttcgccatggagccgacgccggtgcagaaccgggcgacgagcctgcggtgccaggaggaggacctcaacttcgagttctccgtgggcagccaccccatgatggccgccgaccagctcttctccaagggcaggatccttcccctcaaggacaacggcggcgacagcgtctgcttcgccgccgcgcggccgcccaccacgctgcgcgacgagctccgtggcggcggcgacgacgacgagagggcggccttctccgccgccggcaccaaggggtccaactccaaccggtggaaggagatgctcggcctgcggaaggcgctctgcgtcggcgtcggcggcggcggcaacggcagtccggccaagaaggttagcagcagcgacaagcagggcgtcgttgccgccgctgcccccggccccgacgaccacatggccgcgtccaatcagcaggagcagctatcatgatgaggcgaccgtaccgacgggagactgggactgggagagagagacgacgagacagccatgggatgggagcactccacatgcgtgaacaagctttaaaatcttgtcatccctccttccgatccttcctgatgctgttgatcgatcaaccacttgaatcatgcttgtcatcatcggtccatgcctccatggtctagtaggttctg

SEQ ID NO: 373 - DNA, 1738 bp, Zea mays
cactcccacctgtaggttcacgggaggcgaggaccttgcccccctgcattcttcccgtatcgcggaccgatcctcgccgcgggaggcgagcggagcggggcgtttctgcgggggagaagcgcgtccctgcaatttctgagagaggggaggcggcgagtggaaaagagcagacgttgctatcctatcttgctgacacagcggcggtgtggcgaggcgcatggcgagggcgcgcggtggcgccgcgtggtgggtgctggcagcggcgtgggtgctgtgggcggcggcggctgcggcggaggcagaggccaggtcgccgtcggcgaggagggtgcaccggcacctcaagcgcctcaacaagccggccgtcaagagcatcgagagtccagatggagacatcatcgactgcgtgcatatctcccaccagccagcctttgatcatcctctcctcaagaaccacacaatacagtttaggccggcgtaccaccctgaaggtctatacgatgataccaagagcagcataggctcaaacaatgctggcgagaggccgatgctccagatgtggcatcgaaatggcaggtgccccgagggcacggttccaatcaggagaaccaagaaggacgacctgcttcgagctagctccgtgaggcggtatggcaggaagcggcacactgctccgaacccactgtctgttgatcccaacatgctcagcgagggtggccaccaacacgccatcgcgtacgtccagggcgacaagtactatggtgcaaaggccaccattaatgtgtgggagcccaagattcagcaggctaacgaatttagcctgtcccagctctggatcttggggggttcatttggggaggatctcaacagcatagaggctggctggcaggttagccctgacctctatggagacaacaacaccaggctgttcacatattggactagtgatgcataccaagccacaggttgctacaacatgttgtgctctggtttcattcagataaacagcgaggttgccatgggggctagtatcttccccatctcgaactacgcgggctcccaatatgatattagcatcctgatctggaaggaccccaaggaaggcaactggtggatgcagtttggcaaggaatacgtcctgggctactggccgtccttcctcttctcctacctcgcggacagcgcgtcgatgatcgaatggggcggggaggtggtgaactcggagcccgacggcacgcacacatcgacccagatgggcagcgggcacttcccggaggaagggttcagcaaggcgagctacttcaagaacgttcaggtggtggacagcagcaaccagctcagcgcccccaagggcgtaggcaccttcaccgagcagtccaactgctacgacgtgcagaacggtaacaatggggactggggcacctacttctactacggcggccctggcaagaactcgaactgcccgtgactggtgcttctaatgtgtagtgtgaagtgccgtcaccactagcaaaaaaatgtaacccaagcgttcaggttcgcttatacagcgtcaatctgcatctccttgttcagtcctaggtagtgtgtaacatgtgcatgtgctctctagaccctaatgttttcttcttcttttcattgtattttcttcttgtgccatgtaaagtttctgaagagaaggagcatggcttgaggctgcggtgggtggttgggctggtcggtggtgacctctactgat

SEQ ID NO: 374 - DNA, 488 bp, Zea mays
ggaacaacagaatccagaaaccgaaaagaggcctcactgctgccgcctgggccaagtcgtcgtcttgcttgccaatccgtcgctccacctgaacacaccggcgaagaggaggcgaagaagcgatgggcgtgaccaaggaggacgtcgaggcggccatcacctccgctctcagcccttccaatctcgtggtgacggacacgtccggagggtgtggcgcgagctacgagatcgaggtggtgtcggagaagttcgaggggaagcggctgctggagaggcaccggatggtgaacaccgcgctggcgtctcacatggcggagatccacgccgtctccatcaagaaggcgctcaccccggctcaggcccagccccaggcccagccggagccggccgccgataagccccaggcttaagtgcttaacaccccccaaaacggtttgatcccatatgccgatgcacgattacattggctatctgcttgaataatgcgg

SEQ ID NO: 375 - DNA, 1032 bp, Zea mays
accgaaatggggaagctgctccctcgccacccttcccccctcctcctcctcgccgcggcgatctgcatctccagcagcagcctcgcggccgtccggggcgcgccggtgtaccgcgcggactacctggtggacgggaaccagctggtggacatgcagtaccacatgggccccgtcgtgtccgggacgccgaccaacctctacctcatctggtacgggcggtgggaggccgcggcgcaggccgtgctccgggacttcctcgcctcgctctcggccccggccccgttcccggccgtctccgactggtgggcgcgcacgccgcggatgtacgcggaccagacgggcgccaacgtgacgggcgccttcgccgtcgccggggagcactccgacgccgggtactcccacggcgcgtcgctccggcgcatcgacgtgcagtccgtgatccggtcggcggtgtacgcgtacccggacccgctgccgctggacccctacagcggggcgtacctggtgctgacgtcccccgacgtgcaggtggacgagttctgccgcgccgtctgcggcttccactacttcaccttcgcgtccgtggtcggggtcacggtgccctacgcctgggtcgggaacagcgccacgcagtgcccgggcaagtgcgcgtacccgttcgccgccgccgccgagtacggcgccgggggagcccagccccaggcggtgctgcggccgcccaacggcgacgctggggtggacgggatggtgatcgtgctggggcacgagctggcggagatgtccacgaacccgctggtgaacgcgtggtacgccggggacacgcccacggcgccgaccgagatcgcggacctgtgcctgggcgtgtacggtgatggcggcggcgcgggcggcctggtcgggaacgtgtcccgcgcgcccgatggcagcgcctacaacgtcaacggcgtcaacggccggcggttcctcgtgcagtggctctggaaccccgtccgcggcgcctgctacggccccaactccagcaactgaccctaa

SEQ ID NO: 376 - DNA, 1305 bp, Zea mays
atctccagtccgcacgaagcgccccacaaaatgccgcggctgacgccggcgcacgccaccctcatcctggaccacgtcctgggcgatccctcgatccccaccgcagtcaccatcgcgttaatcgctgggatcccctctccctccgatccgaccccgcgcctccgccgcggggtccttctccgccgcctcgccaccgaccccgtatccgaatcctctctcgaaaccctccacctcctggcctcgctcccggcctgcgcctcccccatcgcagccgcccacatcgccgtcgcggcattcctcgcggcctccgcgcccgacttcgacgccgtcgccagggctctcttcgcgcgccccgacggccgcgcgcgccaagcggtccacggcggaagttcccccgcgctcgcatccgacgatgccatcgccacagtagaccagttcgaggctgccgtcgggatgtcctcctctcagaccatcctcagggtcctgtggggcaaccgggccgccgtggaggagcgggtccaggagctcctcgctgctgaatgggccgcgattggcccgtcgcggctcgaggcgttggctatgcggatcgtcggggatggggccgtcgagacatggggtgccgcagatgaggccatgcgtgccaatttgcgcatcttggctggggaagcaaaaacgcgcgagattctcgacaaacttgaaaaaactacctgcaacacaaatccaatttcaacaccagctgttgagaaggtgatggatgcgctcaaagcaagctgtgctgacctccacagcattgtggaggatccccttccagctgcaaaggcagttgcagatgagttattgactgcgaggatggaaaaattagttagcctgaatgcccaagaagtaggagggcagccaacaacttgtggcgttgcaggaccgagtattcataatgacaaagacaatggtccaggtataggcaaacctcacagccttatggagcggaacgcaacagcacgaacctctcagtgggaggagtcacttggtcttgatggttcggaaccaccctcaccaccgagaccacacttgcctagcccaaggagactaccaccttctcctttgtcaccgcctgggaacaaaaacaataatcggagaaaggcaaggaggtggagcttgttcgaagaagaaaccttaagaaagggtgttgaagagtatggtgttggcaattggagggatattctagataacaatgctgaggcttttaccggcaggacaccggtggacttgaaggacaagtggaggaacatgcttttccgttgatgttga

SEQ ID NO: 377 - DNA, 1817 bp, Zea mays
gggattccgtaaatatcccattccaaaaatcgaaacaatcgggacttttcggagattggctgcagttactaattcatgatctggcatgtacagaatgaaaacttcattctcgattctacgagaatttttatgaaagcgtttcatttgcttctcttccatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctctagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccctagccccttttcatcaatggactcctgacgtctacgaaggatcctccactccagtcgttgcttttctttctgttacttcgaaagtagctgctttagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactatactaggaatatcaatgaaccccattcttgcaattgctcaggataccctcttttagctgctaggtctatttcttagttcaagatccctcttactaactggaataaaagaattagtagatctgttccgcccaaaatgggaatgggtgctagggttatgaacttataatcatggaatcgactcgatcatcagattataagttcattccataccggaccagatcgtgcacattcttattatgagaaggggtcattcgagcctatggaa

SEQ ID NO: 378 - DNA, 954 bp, Zea mays
tcagtaatggcgcaggatgatccggttgtttctgctcagtggctgcacgagcacctaggaatgcctgatgttaaggttttggatgcttcctggtacatgccggtagagaacagggatccatggaaagaatatcaggtggcacacatccccggtgcgctattcttcgacttagatggcatagttgatcggacaactgatttaccacacatgctgccatcagaagaggctttcgcagcagcaatttctgagctggatataaaaaaccaggataaagttattgtttatgatggaaagggattcttcagtgcgcctcgtgtttggtggatgtttagagtgtttgggcacaagaaagtctgggtactagacggcggtttgcctcagtggcaagcttctgggttcaacgtggaaaaggccagccctgacgatgacgcagttctgaaatcaatcgctgcaaacagggctgtcgaaagggtttataatggtgaacagacaaatacaatctcgtttcagactgaatttcagcctaatctattctgggcactggaaaaggtcgcacaaaacgtcactgctaagacgtaccaacagatagatgccagagcaaagggcagattcgacggcgtagcgccagagccacgggaaggggtaaggagtgggcatataccaggaagcgtctgcgttccgttccccgagatgttcgacggcgcaccaccgagccttctcctccccgccgacgagctgcggcggaagtttcagcacgcaggaatctctctggaccgaccaattgtcgtgacctgcggatccggcgtgactgcctgcatactcgctctggggctgtacaggatcggaaagcgtgatgtgccagtctacgacgggtcctggacggagtgggaggcgcagccgtcggactccgactaccccaaagtcaccgctcctggtacagcttgagcgtcttga

SEQ ID NO: 379 - DNA, 1721 bp, Zea mays
gtatttgtccacgtctccttcgaagcaatgaggcccccacctttcccctcgtgtgtgttgtcttggcctgagcgacatgtgagccttggcctggcctggcctggccccctggagcaacacagtggtggtgctggacgtttgttttcggggttttcgcttcatgtcggggagataaatccagaggccacgtaaagcagcttaaataccacttcagccttgcgttgcgttgcgttccttgccttgccttgcctgcttgcgtgcagtgcagtgcagctcacagcctcacaccatatcgctctgcggtgctagctccaggcctttatcaagccttccctggccccttgataattccagagagagagagagagagggaggtgcagagagaggcgcgtgggctgtgggcacacacatggcgagtgaggaggtcgccacagtgtgtgccgacgccgaccaagaagcagcggcggcggcggcggcggcggccatgaaggaggaaggaggaaggggcaagaggcggaggaggaggcagccgaggaagggagaggaggaaggcgggaggaagaagtacgcgctggtgagctaccacgagctgcccgagtacatgaaggagaacgagttcatcctcaactactaccgctccgagtggcccgtcctcaacgccgtgctcagcctcttctcctggcacaacgagaccatcaacgtctggacgcacctgctcgggttcatgctcttcttcggcctcaccctggtgcacctcggccagtacttcccccaggtggctgatctgattgggcatctctcctggccaatctcgaaggtcgctgaaaatgtctccagcaatattggagatgtcctatcaggcgcggccatgttcatccagacgaacccgagcctggcctcgcacggcacggcggtggcgtcgcagacgacgcggtggcccttcttcgtgttcctggcgggggccatgttctgcctgctgagcagcagcgcgtgccacctgctgtcgtgccactcgcaccggctgaacctgctgctgatccgcctcgactacacgggcatcgcggtcatgatcgtggtctccttcttcccgcccatctactacatcttccagtgcgagccgcgctggcgggcggcgtacctgtcggcgatcacggcggccggggcgggcacggtgtacgcgctcatgtcgccccgcctgagcgcgccgcgctaccgcgcccgccgcgcgctgctgttcgtcggcatgggcctgtccggggtggtccccgcggcgcacgcggccgccgccaactggcacgagccgcgccgcaacgtcacgctggcgtacgagggcgccatggccgcgtcctacctggtcggcaccgcgttctacctcgcccgggtgcccgagcgctggcgccccggcgccttcgacctcgccggccacagccaccagatcttccacgcgctcgtcatcgccggcgcgctcgcgcactacggcgccgccatcgtgttcctcagggctcgcgacgagatggggtgcccggccagttaggtgctcagacagtacgggcgcgccggccggatgcttgcccgcgacgacattatatttgcgggcggtgtccgtccagtgatcgatacgatatgatgattgggaaagaagaaactaaaccatatttttttttgtttacaccttttccttacagcagcagcagcaagtgtgcgagattcatcgttaatga

SEQ ID NO: 380 - DNA, 524 bp, Zea mays
tggtttcctctgcttctcattctcccgtgcacttccagttcctgcccagctgcagggctgctccaatggccaccttgtccgccatctctgccaacgtcggctactgcaaggcaccaaccctgagctggaagggaagcggagtaccaggccggattgtggtctccatgtccaccacccgaagaggcctcgtctccctaagacgacgatcccctcggtttcgcgtctacgcggcgaaggcggagacggtgagcaaagtgatggacatcgtgaagcagcagctggcgctggcggcggacgtggggctgacggcggagaccaagttcacggacctcggcgccgactcgctggacacggtggagatcgtcatgacgctggaggaggagttcaagatcaccgtcgaggaggacaatgcccagagcatcgccaccatccaggacgccgccgacctcatcgacaagctcgtcgaccagaagccacgagacagcgactgattgtcgacgcgacgacacccaaatccaatctag

SEQ ID NO: 381 - DNA, 1854 bp, Zea mays
acctgtcgttgctctccgccgccaccagtgcccgtagcgctcgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaggcctggcagctcctctccatcttcctctccaccatcgcggggctcgtcctcggcccgctccccgtcggtgcgtgggcgttccttggcctcacagccaccgtcgccacccgcacgctccccttcaccgccgcgttcggggcgttcactaacgaagtcatctggctcatcgtcatatccttcttcttcgcgcgcggctttgtcaaaaccggactcggcgaccgcgtcgccacctacttcgtcaaatggctggggcgcagcactttgggcctatcctatgggcttgccatcagcgaggctctcatctcccctgccatgcccagcaccacggccagggctggaggtgttttccttcccatcgtcaagtcgctatcgctctcgtccggaagcaagcccaacgatccatcggcgaagaaactcggctcttatcttgtgcaatcgcagttacaggcagctgcgaactccagtgctctcttcttgacagcagctgcacagaacctgttgtgtctgaagttagcagaggagattggtgttagtatcggaaacccatggattacttggttcaaggtttctagcgtgccagcagttcttgggcttttagtgactccttatttgatttacaaaatattcccccctgaaataaaggacactcctgaagccccagcattagctgccgagaagctaaagaacatgggtccagtaacaaaaaatgaatgggtcatgattgggacgatgcttcttgcagtctcactatggatttttggggaaactattggcgtatccagcgttgttgctgcaatgattggactctcaatacttcttgtgcttggagtgctaaactgggaggattgtttgaatgagaagtctgcatgggacaccctagcttggtttgctattttagttggtttggctgggcagcttactaaccttgggattgtgtcctggatgtcgaattgtgttgccaaggttcttcaatctttctcattgagctggcctgcagcatttgttgtccttcaggcctcgtacttctttattcactatatatttgcaagccaaactgcacatgttggagctttatactcagcatttcttgcgatgcatttagcagctggtgtgccagctctaatgtcggcacttgctttggcatacaatgcaaacctctttggagcactaacacactatagtagcgggcaatctgcagtatactttggagcggggtatgttgaccttccggatgtattcaagctgggttttataacagccgcaatcaatgctgtaatttggggagttgctggtgcattatggtggaaatttttgggtctttattgagtgtcggggcagtgtaagtacgtgaaaatcgtaccatattatcaaacaagtaattcatgatccagcatcggaggtggccaggtgggttcgtttttcttccgagggcctatgaatgcatcataacagaggaacgctca

SEQ ID NO: 382 - DNA, 1012 bp, Zea mays
acttggttcgtcttccactcatgagaggcacggcaccagagctccagctccacatcgccagctcccgggccgcacctcgatcgcccaggccggcctcctccctcgccgccggcgccgccatggaccgcaagagcaagtccgccaagggcgccgcgagctcggcagcggcgtccatggccgcgctcgccgcagccgccgcggccggcgacagcagctcgggccccgccgacggcgcgccgccgccgccgccgcacggtgaggagtacagcgtgcctgcgaagatggcggccgtgggagacgcctccagctcgtctcccgtggcgccgaggaggggcgtggcggccgcgttgggaggcggcacctctagctcctccccggccgcggcgaggaggggcgcggcggcggcggcgtctgtcgttgcggcaggcggcggcggcggcgggccgaggtgccaggcggagcggtgcaacgcgaacctgatgaccgaggagaagccgtacaaccggaggcacaaggtgtgcgaggcgcactccaaggcccccgtcgtgctcgtcgccggcctccgccagcgcttctgccagcaatgcagccggttccacgagctgtcggagttcgacgacgtcaagcgcagctgccgcctgcgtctggccggccacaacgagcggcgccggaagagctcggctgacgcgcacgccggcggcggcaataatggattccgccaacacgccgaccagaacggccgcggtgacccggccgggaaccacttccagatcagataaagcatgctctctctcttctgtcatgcagcaggatatgctagcatcatcactaccgatagatatttatgcgtctatcgtctacccgccccgaaaaccctagttaattatatatatacatatgctgattgtaacctaattagcctgcagccagttaagcagggactgcctactctgctaggacgtgtgtaatcatgtggccgcctgcgcgaacagtaatttgtgctggctgctgt

SEQ ID NO: 383 - DNA, 1336 bp, Zea mays
accagcgaccgtttcactccccgcgccacgcgcctgactgggtgcactgcactggtggtgtgcacgcccctcgtcagtcgtcactcactcgctaccccatatcccattccccccgacggcgcctctggcagcaaggaacaatatgtccaatagggccacccattggtgttatgcctgtcagcgcccaattcgtcttcgcgggcaggatatcatatgtcccaactgcagtgatggttttatccaagaaatcagtgagatgggtggcgtactgaacacttatgggctaactgaaccggactttgaagagcgccaggccagaagatttggaatgatggatgccatatcttccctcatgcggcaacggctgtcagaaataggaagggatagtttgtttgatattcacggtagacaagggacaggtactgaatatggaaggaggtcaactgctattcctacgctggtatttggtggcatcccttctcctgcagttggtagcagtgatatcaatgttgtcatcagggaaggccgcagagctggcgctgcccgtccgaatttcagtagcttagttgttggtcccagtctggaagctctatttgagcagctactactccagaacaaccgtcaaggcccaccacctgctccacagtcagctattgactccatgcctgtggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccatcacagcgatcaggcagtagtaccagcagcgcccgtgtgccttcagcatactacaacgaaacagcttgccctcctgcggtcgccagggcagatttcgatcctgtgccttcagcatactacaacgaaacagcaactgatcctcctgcggtcaccagagcagatttcgatcctgctccaggaaactacggcagcgaaagccaggaaagtcacgtccccttctcctttctctggccatttggcccgtcgagttcttaccaatatgaagaaaatgttgatgaacctgcagtatacgatccaaaccagatagcatattctgcgtggcactatgaccactgactgaaaccctgagttaaaatcaagatatctgcaattcgtgccttgagctctcagctttggtgaggcaaagggctgcttgccgtataaaaaatggatggttattgtgttcagtgcatacccttgctacgcatgtccgttgtggagatatcagct

SEQ ID NO: 384 - DNA, 604 bp, Zea mays
ctagcagcgcacggagagccaaaaccaaagccatggcagcacatctcgccagcgccttcttcttcgctgccgagcccgtcggcgagcccggcgtgcacgcgctcgacgcgtgcgcgctctgcgccaagccgctggcgcgcgacagcgacatcttcatgtacagaggggacacgcccttctgcagcgaggagtgccgctacgagcagatgcagctcgacgccatccgcgccaggcagccgtacgcgtcagggacggaggcgcggagggggcaccgggaggccagcaaggtgtccgcggtggcgacctgatgaacgcccgccggggtggcccggagctgcgcctgcacagattgagagactcaagccaacggtttggttggtcgtttgcctcgtgaaggttgggattcggagaaacgtactcttagatcagatcgagcggccctgagccgagcttcgcggtgaatgatgcccgcggatgccggagagtcggagaagacgatctccgtcggagttgctctggttgcacgaggcttggcctgcgtgccactgtcaatgccttagtcctagtgtaacatgatttttgtaaattcgatgcatttggaaag

SEQ ID NO: 385 - DNA, 956 bp, Zea mays
cgaggaatcaccacacacacacacacgcagagagacagagaagaggagggagatgtcgccgcagtctcagcagcagacggcgatagtcggggaggagtactgcgagggcgaggacagggagctgacggtgcgcaagacgacgctcttcaccccgggggacgggctggaggcgtacgaccaccgcacgggcgcgctggcgttccgcgtcgagacgtacggccgcggcggggcgtgcgggggcggtgccgccaggggggacctcgcgctgctgggcgcccagggggagcccgtcctcacggtgcgccgccgccgccccagcctgcacaaccgctgggacggcttcctcggcgacggcgccgcgcacggccagaagaagcccgtcttctccgcgcgccgctcctccatcctcggcgccggcacgggcgccgccgccgtcctcgtcgacctcctcgcccccggcgccgccggggagttccgcgtcgacggctccttcccgcgccgctgctgccgcgtcgtggcctccgccagggcctgggccgcgcccgtcgccaaggaggaggaggaggaggaggaggacgtggtggtggcggaggtcaggcggaaggtggacgaggacgcgcacgtcatgatgggccgggacgtcttcgtgctctgggtgcgcgccggcttcgacgccgccttcgccatggggatcgtgctcgtgctcgaccggatcaccggggatgacgtcgacggcgacctgcgggaggacctgctcgaggccgctacatcgccgccggcgtaagcacgcgggaccgacctcccgctcgcgtggggcgtggcttcagtacaattccacaaacaattttctcatggttcttcgatccgatgtactttaccttcgagcatgatgtgaattatcttctcaattccgtgctgtttccccccttccaatctgatgcttgacattggatcac

SEQ ID NO: 386 - DNA, 698 bp, Zea mays
gctttagcctttgtgctgcctgtactatactaacttgcaagggacgtcggcgacggccaggcgcaccgcgcggcggcccggccagcccacccagagaccacctagccatggcgtccaggtgcttcttccccagggacgcgtccgccgccgccgacggccggcaccagcagtcgaagggcgcggcggaggccctcgagcagctgcgccacggcggccgcctcctgtcccgggaggacgtgggcggcgctgtgcgcgtcaggatcgtcgtcagcaggcgcgagctcaagcagatggtcgcggcgctcggcgacgacgacggcgctagcgcggcggcggcggcggccagcagcgagcgccgccaccggcagcgcggcgcgggcgctggcccgggagcggggccgggcgccgagcagaggctgcagtcgctgcggcggcgcagcgcgcggagggcggccgatgcggcgcgccggacgatgcaggcgggcggggagtgggagcccggcctgcagagcatccccgaggaggtttactagctagtaatctctgcttcactaattatgggttgggtacgttttgatcactgcctcgctgctaagtgctactagtagtagatgcgtgtgtgtgtacagcgctgtttttgctctggaccctcgttatcatgggttccattccaatgcctgcttgacatagtcctctcc

SEQ ID NO: 387 - DNA, 922 bp, Zea mays
agtccaccacaattcagaagcgccgacccgcgtcgccttatcgggagcaacggcaacggcagcctctcctccgcgccatcaggcagccatgggtccgggcgcgtccacctccgcgcagccgctgtcccggctcctcctcagcctcccgaagccaggcgccgcgaagcacccccgctcctcctcctcctcctcctctccttcgcagcctcgcccggacgtcgccgcggccaggagccccggcctcgtcctccggcggcgcgaggcagcggccgccctgctgtcgaccgcctttctctcccgcttcgccctccccgcggccgccgcggacggcggggagtgcccgctggaggtggcgccgtccgggctcgccttctgcgaccgcgtcgtcggcaccggcgccgccgcccaggagggacagctcatcagggcgcattacacggggaggctggaggacggcacggtgttcgacagcagctacaagcgcgggaagccgctcaccttccgcgttggcgtcggagaggtgatcaaaggatgggatcagggtattgttggcggcgaagggatcccgccgatgctcgctgggggtaagcggacgctgaagctgccaccggcgctggcctacggcgagaagggtgctgggtgcagagggtgggagcccacctcgtgcgtcatcccgccgaactccacgctcctcttcgacgtcgagtacgtcggcagagccaccggctgaggtctccggaaactctgaaagtctgaatgcgcgaggccaaggttcagactgatccatgtggacaacgatcgtagttgcccgggcactaagaggttttcttcttctcgtcgtatgtttaagagagctatagattgccagagacaagagtctatatagttttcaatgtcgtgaaaggtgtagagaaatgtgcca

SEQ ID NO: 388 - DNA, 1519 bp, Zea mays
gctcggcttagacaagcctctccaacatgaagctcctgggttggatgcaccggaagttacgacagaacagcaatgatgtgttcaaagagttcaacaacgctgcaggtgggacgtgcaactgcatcaccgggctggccgcgtcggacccggccactttcctcgccaccgccaacgaatacttcaccgccgacaacgacttcaccaacaaccatccatcgtcgccggccgccgacctcttcacctttggtggcagcggcctcctcaccattggcacgctaggcatcgccgccgtcgcggtgtctgcagacgctgatgaagttgattacgacgtcgacgccgatgctgactccgactttgacgacaacgacgacaccgccggtgatgacgaagaccaggtcgacagcgccgtcacgcccacgttcacatatgcagcgccgcctccgatagaggacgccacggtcgtcgagaaggctgcagttgccgtggttgaggccattgccgagaagaacgacgacaccactactgaggatgacctcatggtggtgagcgccgagctggagaaggtcctcggtggccgcaacagcggcaccgccggtgacctggtggcgtcggcgcgggtgagctttgccatgggcgtggactgcccgctacagggcttcctgttcggttccccggtgagcgacgccgagtcgcgcctggagcagccgcgggatagcaacggcggccggcgcacctcgctcggcgagctgttcatgcgcacgcgcttcgccgaagagaaggtggcgctcgtcgccgtcgaggaaggtgaggacggcggggacattggtgctggcggtgaaagggacgacaggaaagcagggaaaggcggcggcggccacaagacaacgaagaagaggagtgcaaaggatgaaaaggtccccagaggtgacggagcgcaggcgagtgcaacagtgaccaagagcaagtttcacaagatcctccagatcttccacaggaaagtgtaccccgagagcgcggccctggcgcggaacctgaccaagaagagccgcaagcgcggcagcggcgcctaccacaagccggagccggcggcgtccaggctccggtgcctcaaggagcagcgcgcgccggggttcggctgctgcgccagccgggcctcgttcggcggcgccgcctctcccatcgacggcgacgacgacgacgagctcaacggcagcaagagcggccactggatcaagaccgacgctgaatacttggtgctggagctgtagaatgagaaataacaagagagagatcaggatctgttggctggtcagcatcaagcatatatagtgagtatattgagcataatgcctgcttatgtttctgtgcttgctcttcacagaaaaaaaaacccatcatacatatgtttgttcatgtgattacctgacggatgagttgtacgtgtccgtctatatatctgtataaaggggaaaaggactgcgagtgtatgaacttaatgtatggtttgcgtcaagatgtg

SEQ ID NO: 389 - DNA, 605 bp, Zea mays
acctccgtcctccgaccccctcagctccggcgatggcctccaccccgcaccctccgccgctcatcggcaagtcgggaaacctcacggtgttcttcacgccatcggcggagcacgagagcccggggtccgagttctctacgcccccgacgagccctcgcgccgaggactcccctgaatcaccaccggcgcagacagcccctccgcccgcgcctgtttactcagtatccacgccgcagcttgtcaagatggtctccccgccgcttcccgccgagaagctctcccgaccctcgctggtccaggtaccgtcgccgcccgtcaagtcggtctcaacgccgctgcaggcaccaaaggtctcttcctgctccttgccaccggtccaggtgccgccattgcagttcgggaaggcttcggcaggatcagatggatcgctgcttgcgttcttctgggacgcggttgcacgcatgcaagaagcacacgcgagcttggacgagcacatctcgagatggttcgggctggaccagtccaagtaccagtgggcgctcaacgactattatgagaggaccgggcaggagatagatttgagcaacgttggcactcgttagtaa

SEQ ID NO: 390 - DNA, 2199 bp, Zea mays
tacatcctcacaccgccacagcagctgccgcggccgagccgacgacgaggatgagcggggccgcgctgtgcgcggcgctgacggagctggggttcgacggggaggacccgctggacgcggatgcgctcgagtggccgttccagtatgaggaggcgcgaccgctgcttgcctggatctgctcctgcctccgcccctctaacgtcctctccccgtcccacctggcccagtatgaacaactcgtggaagagggaagactgttagagggtgaagatttggactctgcttttgatagtatttcagccttttcaagcaagaaagacaatcaagaggctgtgtttggatcagaagaaaccattcttgatatccgtgaagcaaaactagcatatagagccgaagtttttgagttacaaaagcagcttgcgcggcagcaagcacaatttgatttgcttgcaggccaggcttcaactcttattcaaggtagaaggtcacgtgtatctgctatgtctgcagttagtggagagcttatatcgctagatgagatactttcttccagaaacttggagatgaattcagttcttggaagaatcactgctactacccaggaactagcccattatcattcaggggatgaggaaagtatatatttggcatattcagacttccactcctatgttgttggtgacttggcttgtacgaaagagctaaataggtggttctcaaagcaatttgagaaggggccatttcgacttgttgctgaggaggggaaatccaaatgttcctgggttagtcttgatgacatcactaattgcttgataagaggagattctgaaaaatctcatcatcaccaacgtgtcgctgagttgcaacgacttcggtccatatttgcaacaagtgaaagacaatggattgaagcacaggttgagaatgctaaacagcaggctatactctctatattgaaagcacaagtgtcatccgacgaggctcatatacatagggatatccattctcttaggagaaaaggttctgagcttgctggagagctctcgacactttctcaaaaggtgcaagctttggtatctgagacaataccgtgcctgtgttcagaacttgctcaacttcaaggcacatatatcttgcaaggggattatgatttaaaggtcatgcgccaggagtactacattaacaggcaaaaaacgttcatcaatcacttggttaatcagcttgccagacaccagtttctgaagattgcttgccaacttgaaaggaagaatatagctagtgcgtactcattgcttagagtaatagaatctgagttacaaagctacctttcagcagtcaatacccgcttgggtcattataattcattgattcaagctgcatctgaagtacgagaacaaggagctattgatgatcgtgacactttcctccatgcagtgcgagatctcctatgtattcactcaaatgtccaagcaacagtgccaacatacatgtcagcacatgcattggttcagcagatatcagcacttcaatctgacttgctttctcttcagtctgagctggagaacacccttccagctgaccggaaaagatgtatcaatgaattatgtactctgattcaaacagtggaacagcttctatttgcgtcgtcaactactgcagaaccaatattgacgccttggccattgatgcgggcacttgatgatatggaaaatgccaacgctcaagtcgaagtttctgtggaagaagtaaccaaggctcgcacccagaagataaagatctttgaaaatcgtgcccatgaggtggggagggagaggcaaatattcgttgatttcttctgcaaccccgaacgcctcaagaatcaagtcagggagctgacctcccgtgtgaaagctctccaggactaacctgtttctgtaggctggtctcacagatcgtgatgctttttttttatgtaaagtttgacttcactccagcgtcaggttggggctgctgtgcagggacggtatggaacaatataccatcatgtagctcgggggggttcaggctctaggtccttgtgccacccggaataggatggcattgttgtgatattatttgtagcgatatgtatgttgtaaaatatctcagaaatcacaagccctttctttcgtgtatggttttgcttttgagtaggttatggtggtacagttgttagcgtcc

SEQ ID NO: 391 - DNA, 1499 bp, Zea mays
agtcggataccgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgccgcggcggcggctcctcgcggctccggaaacgttttcgagggattgagagcaaaaggctttgcaagcatgtcatcttcgactggcaatgagaatatgtctactggaactggtacactacctcccatgccacccacatcatcatatattggttcacctgttttctggattggagttggtgtagcattgtctgtggcgtttaccacggtctcttccatgttaaagagatatgccatgcaacaagcatttaagtcaatgatgacccagtcagcaccaaactcatttggctccaactcgcctttcccatttagcatgccgccacaggcatctcctactgctccaagcacttacccgtacttggaaccaaagaaagatacttccccgcatgtgtcaactgttgatgtctcagctaatgaagtggaagccactggaacatcgaaagaggtggatgttactgaaacgccaaaaccttcaaagaagtttgcatttgttgatgtttctcccgaagagttgcagcaaaagaacctccaatcttcaccggagacggtagatgtaaaacatgatagtacatacagtgaaagtaaggaggatactgaggaacaagttcccacaattagtacaaacactgaaagtaaggaggatactgaggaaaaagttcccacaaatggagcatcttttaagctgaacgaaggtgctgctcatgggccaactgaatctaataactcggcatctatgctatccgttgagacaattgagaaaatgatggaagatccagctgtgcagaagatggtgtatccctacttgcctgaagagatgcggaacccaaattcattcaagtggatgctgcagaatccaatgtaccgccaacaactacaggatatgctaaataacatgggcgcaactcctgatcaatgggataaccgcatgcttgatcaccttaagaacttcgaccttagcagtccagaagtgcggcagcagtttgcgcaagttggcatgactcctgaggaagtagtatcgaaaataatggcaaacccagatgtagctgttgcattccagaatccaaaaatacagacagccatcatggactgctcgcagaaccctcttaacattgtaaaataccaaaatgacaaggaggtcatggatgttttcatgaagatatcacaaatcttcccccaaattaacggctagctgatcttcgtcgtgggatagcacttctgattt

SEQ ID NO: 392 - DNA, 2303 bp, Zea mays
caccattactgaaatgcagagctcgcataaataggcaggacccgcggtgctactctcctgtccccttccggccttttccccccttctggagcttggggggaggcactctgcaccttcgtcttcgtcttggcgtcctccagcgctctgccttcctgagctggcttcttgtccgcaggatccatggcgaaggactacccagcttctccgaaagctcagcagctgcaggaatccaagaagcagcgcctgacatacatcctcgtcgtaagcgcgctctgcatcgccttctacgtccttggcgcatggcagaacaccacgcttccaaagcccataggcaactcggcgatcacccgggttggctgcgatcccactgccgccacgacacagtcctctggctctgtgccgtcgtttgggccaggctccggcgaggtgcttgacttcgacgcacaccaccggctcaccatcaacaacacggacggcgatggggaactgcagcagttcccggcgtgccctctcaacttcagtgagtacacgccgtgtgaggaccgtaggcgcgggcgccggttcgaccgaaacatgctagtgtatcgggagcgccactgtcctggcaaggacgagcaggtccgatgcctcatcccagcaccgcctgggtacaggacccccttcaagtggcctcgtagcagggactacgcctatttcaacaacatcccccacaaggagctcagcattgagaaggcggtgcagaactggatccaggttgagggcgacaagttcaagttccccggtggtggcactatgttcccgcgtggtgctgatgcctacatagatgacatcaataagctcatctcgttatcagatgggaagatcaggacggctgttgacacaggttgcggggttgctagttggggagcttacttgctgaagaggaacatcatcgccatgtcatttgcgccgagagacacgcacgaagctcaggtgcaattcgcgctggaaagaggtgtccctgccatcattggtgtgatggcgaagcagcggttgccttacccatctagggcgtttgatatggcacattgctcacgctgtctgattccttgggatgaacacgatggactgtaccttgctgaagtcgataggattctaaggccaggaggatactggatcctctcgggacctccgatcaattggaagacacaccacagggggtgggagaggacgaaggacgacctcaagcgagagcaggacaagatcgaggatgttgcgaagagcctttgctggaacaaggtggtcgagaagggggatctgtccatctggcagaagcccaagaaccaccttgagtgtgccaacattaagaagacatataagacaccccatatctgcaagagtgacaatcctgatgctgcctggtacacacagatggaagcctgtgttactccactgcctgaagtgagcaaccagggagaggtggctgggggagcggtggagaaatggccagagagggcgttcttggttccccccaggatcaaaaggggcatgattccaggactggacgccaagaagtttgacgaggacaagaagctttgggagaagagggtggcctactacaagcgcaccataccaattgcagagaacaggtacagaaatgtgatggacatgaacgccaacatgggtgggttcgctgcttctctagtgaagtaccccgtgtgggtgatgaatgtcgtccctgttaactccgaccgggacaccctcggggcaatatacgagcgagggttcatcggcacgtaccaggactggtgcgaagctttctcgacgtatccaagaacatatgacctcctgcatgctgacaatctgtttagcatctaccaagacaggtgcgatataactggcatcctcttggagatggacagaatattaaggcccgagggcacagctatcatccgcgacacagtcgacgtgctcacgaaggtccaggcaataaccaagcggatgcggtgggagagccgcatcatggaccacgaggacggccccttcaacccggagaaggtcctcatggcggtcaagacgtactggaccgccgaagccgaggaggagcactagcacacgagtgacaccgagctcacttgaaagcgtgaaccaagcctgttctacacttctactaccggtcgagagggatggcgtcagcgttttgcgtctcagtgtagtatgtatgtccctttcaccttttctctagttctttgtagctagctacaatcagatgggaaggtaagggagagttttgagggggggtggttggttggtcctctagttga

SEQ ID NO: 393 - DNA, 558 bp, Zea mays
gaactctaccccgcagtctcggccgcggccatggcggaggacgcccccaacgccgtcgccgagggcagccagcccgcggcctccgagggatccgccgacgccgccctgccggctgccgcgggcgccaaggccgcggaggcgctgctcccgtcgctcagtatctggccgccgtcgcagcgcacgcgcgacgccgtggtgcgccgcctcgtgcagacgctcgcggcgcccagcgtcctctcccagcgctacggtgccgtcccggagcccgaggccgagcgcgccgccgtggccgtcgaggccgaggccttcgccgccgcctccaagtccgccgccgccgccgccgagtgcccggcctccgtcgaggaggggatagaggtgctccaggcctactccaaggaggtcagccgccgcctcctcgagctcgccaagacccggtccgccgctgctgcggcggcgcccgcgcccgccgaggggagcgcgcaggcgcaggagtccgcggaggcctcgtcggcgactgctccacccaccgaggaggctgccgtaaacgaggagtaataa

SEQ ID NO: 394 - DNA, 934 bp, Zea mays
accagaggcaagccaagacgcaagctgcaagcacgcgctcgtgcccgcgccatgaagtgctggtgcgtgcactcgccaaggggagcaatggcgacgccgctctccagccccttggctcccaccgccctccgctcccctctccggcaccgcgccctgctgctgctgctgccgttccctccccgtgcggcctcctccggcgaggacgccgccgcagcagccgaccaggagccggccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagcggctcaacggcgcgctggccgcgctggggctcgccgcggtgctgctcgtggagctgggctccgggcaggccctggtgaagtaccaccagccggccacgctgttcctgcaggcgtacaccgtcgctgcggccgccgcgctgttcgtcaagtacgagaaggagcggatcagcacgtggccggggccgccggcaaagtgagataaatggcgttgtctcggtcgcggatctttacttgtacttttacctcttgatgatgtgcactgcacggatattatatgtgttcgttgtgagaactgggaaattcgaggagagaagaagagcttgattttttacagtccttttaacgcccatagtttcatttcatttctttcgtcacattaggcaggtccagcctccagcggcaggcggtttggtcggttcgagtgttttgctgcgttcgtcggttatcacggagaatatccagacagttgttggttcgagaaca

SEQ ID NO: 395 - DNA, 2909 bp, Zea mays
ttgcttccacttctgattcctcgttcgcctgctgcacgctcaccactgtacgtccccgatggctgaagccatcagcgcgaccagctcgtgcctggaacccctgtgcggttgtctggaaagcacaggcgtgttcgaggcggtgggccgggaggtggccgcgttccttcgcatcaagtcgaattgtggcgacctcgaaaaggcccgggacagcctgcgcgccgtcgagacgacagtcagggcgcgggtcacggcggaggaggacaagctgaacgtctgtgatcctcaggtgcaggcgtggctcaagcgcgtcgacgagcttcgcctggacaccatcgaagaggattacagcagtctgtcgcggttctcttgcctctgccagtgcaccgtgcacgctcgtcgccgcgcctcgatcggcaagcgtgttgtggacgcgctggaggaggtgaacaaactgaccgaggaaggaaggcggttcaggacatttgggttcaagccaccgccgagggccgtcagtcagttaccccaaactgagaccgttgggttggagcccatgttggctcgggtccatgatttgcttgagaagggcgagtcgagcataattggtgtgtggggtcaaggaggcatcggcaagacgactctcctgcacgccttcaacaatgatctcgaaatgaaagaccaccactaccaggttgttatttttattgaagtatccaattcagagaccctgaacacagtggagatgcaacagactatctctgataggcttaatttgccatggaatgaatcagagacagttgagaaacgggccagattcctattgaaggcactggccaggaaaagatttctattgctacttgatgacgtaaggaagagattccgactggaggatgtcggtatcccaactccggacacgaagagccaaagcaagctgatcctgacatcacgtttccaagaagtatgcttccagatgggtgcacagaggagccgcattgaaatgaaggttttggatgataatgctgcctggaacctgttcttgagcaagctgagcaacgaggcttttgcagcagttgagtcaccgaatttcaacaaggttgttcgggaccaggccaggaaaatattctccagttgtggaggtctaccacttgcactcaatgtcattgggactgctgtggcagggttggaaggaccaagagaatggatttcagctgctaatgacatcaatatgttcagcaatgaagatgtggatgaaatgttttatcggctgaaatacagctatgacaggctgaaacccactcaacaacagtgctttttgtactgcactcttttcccagaatatggatctattagtaaggaaccattagttgattattggctggctgaaggtttgcttctcaatgatcgtcaaaagggtgatcagataattcagagccttatttcagcatgcttgttgcagaccagtagctcattgtcatcaaaggtaaaaatgcaccatgtaatcaggcatatggggatttggttggttaacaagacagatcaaaagtttcttgttcaagcagggatggctttggatagtgctccaccagcagaagagtggaaggaatcgacaaggatctccatcatgtctaatgatatcaaagagcttcctttctcaccggaatgtgaaaacctcactacattgttgatccaaaataacccaaatttgaacaagctgagttcagggtttttcaagtttatgccctccttgaaagtgctggatctttctcacactgcaataacaacactcccagaatgtgagacattggttgcattacagcatctcaatttgtcacacacacgtattaggttattacctgagcggctgtggttattgaaagagttgaggcatctggatctcagcgtgactgctgaactcgaagataccttgaacaactgctcaaggttactcaatttaagagttcttaatctctttcgcagtcactatggtattagtgacgtcaacgacctgaatctggattccctgaaggcactgatgttccttggaatcactatttatacagagaaggtgttaaagaaactgaacaagactagtcctttggcaaagtcaacatatcgtctgcatcttaagtactgtagagaaatgcagtcgatcaaaatctccgatctcgaccacttggtgcaactcgaggagctgtatgtcgaatcatgctataatctaaacactcttgttgctgatactgagctgactgcatcagattcaggcctgcagctcctcaccctctcagttcttcctgtgctggagaacgtcattgttgcaccaacgccccaccattttcagcacatccgcaaattgaccatttcgagttgccccaagttgaagaacatcacatgggtcctaaaacttgaaatgctcgagaggctcgtcgtgacccattgtgatgggttgctgaagattgttgaagaagacagcggtgatgaggcagaaacaacaatgctgggtcagggtcatccttctgaagaacaggaagataaacggattgatggtggtcaaagtgtgtgcaagagcgatgacaatgcgcatgctgagctcctgaacctgagatcaatcgtgttgactgatgtcaagagcctgagaagtatctgcaagccaagaaattttaccagcctcgagaccatccgggtggaggattgcccgaatctgagaagcatcccactgagcagcacgtacaactgtgggaaactgaagcaggtgtgcggttcagttgaatggtgggagaaactggagtgggaggacaaggagggcaaggagagcaagttcttcattccaatctgacaggcccctccgttcagctgttctcggcggttgctgtgtcagttggcaggaagcttcgttcaatgctgccacgaataag

SEQ ID NO: 396 - DNA, 1209 bp, Zea mays
gggctctccgtaagtttctttgagccgggtagctacacagtacgcacacctatcccggctgcagcgcggttccagccactggtgccacgtggtttgtgctcttgtgggcacactggcctccacccatctctctcacgtctccccatccgcagcaaaggcacacagtacagattcggcccatcgttttatagccacaccatggctaggaagtgctcacactgtggcaactgcggccacaactccaggacctgcgggagagaaaccatgctctgcgaagctggcgacaacggcggctatggcggcctaaggctcttcggagtgcaggtccgtatcggcggcggcggcgcaggctcggcgtccatgaagaagagctacagcatggactgcctgcagctcgcggctcctggttgttccctcgtctcgccgtcgacgtcctcctcgtcgtcgtcgctgctgctgatgtcgattgaggagggatcggagaggggggcgccaaatgggtacctttctgacgggcctcatggcagagctgtgcaggagaggaaaaaaggagttccatggagcgaggaggagcacaggcagttcctttccggcctggagaagctgggcaagggcgactggcgaggcatctccaggagctacgtgccgacgaggaccccgacgcaggtcgccagccatgcacagaagttcttcctcaggcagagcagcttggggaagaagaagcgccgctccagcctctttgacatggtaccgatttgcgagaacagtgcgagcatctccgatccgctgagcagcgaaggggcctcaacctctctgtcgctgaacgtgccacgccacggcgtcacctccgtctccgagagggcggccttggacctgaattcgacggaggaagacgacagcggggcggacgcgtcgtcggcatcggcatcaggtgcagggaccagaccaccgttcccggcagcgcagacggagccgctgcagccttcgtcgcttggccgtggacgcggtcaccactgctctccgttggacctggagctgggcatgtcgctgcctgccccatccatcggaacatgacgcgccgccgccgccgtacttatcgccatggaatcccacgcaggtcgcgccagaattcgtcagcgcaggttgccaaggccgaggccgtgcgtgcctgctgtctcgcacaaacgtcccacgtgtaatcagaactag

SEQ ID NO: 397 - DNA, 2254 bp, Zea mays
ctaaaccctagcttgggcactcccccctgccccggcggcgccaccaccgcgccgcaccgaccgcgtgcgctgacacgttggaatgcattgtttgaagtgtgatcattgaggttctggttaaataagcttctagaatcgagtgactcccctcccataaatggataagatacaatctgattgcccttatccgggatgtttcttttgtgttatgaaagaggcgaaccctagtaaacgaagagcaagtgtgctaaagttttttagggaacttccttcccaagatgacgatggtcaagttctccctgtcagcggtctctggaacacagcgatggctcacccaaatgatcccgagttcatcaacttgggcatatttgaatgcatggcagctcttatatggaaagggttgaaaaataggcgttggcttgcacatgatcagaatatttacgtcccatattatgcagctcacataattggatcgtacacgatgaatatggaggaatttgcagagtgtgctgttcgtgctggtgtaatacctccattagtcgaactgttaagaggtaggttgacatgggtcgagcaaagagttgctgttagagctttggggcatttggctacgtatcctagtacattccctgcagttgccgataatggggaagtacttgaacttgccactcaacttgcttcgagcacccttgagattgtgtacactcacttttaccagtttgtggatcgaagacttgactaccattgtggccttcttactcgtggcataggtggtgtggaaatggaatcccgcaaagctgaggaatgggcaagtcaactacagtgctggtcattgcaactcattaactgctttgcatttaagcctgaattcctccatgatatttgcaagcctgattttctagtcaagttacctggaatgtggggtggacttgtgaatgagaactcgcctgctggtgttggtttgctaagaacaatctgccagagcaaagttggccgaggtgatgctgccaacattcctggtactattgatgctttatgtaacattgctcgctcttcagatgattggcaatacatggcagttgattgtctgatctggttagtgcaggatgcaagtacttgtcataaggttatagacaaagttgcgccaatactgatagatttagcagatatttcgacactgggtgattataaaaagcttggtgacatgattgtcacagtcctccaagaatgtatgcaacaaagcgggaactcacgtggcgcaatcagtgctcagaccaaagcagaaatcgatgagctcttgagatccaagcaaagtttgaaattggaaaagagtatgccaaaggaggatcttcatataaaacaagctgcagcactggttgtcaagttggaaggcaactcactgttctcttcagggaacattgcaggagctgcagagaaatactccgaagcactggcactatgcccaatgaaatctaagaaagagcgggtggttctttacagcaaccgagctcagtgctaccttctcctgcagcagccatcggctgccataagcgatgctactcgagcgctgtgccttcatagccccgtgaatcgtcacgccaagagcctgtggagaagagctcaggcgtacgatatgctcggctttgcgaaggagagcttgctggatacgatccttttcataaacgagtgttcgcagtcgaacgatcctgacctatccctgaagcagaacaaagtccctgattatgccgagcggctggtgaagaagcagatgcgcgccgcttggctgttcagggaagcagccctgaagcacgggggcgtccgtcgcgcgggggatgctagcgacgctgcgtttggccaggaggccgacgactccgagtgggagacagctagcgaaagcgacggcgagaacggtgccgccacggggggagaagcagacggtgagactggatggaagaatggtggccgccaggaagatttctgtgagaaaagctgagcaacagccaaatgtgtattcagagtctcaaactgagctgctacagaagcagatgctgggccttctgcggtcggcacactatgaagcatcaaatctttctaacgaaacgatctggtgacgtttttattgtcctcatcaaagcaaggggggcagaggcccaattaaattagttatccacgtcttctcgctgggtcagttgagctgtgcctgtgaccattcaatatttcctctttgatgctggtcctcctctggtgtttgtaa

SEQ ID NO: 398 - DNA, 1358 bp, Zea mays
attattcgaaaccatctcgtcgctcacgaacgcgtcagaggttttgcagaaacggagcgcgtgcggcgttcgtcggcaacgttggcgtccatggagagcaccgcgggtccgaggaagaggcagaaggccgcctcggcctctggatccgtggccccgtacttgccccaggagctcgtacggaacatcctcctccgcctgccttccaggtccgtcctccgcttccgcgccgtttgcaaggactggctccggatcgtctccgaccgcgagttcgcggccgaccacaaccgccaccagccggcgatgcccctcgtctccttcctccgcagcgccgccggtagcaagagggggcagacggactgctgcgtcgacgcatttgacctcagcgccgacagtttccggtccgtcgtccggttcgccgacaaggggacgcggtgcagcagcttcgacatccacggctcctgcgacggtctcctccttctcagcttcgatgcccgcttctacgtttgcaacccggcaacgcaccagtggacgcgcctcccggcgcccctccgcgcctcgtggctcgccggcttctaccgccacgagcccaccggagagtaccgggccttgttctaccggggccagtggcccgggacggactactacatcatggtggcggactccaggaaagggaggggaattggcctgccgtcggagaaatatgggtacaagttcaggagacaaccgtatagcctgccggtcctgctccgcggccacctccactggatggcagccattgaaggctacgactacgagatgttggcgttcaacacgacgactgaaaagttcacggttatgtgccctcctgtggttcggtggcacatgtcgctagctgaggtgggcaacgagctcgcgttgttgagctgcggccaccaggtcccgatgctcgagctctggattctgaaggattacgagaacaagagctgggtctgcacgcactggattcggctgccggagttgaagatgagcaccttcgcgttcgatgacttctcgcgaatgattttcgtgtcagaaaagggagttctgatagccaccccggagcagaagctgttgcgctatgacctgaatgggactctgctggaaagcttcccttgcaataatggcagccatctcaagattactccgtacaccttcaaggagagcctcgttcggcatgcattctttgagacaccggattgcaatgccgatggtcatgaagatgaagatgaaccagaaccaccacctttcttcctggggctgtagacccggacccggtggtgatggatctcatgggaacccttggttggagttgatcagcggttcatgcttcagatcggtat

SEQ ID NO: 399 - DNA, 1149 bp, Zea mays
gaaagaacgttacatcacgcacacacgcgcaccaaagccaagcgcccaagcccagcactcgacaccaccacagcgcgcagccacgctcacgcacaccgagctgcgggagtggagtagtggaccgatggggagcagcgggggcagcagcgagcacttcctgcggcagctgagttcgagcgacggcggcagcgcgccgcaccatctgctgcagcgagagtgggagtgcggcggcgtcaccggcagcggcagcaggcgcgggtcgcggaagaagaccagggcgcggggacaccgccgccgcggcggcgggttctgcagggcggaggaggctgcgccggggcggaagcgggtaatggtggtggtggaccagagctccggcgccaagcacgccatgttgtgggcgctcacccacgtggccaacaagggcgacttcctcaccctgctccacgtcctgccgccggagagcggccacagcagccgcggtgctgcggaggacgcctccgcgctcgccaactccctcggcgcgctttgcaaggcctgcaagcctgaggtcgaggtggaggcgcttgtgatccaggggcccaagctgccgaccatcctcagccaggtgaagaagctggaggcgtccgtgctggtgctgagccaacgcagcccctcgcctttctgctgcttcccgcggagcagcagcgaggagcttgtggaggagtgcatcgaccgggcggagtgcctgacgctggcggtgcggcggcagagcaagggcgtcggcggctacctcgtcagcacccggtggcagaagaacttctggctcctcgcgtgatccacaaccatatatttccccccttctttggaaggcgttcggtttgagtttgaaagcatgggatggaacggaacgggctgggaaatggcgtttggttcagggatacgaggtttgggaattgggatcgcctacaggagtgagcgtgtttccatggattcgggaataacgtacctaatccctgcaggtcggagggacgggatagtcctctatatatgaacgtcgtttcttccgtcatcagtcttcttcctcgcgtccgtgtgtcctcttcttcttcctcgccagttgtctctcatcctgtttctctcaacgtcttaatatgctctccaggacgctag

SEQ ID NO: 400 - DNA, 576 bp, Zea mays
cagctctgctctgtttgcttactcttcccttccatggcggcatacgccggaaccctagttccacccttcctcaccgtccgcctcgcggtctcccacctcagatccattaccccggggtcctactccctgagccactgtctcccccgcctcgcggtcgcccgtgcggcctcccgcggaaacggagacggcgacggcgggcctccagcggagggggagaaggagcggcggcgctcgtcactcccagcgctgtcggagatccggtggggggagctgctatccccggaccccaccaacgccgtggctgtggtgctcacgggcgcgctcgtatgggctggcgcctcactgctgctgcagctcgcgctcatctccgcggcaatctttgccgccgctgtcaagtactcgtttgtcgccgcgctcctgttattcgtccttatcgcgctgctgtgatcgatccgccttaaggaaaaaagctgtaaattcgcacgaagcattcggatggaagatcagatttaatttgcagaggtggcactcgtggcaaacagacactgactttgctttcctctgaagccgaataca

SEQ ID NO: 401 - DNA, 393 bp, Zea mays
ccttcacgcttgagctagctttcacaagacaaaacaagaacacaactgcagtgtaagtagcgctacgcggccggggagagatagggaaagcgggaagcaaggacgatggcgtctctgctcagcctgtacggcggcgacgccgccggcggtcggaggaggatgagccgaggtagcggcacggcgccggcgccggtgaggcgtctgctgaggaggctgaggtccagcttcatcagacggagcgcggcgcggccgaggacgagggcggcggcgaggttcgcctacgacctgcgcagctactcccagaacttcgacgacggcgtcatttcgtcgtcagctccggcggccacggctcgtgcgtagctgcgactccaggaggattctgcttcttcttag

SEQ ID NO: 402 - DNA, 1232 bp, Zea mays
agatcatggcgtcatcttcctgcgtccgcctccatcacctgccgtccacctctcgccggtcgtccgcccctggcgccccaaccaacctccagttccgcgcggcgagctgccggtggcggcggcgggttctcgttcccggcgcggcatctcctcccctacgcctctgcgccacgggttccccgcagccgcctcttggcagtgacagcaatgctccgttgtcccgcggaacccgggaggagggcgaggaggtggaggagcagcggcagcctccgcccccgctgcggctcaagatcgccgtggtcggattcggcaacttcgggcagttcctggcgcgcacgctggtggcgcaggggcacacggtcctggcgcactcccggtccgaccactccgccgcggcggcagccatgggcgcgcgcttcttcccggacgcgcacgacctgtgcgagtgccacccggacgtggtggtcctagccacctcgatcctgtcggccgagtccgtggtccggtcgctgccgctgcaccggctccgccgcgacacgctcttcgtggacgtgctgtccgtgaaggagttcccgaagcggctcctcctgggcgcgctcccggaggagatggacatcatctgcacgcacccgatgttcgggccggagtcggcgcccagcggctggacgggcctcccgttcgtgttcgacagggtgcgcgtgggggactcgtgcccggcgcgccgcgcccgcgccgaggcgttcctcggcgtgttcgcgcgggaagggtgccggatggtggagatgtcctgcgccgagcacgacgcgcacgccgccgagacgcagttcctgacgcacaccgtcgggaggatgctggcggcgctggagctccgcgcgacgcccgtcgacaccagggggtacgagacgctgctccggctggtggacaacacgtgccgcgacagcttcgacctatacaacgccctcttcatgtacaacgacaactccaccgagctgctccaccgcctcgactgggccctgggcgccgtcaagaggaggctcttcgacggcctccacggcgtgctccggaggcagctgttcggcgtcgaggacggggagggcccggcggagcgcacggagctgctggcggtggtgccgggtggtggtccgcctgacaccgacgaccagggcggtgacggacgcgacggcgacggtgacggcgacgagtcgggagagcagaagaatgattgatggtga

SEQ ID NO: 403 - DNA, 3259 bp, Zea mays
attgctgggtaagttggaacagaggagtgcgtattcaagatgatggacatgaggcgccactctgtgtctgtggatgccccactgtcaagaaccttggtgcagctcaagcgagtgaggtcgctgcgggatccagcgacaaactcgatgagcaagtacgcgtctccttccgatcacatgatctgggagactgcttctagcaatggggtgactccggagcttggcaggtcagcacaccatcacctggttggggaagacgaagatgtgggagctgagcctactacaatggggtcagagcggagtttccggggaccaagcgcaaggactgcatcgtataggaaatcttctgctgtcaggatcagaggactgaacccaccaagaagcaagcaggttcaccgtgtccgccaagacggccaccgcaagtcattggattctaaccactcaaaccatagctctatccgtcaattggcagacaatatggtcagcaatgtggatgcagataaggaagagggggaagtgaattcctatgaaagaccaaaacttgcaatgccagataagtctgacgaagaggtgaaaatgccaggctgctccaaatccaggagcaagtcttctgctgcaatgagccgtgttgggagcccctgcatgtcagccagtgaggcacgctcagttgggtcaagaagaagcactttggggcatggaaccgaggatacacgactgaggtcaaatgatgtcgtgggatccaatttcagtggctgtggtataagctactgctggtcaggagcgtcaaagtaccgggagctttattctgacagcgatggtccagaccaacctctcttatccacagatgggattgaggcagcattccaaggcaatgtaccatacactgagacactgaggtgtctaagccagaagttccgccctcgttccttcagtgaactgattggcctaaatgtcgttgcccagtccctcctatattccacttgcaaaggaaaagttgctccaatgtacttgttccatggcccccggggtacaggcaagacatccacggcaaggatttttgccgcggcactgaactgtgtatctcttgaggagcaaaggccgtgtgggttctgtaaagagtgtgtcattcttttctctgggaagagcagagatgtgaaagagcttgacgctgcgaaaatggatcgtctaggccgagtgaaggcacttctcaagagcgcatcgctcgtgccatactcctcgcgcttcaaggtcttcatagtagatgagtgccacctcttgcgagaagatgcatggtcagcaatactgaagagccttgacgagccataccggcacacggtgtacattatgatcacttctgacatagaaagcctgcctcgcgcttccatcacacattgtcagaagttccattttccaaagataaaggtggcggatattgtctacaggttggagaggatctgtatagaagaaggattggaatttgaccatgatgggttgtacttcattgctgcaaagtctaatggttctcttagagattcagaaataatgcttgatcaactcagtttgcttgggaagaaggtcacaatttctcttgtgcatgaacttgtaggatctgtgtctgatgatgagttgattgaattgcttgatctagcgttgtcatccgacacaaccaataccgtaagacgagctcgagaacttatggggtcagcaatcgatcctctgcagctggtgtctcagttggccaaccttattatggacattctctcagggagatgtcaatctgcagtcacggaagtcagcaaaagtttcttgggtagatatgcattatcagaggttggaataaagaaactaagacatgcactgaagatactatcagaaactgaaaaacaattgagaacatcaaggaatcaggctacttgggttacagttgcgcttttgcagtttagcaccaatgaacctaaccctgttgctgaaacaaatgatatgcatgcacattcagtaactggatatacagatgactgggtttccaaggtgcactcaagtgccaatttttgccaggcatgtaacagcagcaagtccaactgttctgagagacactgtaggcggcttaagctcgagaacatatggaggagagccattggaaagtgtcgatctaggtcagctaaaagtttcctcaggaaagaaggcttcttatcgtcggttcacgtcaccgaagagctggccatagcagaagttggttttgaacacccagatcacctgtcaagagcggagaaaatgcaaagcctaatagaatcctctttgcaacacgttcttgggtgcaatgtggagatcagattcaaactcgtgccatgcccagtgagcaaagatgctaggttgaagagacagccgttcagctttctcaactgctctggccggaagcaagagctgtcagattcagtcgtgactgatgaagacgaagctgcgagggggcctggagcaagagagacaccgcttaaaggctacacctctagccagcaggaatcaccatacaccatgcgacgtgtcgattcgaaaccaacaacggtccacggttgcgaggatgacgcccggagtaccttgacgtcaagcagatccacggcagatgacctgacaaggacgtgcaggtcggagactggctacccaaagggtgtgcgtgagcagggccgctctgatggcacgcagcaggagcctgacctacagccgaactgcttctcgcgaacgctcaagcttcagaagaagctgctgtcttctggcgcagcgcacaccatctgtctgagggtccagccacataacaagatggatttcctgcctaagaaagagttcgatacgtacttctgcgcgtatgagccctacgagcagtgtccaagatcagattcaagagctacttacagttcaagagacgatgacttgtggagcaagaattcacgctttggctcgaatctactctgctggagagccccaaaacagtccatgtaatggaggaaagaacgagtgaactgggtggaacaaatcgattctgctacgagattttaccaattttgcccgaagctggagacatggacaccacccgcagctgcggggacaaattttgaagggaagtctaggaggggtctgtgctattcttgatcttggtaggcagctgaggattgaggaactatttagtgatgttttcttggaaatgcagatcctttataatgctagtgggcagttgtacagcgcgccagcgacgaaaccctgtgaattgttc

SEQ ID NO: 404 - DNA, 560 bp, Zea mays
ccgcgatgttcctcaggatctctcgtctcggggcgcggcttctgcgcgagtctggagcggagacgagagctggaaatttgctaagcagtccaggcattttgtatcaagctcatcttaaccagcattcgaccagagtgcggaatgtccttttctcaactgcaacaagtggtgatcaggatgaaagcagtcaggcaaaggataaaatctcggtaacatttgttaacaaggatggctcagaaaagacaatacgtgttccagttggaatgtccatgttagaagctgctcatgaaaatgacatagagcttgaaggagcatgtgagggttcacttgcgtgttctacttgtcatgtaatagtaatggatgtaaactactataacaaattagaagatccagcagatgaagaaaatgatatgcttgaccttgcatttgggctcacagagacatctcgcctcggctgccaagtgatcgcgaagcctgaactcgatggtattcggctggcattacctgtagccacaagaaacttcgcggtagatggctatgtaccgaaaccacactgatga

SEQ ID NO: 405 - DNA, 552 bp, Zea mays
aaaggatcccaactaggcatggacgaccgcacctacaagggcggcatcaaggcgtactggaagcgccggggctactaccgcatggacggcgacgccgcgcggcgccgccagccgctccccaccgtggagctcggaaatggcgtctcccaggcccaggcccaggcccagccgccggtgggggatggctcgggccggcgccgccggtgccgcgggtggcgcgtgcgccgcggccagctggggcggcggctgctccgcgcgctgtcccctcgccggtggctcatgcggctccgcgacgcgtacgtgtccgccatgctgcggctggcctcctcccccgccgtcgggtacggcgccggcgcgcccttctgcgccacggcgacccacggcgcggcggcggcggcggccttcgcgcggccggcgcagctcaaggagtacgacgagaaggtgctggtggagatctacaggtccatactcgcgcgcggcgggcctctcgccggcgcgcctgccgccgccacgctgcggctaccgacggctgtttgagcttgaggtaccaaa

SEQ ID NO: 406 - DNA, 1631 bp, Zea mays
atctatcacctgctgctccaaggaggcggacagaggcaggcaggaaggcactcacttctccaggagcccggagtcggcagcaagagagaatggccgccgacgccgccgccgccgccacccttcgtactgctctctcccaagcaacagggcaagagcagagagcttcactgctgtgcacaccgaagcaccgagttgctgccagcaggagaagcttgagattcaccactagggccagctcgaatgcgggcgccagtgtgagcatcccgaagcaatggtacaacctcatcgccgacctgccggtgaagccaccgccaccgctgcacccgcagacacaccagcctctgaatcccagcgacctctcccctctgttccccgacgagctgatcaggcaggaggtcaccgacgagcggttcgtcgacatacccgaggaggtcatcgacgtgtacaagctctggcgcccgacgcccctgatcagggccaggaggctggagaagctgctcggcacgccggcgaagatctactacaagtacgagggaaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggcctcaactgcgaggtatggcaggtgcgcgcgtcgttcgaccagaagccgtaccggaggctgatgatggagacgtggggcgccaaggtgcacccgtcgccgtcgacggcgacggaggccggcaagaggatcctggaggcggacccgtccagcccgggcagcctcgggatcgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaggatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggtgggcttcggtaccatggaatggcacctctgatctcgcacgtgtacgagctgggcttcatggatgccgttgctatacagcagactgaatgcttccaatctgccttgcaattcgccaggacggagggcatcatcccggcgccggagccgacgcacgcaatcgcggcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggagaagctggaggcctccctcgctgccgtgcccaaagtctgacggcgttggagccaacagcacatgcgactggaatgggacgaataatccatt

SEQ ID NO: 407 - DNA, 1624 bp, Zea mays
caaagaaatagcgccaacaagttaaataatgccccctttgcacgtccccggtagtagtactcctcgcaagttctatcacctggtgctgttccatgtgcacccgttctggatccaagtcctgtacttccttttgatctccgttttgggtttcttgatgctgagagtcctgcccatgaagtccagctccgtgcctaggccctcggctctggacctactcttcacgtcggtgtcggcgacgacagtctccagcatgatcgccgtcgagatggaatccttctctaacgcgcagctcctcctcatgaccctccttatgctcctcgggggcgaggtgttcacaagcatgcttggtctccacttcacctgcaccaagctcagaaacaagagagaaacacctcataataatctccatggtaatagcttagagcagagtcgtcgtcgtcaccgtcccatggagattgaagcccatgccgccgccgtccaaatggagcttgcagggttcaacaaggacggccatggcgatttcgcatccatggctaggttgctaatgtttatcgtgctgggctacatcttggtcgtgcacatcgccggctacgcgctcattctaatctaccttagcgtggtcggcagcgcgagagcagtgcttgttaggaagaggatcagcctgagcaccttctccgtcttcacgatcgtctcgtcgttcgcaaactgtggcttcgtgccaaccaacgaggggatggtgtccttcaagtccttcccgggcatgctcctcctggtcatgccacacatcctgctcgggaacacgctcttccccatcttcctcaggctctccattacggcgctcgagagggtcacaaggtggcgagacctctgcgagctgctgagagacagaggacccggcggcgggccagctgcggctgccgccgccgccgctataggctacgaccacctgctcccgggaccgcgcacatggttccttgctctcaccgtggcggtgttcctggcggtgcagctggtgctctactgcgccatggagtggggctccggtggccttggagggctcaacgcgttccagaagctcgttgcagcggtcttcatgtccgtcaactccaggcactccggcgagatggtcgtcgacctcggcaccgtctcgtccgccgtcgtcgtgatgtatgtgctcatgatgtatctaccgccttacactacatttttacccgtagcagtggaagatgaccagcagctacaaaatgaggcacaaccccacgacaatagcagcagaagtattagcatctggcacaagctgctgatgtcgccgctctcgtgcctaaccatcttcatcgtcgttatctgcatcaccgagaggcggcagattgctcgtgacccaatcaacttcagcgtcctcaacatcgtcgtcgaggtcatcagtgcgtatggcaacgtgggattcagcaccgggtacagctgcagcaggcaggtgacgcccgacggcagctgcaaggacgcgtgggttagcttgtccggcaagtggagtgtggaagggaagctcacgctcatggccatcatgttctatggcaggctcaagaagttcagcatgcttgggggtcaggcatggaggctgaactgataa

SEQ ID NO: 408 - DNA, 1195 bp, Zea mays
ccattggtagtacacagggtcccacccacaagagaggcatggcggccacatcgtccctgaagagcagccttctcctcccgtctaccatctccgacttcagtggcgcagccgcagccgtctccatctcaacgcagaagaggagatcacggggggcgagggtgcaggtctcagcggctgcggactccaagaacattctggtcatgggggggactaggttcatcggggtcttcctgtccaggctccttgtcaaggagggccaccaggtcacattgttcaccaggggaaaggcacccataactcagcagctgccaggggagtccgacgcggagtacgcagacttctcctccaaggttctgcacttgaaaggtgacaggcaggacttcgaattcgtgaagacaagcttggctgccaatggatacgatgtggtttacgacatcaatggacgtgaggctgtgcaagttgagcccataattgaggccttgcctaacctgcaacagtacatctattgctcatcggcaggagtgtacctgaaatctgacattcttccgcactgtgaggttgacgcggtggaccccaagagccgtcacaagggcaagctggagacggagagcctgctgacctcgcgcggcgtgaactggacgtccatcaggcccgtgtacatctacggcccgctcaactacaaccccgtcgaggagtggtttttccaccgcctcaaggccggccgccccatccccatccccggcgccggcaaccagatcacgcagctcggccatgtcaaggatctggcaagagccttcaacctggtgctcgggaacccccaggcgagcaagcagatcttcaacatctccggggccaagtatgtcaccttcgacggccttgcgcgggcatgcgcaaaggctggagggttccctgagccggagctcgtccactacaatcccaaggaattcgacttcggcaagaagaaggccttcccattcagagaccagcacttctttgcgtctgtggagaaggcgacgagcgaactcgggtggacgccggagtttgacctcgtccaggggctcaccaactcgtacaacctcgacttcggccgcggcacgttccggaaggaggcggacttcaccacagacgacatgatcctcgacaagaagcttgccaccgtttgatgcatgtctcgggctagctgtaccgtacttag

SEQ ID NO: 409 - DNA, 535 bp, Zea mays
cttgtcacccgtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggatgccac

SEQ ID NO: 410 - DNA, 1023 bp, Zea mays
accacatagtgcccttaactccccagcaaccagcagcagcaaaaatcttcacgatttagaaaccctcacctcttcccttcctccccgccgccgccaccgccggaaggagaaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcaggaaccgggagcgcagggcggtaaagcgccagcgcatccgcgacgagcacaaggtcaccgtaaggcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaaggagcctttccctcttaccagtaacgatctaattgagaaggctcttggagatcacggcatcatatgcttggaagacgttgtgcacgagatcgccacggttgggccgcacttccgagaagcatcgaggttcctcatgcccttcaggctcaagtgtccggagaggaggctgcagatgaagaggaaaccctacaaggatggcggcgactcgggcgaccgtggcgacaagatcaacgaactaatcgagaagctgaactagaagcgcagaccttgcctcctccggctgtcgttttgcgttggagcgatggatctgttattaccttgtcggttttgtaatagcattagctgggtgtaccttcggctttgaaaccttacct

SEQ ID NO: 411 - DNA, 769 bp, Zea mays
aaaggatcccatttactcacacggtcacaccgcctcaactcgcgctgcccgtcgcccccaagcctcggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacattggaacacgattggttgatgagttcttagcaaagtcaaatgtatcaaggtgtgttgacttcaaggagactgccgatgttattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggcggaggtgacatgggtgcgtgacatgcttcgcggggacgatgcctatgagatgcgggtgaagcttatcaagcaagtcccggaggaatacccctacaaggatgatgactagttctactttagtgcaagattgcttgtttggattttgacatcgttttcgtcgatggtccgtagttctgctatatagggtaccttt

SEQ ID NO: 412 - DNA, 643 bp, Zea mays
agctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgcggctacgccggcttcggcagcggcgctgccgcccgtaccaaccgccccggttggaagtctggagactggatctgcaccaggtccggttgcaacgagcacaacttcgctagcaggatggaatgtttcaggtgcaacgcgccacgggactccggtagcgctgccacgacgacctacgaaaactacttgcactgaggtgtaggtagagcaaagtttacagctatagcgcgcgtcgacgaagcaggagcagcagcagcagcatgaattgaagaggagt

SEQ ID NO: 413 - DNA, 652 bp, Zea mays
acccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaagattaaggtgaagaaagaccacgcatcggtgccgttcgatgaccagtgctctattctagagaaggaggccgtgaacctgtccctggagaacctcaagacctaccccttcgtcaaggaagggctggccaacgggacgctcaagctggtcggcggccactacaacttcgtgtcaggggagttcctcacatgggacaataagcagccatcgtgatga

SEQ ID NO: 414 - DNA, 907 bp, Zea mays
aaaggatccctccgtcactcacctcgaccaccgccatggccatggccttggcctccgcgaccgccgccgcactcttccgctccgccctgtccgcgccacacggcgccggcgcgcgcgtccggccgcagcgccggcagccgttcttggctccgctccacgcggcgaagggccccggctcggcgccggtggtgctggagggcaaggccaagggaaagaagaagaaggggcccagctccgggaaccttcccgcagccctcgacgtcgagatcagggaggcgcaggagtacctcgacagcgaccagcaggaacctgttccagaaaactttccatttgaattaatcgacgaagagggtatgagcgtggttattttgagaagggactacaaggacgagaaggtcgaggttactgtcagcatgcctaatttagaaggaggccccgagtttggtgatgaggatggcgagggcgatggtgagagcgctgccaaggacgacggagaagcagaagaagatgacgagagtgccggggagagcagcatctctcttaaggtggtagtttccaaagactctggcccagagctcgagttcacatgcacagccttccgcgaggagatcaccatcgatgatatgctgatagtggagaaaacagacgacgacgacgacggagaagagaagttcccctacgagggccccgagttcaccgagctccctgtgaatgttcagaaaggcctgttcaagtacctggagcaaagaggggtaacgctgtcggctaccaactatatgcacgattacatggtgactaagcaggctcaggagtacatccggtggatgactaagctgaaggatttcgtggcgcagtgagcaacagcgtcgtgattcggcagcattgtttggttagcctaggtaccttt

SEQ ID NO: 415 - DNA, 477 bp, Zea mays
ctagcggaagcaaagcagagcagcggtcgccggccgggcacgataccagcgtcgcgagagagagagaggatggcgttcatgcggtaccgcgcgctgccgcggggggagctaacagcggaggagttccgggcgtggctggcgcagttcgacgcggacagcgacgggcggatcagcagggaggagctgcggcacgcgctgcggagcctcaacgtgcggttcgcgtggtggaaggcgaggggcggcgtgcgcgccgccgacgccgaccgcgacggcggcgtgcagctgggggaggacgaggtggcccgcctcttcgccttcgcgcagagccacctccgcgtcaagatcgcccagctcgggtactactagtactgctgatccgtcgtcggccgatcgatcggccaatatggaggcatggagcatatggcatcgatcgatgggtttgtcactactcgatcgtcacttgtttgtcacagctgg

SEQ ID NO: 416 - DNA, 1628 bp, Oryza sativa
cttttgcgcaagtttcaagcgatgcgccaccgcgtcggccccgccgccgccgccgcggcggcgctccggcggttctcccacctccgcccgccggccccgccggacccgaggctcgccttccttcgctcagagtttgatggccgtgagcccggccgacagccaccgtcaccggaaacaagagaggagccaaaaggtggcgagcgcgcgcgctcgccggtggccgtggatatcgcgcacccgtggccggagtgggtggcgctgatggagctcctccttcagaggggccacctcgacgcctccgtgttcgccggcggcgcggctggctcgccgtccaaggattccaacgttatccgcaccgcctgcctccggtttgggcgagagcggccggagcttatcaggcatctatcaagatgggatatccaggttgctctccggtatgggtgccccagcattgacaggaaggttgttaattctgggaagcgattacgtgctcatgtaggccttgatgaaggagaggtctgcagccaatgcaatttaaggggtggatgcgagagggcatatgtaaaggctcggaaggaggaaattggaagaactgtggatgttatgcgcatccttttgacttatgggcttgacacagttactggcaatgtggagaacagagcatgtctaaacaaaaccgttaaagaatccattaagagcctacttaatgagattgttgggttcgattccatgggtcctggttccagcactgaaaagcccacacaccgtatgccaaaaggacaatcttctattcctatgaagcagggtgattggaattgtcccaaatgcaacttcttgaactttgcaaagaatataaaatgtttacgctgcaatggagaatttgaagagaggtatcagctgctccatgagaaccaagagcatcttcctctcaaaaagggtgattggatatgcaaaaggtgcaactttttgaattttgcaaagaatacaagatgccttcagtgccatgagaaaccaacaaaccgtcaactcaatccaggggaatgggagtgtgtctcgtgtaattatttgaacttcaagaggaatgcattctgtttgaaatgtggttggaaaagaccaaaatcattgaacaaccaagacagtattgaatcacaacgtgacttagatgataataagcattctgctatttcatttatccaagatggcatccaatcgaggaggcaaattctgcaaaataaggctccattgtctgacgaagattcagacttctggagctccgaggaggaaggggcctaccacagtgacaaaaacattcccccaataaagaaggattacaagttccttgaaagttttcccatcattgggggtaggactgctatgtctcaagatcctcttgagagggagaaatggaaggacgaaatgtccaggagaaacaaagggctcctaacagaagtatcagaagaaagtaatcggccttcgtgccccgttcgtattccgagaagcattgagcagattgaatctggtgacgacgacgacgacgacatttcatcatggttttctggtggtactagtaatattaacatgaaaaaggcatagccagatttctgtaaacgctagtatctgcacaattt

SEQ ID NO: 417 - DNA, 618 bp, Oryza sativa
aaaggatccttgctagctcactcctctcctcctcgtctaccttacctagcagcagcagctagctagcttaattagctatagcagccatggcggcgacggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacgaccaggttgccgccggctgggtcctcacctgccacgcctaccccaagtccgacgtcgtcatcgagacccacaaggaggacgacctcatctaatcaatcaagcaagctccatatttataaatctctcgatccatctccatgcgttcttgagtttatcaattaagaatataatgtcgtcgtccctatgctatgcaagggtaccttt

SEQ ID NO: 418 - DNA, 3326 bp, Oryza sativa
cggcgatgagctcaggcggacgcggcggcaagcggcgaggggcgccgcccccggggccatccggggcggcggcgaagcgggcccaccccggtggcaccccgcagccgcctccgcccgccgcgacggcggcggcgcccgtggcggaggaggaggacatgatggacgaggacgtcttcctcgacgagaccatcctggcggaggacgaggaggcgttgctgctgctcgaccgggacgaggccctcgcctcacgcctctcccgctggaggcgccccgcgctccccgccgacctagcgtccggctgctcgcgcaatgttgcttttcagcagctggagatagattatgttattggtgagagccacaaagtactgctccccaactcatctggtcctgcagctatactcaggatatttggcgtaactagagaaggtcacagtgtatgctgccaagtgcatggatttgagccatatttctacatcagttgtccaatggggatgggccctgatgatatttcacgcttccaccaaacactagaggggaggatgaaggattcaaataggaacagcaacgtgccaaggtttgtgaagagaatcgaacttgtgcagaagcagacaatcatgcattaccaaccacagcaatctcagcctttcctcaagatagtggttgctttgccaacaatggttgctagttgtcgcggcatcctggaaaggggcataacaattgaaggccttggttcgaagagttttctgacatatgaaagcaacattctttttgcacttcgcttcatgattgactgcaatattgttggtggtaattggattgaagttcctgccggaaagtatatgaaggcagctcgtatcatgtcctattgtcagctagagttggattgcctatattcggatttggtaagccatgctgctgaaggagaacattctaagatggctccatttcgcatattaagttttgatattgaatgtgccggtcgcaaaggtcacttcccagaaccaactcatgatcccgttattcagatagctaacttggtcacccttcaaggagaaggacaaccttttgtacgcaatgttatgacgcttaaatcatgttctcccattgttggagttgatgttatgtcatttgacacagagagggatgttctacttgcttggagggatttcatacgtgaagtggaccctgatattattattggatacaatatctgcaaatttgacttaccctatcttattgagagagctgaagttcttaagatagtagagtttccaatacttggacgaatcagaaatagtcgtgttcgtgtccgtgacacaactttctcttcaaggcaatatggtatgcgtgaaagtaaagatgtagcagtggaaggaagagtacaatttgatcttctgcaggctatgcaacgggattacaagcttagttcttattcattaaactctgtatctgcacatttcctcggggagcaaaaagaggatgttcatcactcaattatatctgatcttcaaaatgggaattcagagacacgaagacggcttgcggtttattgtttgaaggatgcctatcttccacaacgactgctagataagttgatgtatatctacaactatgtggaaatggcaagagtcactggagttcccatttcatttcttctttcaaggggacagagcattaaggtcctctcacagctactcaggaaagcaaaacagaaaaaccttgttataccaaatataaagggtcaagcgtctggacaggatacctttgaaggtgcaactgttttggaggcaagggctggattttatgagaaacccattgcgactttggactttgcttcgttgtatccatccatcatgatggcatataacctatgctactgtactttggtcccccctgaggatgcccgcaaactcaacctgcctccagaaagtgtcaacaaaaccccatctggtgaaacatttgtgaaaccagatgtgcaaaagggtatacttcctgaaatccttgaagaattgttggctgctcggaaaagggcgaaagcagatttgaaggaagcaaaggatccatttgaaagggccgttcttgatggtcgtcagcttgccctaaaaataagcgcaaactctgtctatggttttactggagcgactgttggtcaattaccttgtttagaaatttcttcaagtgtgaccagctatggtcgacagatgattgaacatacaaaaaagcttgttgaagataaattcacgacacttggaggctatgagcacaatgcagaggtcatctatggagatactgattctgtaatggtacagttcggtgtttctactgttgaggacgcaatgaagctaggaagagaagctgcagactacattagtggaacatttattaagcccatcaagcttgagtttgagaagatctatttcccttatctactgattagcaagaagagatatgctggtttgtactggacaaatcctgagaaatttgacaaaatggacacgaaaggtattgaaacagtgagaagggacaactgtttattagtaaagaacctggttactgagtgccttcataaaatactagtggacagagatgttcctggtgcagttcaatatgtcaagaacaccatttctgatctactaatgaaccgtgtagacttatctcttctagttataacaaagggtttgactaaaacaggagaggattatgctgtcaaagctgcccatgtggagcttgctgagagaatgcgaaagagggacgctgctactgctcctactgttggtgaccgggttccttatgttataatcaaagcagcaaaaggggcaaaggcatatgagaggtcagaagatcctatttatgttttggataataacataccaatagatccccaatactaccttgagaaccaaatcagcaaaccacttttgaggatctttgagccgattctgaagaatgccagtagagagctgcttcatggaagtcacaccagggctgtttcaatctcaactccttcaaatagtggaataatgaaatttgcaaagaaacaattgacatgcctcggatgcaaagcagttataagtggttccaatcaaacgctttgctttcattgcaagggaagagaagcagagttatactgcaaaactgtaggaaacgtttctgagctggagatgctctttgggaggctctggacgcagtgccaggagtgccaaggctcccttcatcaggacgttctctgcacaagccgggattgtcctattttctaccgccgaagaaaggcgcagaaggatatggctgaagctagagtacagcttcaacgttgggacttctgatga

SEQ ID NO: 419 - DNA, 2289 bp, Sorghum bicolor
gcaggtagcgcaagaagataaatatacacttcgatcttatccttccagaaactaaaagcttggccatggctatggctaaaaagggagcaagcagccttctcctactcagcctctcctcctacctcctctgtgttgcccatgccgccacctcgcttagcttcagctacaacttctccgacgccggcgtcctaaccggcgccgacctcacgtacatgtccaacgccactgccgccagcgatcggatcgacctgaccaaggacacgacctggagcaccggccgggtggcgtacgggcagcccgtgccgctgtgggacaacagcagcaccggcaattccatggtcgccagcttcacctccaacttcaccttcgccatcacgccacacaacagcactttcggccagggcgacggcatggcgttcttcgtggcgccgtacccgccgtctctgccgcaggactccaacggcggcttcctggggctcttcaacaaccccaacaacacggccaacgcctacttcccgccgaccgtcgccgtggagttcgacgcgttcaggaacacctgggacccggagagcaccgtgaaccacgtcggcgtcgacgtcaacagcatcgtctccgccgcgtacgcggcgctgccggacgcgagcttcaacgggaccatgtcggcgtgggtcaggtacgacgccagcgcgagcacgctctcggcgacgctgcggttcgaccacctgccggagctcggcctctacaacgtcagcgccaccgtcgacttcaaggaagccgggctgccgcagcaagcggcggtcgggttctccggagccaccggagatttcgtcgagcggcatcagatcctttcgtggtcgttcgagtccgctctcgtcagcgtcgccgccggtgacaacacgaccggaaccaaaacatcaaacataggcctaatagccggactggcatgtactgggatcttcatactactcattgtagcagcgtggctcagctacaacaaatacctgaaacaaaggggcgccaaacaaacacaagaaccacctcaaaacacagagactcccctccacctcgatggagaaatggacgacgagttcgagatgggggccgggcctcggagattcacctacaaccagctgtcacaggcgacgcgaggtttctccgacgaggagaagctcggcgagggtggcttcggatcagtctaccgtgggtacctgcaggatcaaggtctccatgtggccatcaagaaggtctccaagacgtcgaagcaggggaggcgagagtacgtctccgaggtcaccatcataagccgcctcaggcaccgtaacctcgtgcagctcgtcgggtggtgccatgacgccgacgagctcctgctcgtctacgagctcatgagcaatggcagccttgacaagcatctctatagcacagacaacattcttacatggcaagtcaggtacgacattatccttggcatggggtctgcgctcctgtaccttcaccaggaatgggagcagtgcgtggtgcacagggacatgaagccgagcaacgtgatgctggactcgtcgttcaacgccaagctaggggacttcggcctggcgcgcctcgtcaaccacagccgcgccgcgcacaccacctggctcgccggcaccatgggctacatggacccagagtgcgtggtcaccagccgcgccagcgtccagtccgacgtctacagcttcggcgtcgtcctcctcgaggtcgcctgcggcaggaagcccgtcgtactggaggaggaagacgagagcagagtgctgctcgtgcagtgggtctgggatctgtacgggaggggcgagctcctcgacgcggcggacccccggctgaacgacggcggcggcggcggtgggttccagccgctggagatggagcgggtgctatgcgtggggctgtggtgcgtgcatccggactacgcgtcccgggcatcgatccggcaggccatgagcgtgctccagttcgaggcgccattgccggagctcccgctggagatgccggtggcgacgtatgggccgcctgttgccaggggtcacaattggtcaagcaccacgtcgtcgtccgcaagtgccaacaccggaggccactcgtcgactagtgaccggacggcggaacactcgttaggctcgtcggacaagagcagcacccatggccttttgtcacttccaagttccaacacgaggagtgcgacgaaataaggagtttttcggtgtatgatactgtgagaagagaaatatgtaaattgcgtatggaacagggttgatcctg

SEQ ID NO: 420 - DNA, 801 bp, Sorghum bicolor
cgatctcgctgaaacaagaaggaatccaatcgagagcaaatgctgtcttccaccacactccggtcgctggttccggctgcggtggcgtcgccgtcgccggcgcacgtcaccgcctgctcatctcccgcggtggggcggcgtgtgccggcggcggtggtggtgcgcgcggtgcggaactacgactccatcccgaagcgggagcccttcagctccagccgcagcatcctcgacgagttcctcaggcaggacaagcccctcgtccagcgcaccaaggaccagatcacagattattgcacgaccactgaaggtgatgaatgttgcagctgttgggatgcttactttgaactgaataaacttgagcaagagctgcccaaagaggaaatctcaaggatggttaaggactcagagggtgacgtgaggtacctgattgagagcatccatcatcgctcaaatttacggaagaagatggcagagaaatctcgtaatttagtaccatcaacctcccaggggcaaactgcaaagccaaggccattccctgtgcctgatgggataccgaaaacacaggaagagcttgctgaagaagaggaggcgttgatgccagagtctccatacacaaggttgctgagaaggatgggtagataccctgattggtacaccccacgccctgatcatgagactgactgaatcaaatcatcccccatccaggtgccccttttggaagttttgcagcatgataatctgaagctctttttatggcctgtggtaagattagcgttgcacctatgcagattaggctgttag

SEQ ID NO: 421 - DNA, 1407 bp, Sorghum bicolor
tcctttggcttggaaccaggctaccagccgaggggagagcgagacgagagcgtccctgtcctcctccagcaggcctccaccctccccgtccccgagctcgtcgtcgccacaccaggcgaggccgcggggcttcgctactcggagagggagggcggaatggggccgtcgtccattcaggagatggaggaggcccgaaggaccgcagtgcagagctgccaccgggtgctggcgctcctctccaacccgcacggccagctcgtccccagcaaggacctcatggctgccaccggggaggccgtcgccaagttcggctccctgacggccaagctcaccaactccaactccaactccaacggcaatggcctgcagctgcagggccacgctagggtcaggaagatcaagaagcccctgcccatcttcgacagcaacctcttcctcgagagctctgcggtggccgccgccgccgccgccactgtggccaagacgcccagcccgagcccgatcactggcctccagctgttcccgaggtaccaccagatggagggctcgtcgtctaaggatcctgtcaggatccctacccagttccccaagaggttactgctagagaacccggctgccggtctggaggggctgccgtccaaggcccctccggtccagatggtccagccggtgtcggttgcgcctcctgcagggacgcctaccccggcattgcccgctgctcaccttcatttcctccagcagaaccagagctaccagaggtttcagctcatgcatcagatgaagattcagaacgagatgatgaagaggagcaatcttggtgatcagggtggtagcttaagcggtggtggtggtggtaagggtgtgaatctcaagtttgatagctcgaattgcacagcgtcatcgtctcgctccttcctttcgtctctgagcatggaagggactcttgcgagtttggatggaagccgggccagcaggccattccagctagttagtggctctcagacatctagcacaccggagatgggcctggtgcataggaaaaggtgcgctggtagggaggatgggggtggtcggtgcactaccgggagccggtgccattgttcaaagaaaaggaagcttaggataaggaggtccatcaaggtccctgcaataagcaacaaggttgcagacatcccagctgatgagttctcgtggaggaagtatgggcagaagccaattaagggatccccacatcctaggggttattacaagtgtagcagcgtgagagggtgccccgcgaggaagcatgtcgagaggtgcgtggacgacccctcgatgctgattgttacctatgaaggtgaccacaaccacaaccgagttctagcccaaccagcctgatctttcaggctatcaattcaagatcgctag

SEQ ID NO: 422 - DNA, 1849 bp, Sorghum bicolor
gccgctacactctcatctgacccatggacgcgacgcaactgaaccggccaatggacgcgacgcgactcttccttggcgcgctcctcctcctcctccccgccgcgctcctcctcctgctccgcgcgcggggcaggcgccgcctcccaccgggcccgccgtcgctgccgctgctcggcagcgtggtgtggctcaccaactcgcccaccgagatcgagcccctgctgcggcgcctcttcgagcggtacggccccgtcgtggcgctccgcatcggggcgcgcctcttcgtcttcgtcgccgaccgccgcatcgcgcacgaggcgctcgtcgaccgcggcgcggcgctggcggaccgcccggcgctcgcgtcggtcaggctcctcggcgagaacgaaaacagcatcacccgcgccagctacgggcccgtgtggcgcctccttcgccgcaacctcgtcgccgagacgctgcacccgtcgcgggtgaagctcttcacgccggcgcgcgcgtgggtgcgacgcgtgctcgtcgagaagctcggcgagcccgggcccgacgccgcgccgccccgcgtcgtggagacgttccagtacgccatgttctgcctcctcgtgctcatgtgcttcggcgagcgcctcgacgagcccgccgtgcgcgccatcgcttctgcgcagcgggagggactcatctaccgctccaagaacatgcaagtcttctccttcttgccggccgtcaccaagcacctcttccgcgctcggctcgataaagcacgggagctgcggcggcgcgtcaaggagctcttcgttccgctcatcaacgcgcgccgggagtacaagaagcggggaggcgagccgaaaggggaaaccacgttcgagcactcgtacctggacacgctgctcgacatcaagcttcacgaggacggcgatcgcccgctcaccgacgatgagatttgcatcctatgttccgagttcctcgacgccggtacggacaccacgtccacagggctgcagtggatcatggcagagcttgtcaaaaacccagccatccaggagaagctctacaacgaggtaaaggctgccgccgacaacgacaaggaaggggtctcagaggaggacgtccacaagatgccatacctcaaggcggtgatcctcgaggccctccggaagcacccgccggcccacttcgtgctgccgcacaaggcggcggaggacatggaaatcggcgggtacctgatccccaagggcacgacggtgaacttcatggtggccgagatgagccgggacgagcaggaatggaagaacccgatggagttctctccggagaggttccttcccggcggcgacggcgagggcgtggacgtgacgggcaccaaggcgatcaggatgatgccgttcggcgtgggccggaggatctgcgccgggcttggcatcgccatgctgcacctggagtacttcgttgccaacatggtgctagagtacgagtggaaggaggtgcccggcaatgaggtggacttcgccgagaagaacgagttcactgtcgtcatgaagaagccgctacgcccacgccttgtccctaggaggtctcacttgaactagaactattttactgttctattgtatggtttcttgtattgtgatgaaactgttttactgttctattgtatggtttcttgttatgtgatgtatataaacatcagtgtactattcataactggcaaaaattctggttcttcaataattattcggcagagaatgtaaccttcattggatagtttcgtcttcgtgttgaccgtggatggcttgtggatatggaaaatgattatcaaaactatgccaattataaacagcacagctgc

SEQ ID NO: 423 - DNA, 3025 bp, Sorghum bicolor
agaagcggcaagtagcatttcgaggcgagcgagcgagcgggcgggcgcgatggtgagcggccacatcttccactgccggaagaactcgtggccggcggaggagtacgtcggccggaccgcgctgcagctgttggatttcgatggcggggcgccgccggagcaggcgtggcggaggcggctcaacagccacgctaacattctcaaggagttcagtgtcaccttcatggaggcaatgaggatgatgagccttggcctgagactctggtcgtatgttcgggaggaggcgtcacatggacggaaagctccgatcgatccattcacaaaagagcgctgtaaaccgtcagcttctcagggtgtgccacttggtgggatggggagcggtagcatttctagaggtttcaggggagagtttaagaattggcacatcatacctggtctgtgtgagagttcgccggtcatggagaaccagttctctatatttgtatctcgagatggggggaataagaaatactcatcagttttggctcctggacatcatgaaggtctgaagaaaaatagtgactctggaatttcttcatgggactggaatttgagtggtcaacactcgacctatcatgcattgttccctcgggcatggactgtttatgatggtgaaccagatccagaccttaaaatctcatgtcgtcaaatatcacctttcattcctcatgattacaaggatagcagccttccaacatctgtgtttgtgtatactctagtaaacactgggagagaccgtgcaaaagtaagcctgttaatgacatgggcgaattctattggaggtttttcacataattcaggaggccactacaatgagcccttcattgcggaagatggagtatcaggagtgcttctgcatcacaaaacagctaaggataatccaccagtcacttttgctgttgctgcctgcgaaactcagaatgtgaatgtgacagtcttgccagtgtttggcctttctggagaaaaccatgtttctgcaaaggaaatgtggaacaccatgcaacagaatggtcacttcgatcgggaaaatttcagtgctggttctagtatgccttcttctccaggacagaaactctgtgcagccgtctcagcctcaacttgggtagagccacatggtagatgtactgttgtgtttgctctggcttggtcctcacctaaagtaaagtttcaaaagggatgcacatataacaggaggtacacccaattctatggaacttctgagaaatcggctgttaatctggtacatgatgccttaacaaaatataaactttgggaagaagaaatcgagaagtggcaaaaccccatactcaaggatgaaagacttccagaatggtataagttcactctttttaatgagctttactttctggtagctggggggaccgtttggacagatggtcaacccccagcaatcgatgagaaaaacagtcctggttctattcagcagaagtcctcaaagaggggcactaaagacactaaacagggatctgttaaagataaccatgtcaacctgacagtggagcaagtacctcatggtggtcaaatgactaatagtgatgatcacagtgtatcaaagttcgcagcagttcatgggtcacaaatgcaagaacaagtcaatggactcaagtcagaagagccaattccttacttgatctcaaaggatggccctgaacatgttggcaagtttttgtatctagaaggagtggaatacatcatgtggaacacatatgatgtgcatttctatgcatcatttgctctccttgatttgttcccaaaaatagagttgagtatccaacgtgattttgccaatgctgtgctgtatgaagatcgacgcaaagtaaaatttttggctgatggcacatcaggaatccgcaaggttaaaggtgctgtgcctcatgaccttggaacgcatgatccgtggcatgaaatgaatgcatataacatacacgatacaagcaaatggaaagatttgaaccccaaatttgtgctccagatatacagagacttcgctgctacaggtgatatgcaattcggtcgagatgtttggcctgcagtctgtgctgctatggactatatggatcaatttgaccgtgatggtgatggtctcattgagaatgatggatttcctgatcaaacctatgatgcttggactgttcacggaatcagtgcttactgtggttgcctatggcttgctgcacttcaagctgcagctacaatggctcatcgtcttggggatcggcactttgctgaaaagtacaagctcaagttcataaaagccaaagcagtatatgaggcaaagttatggaatgggtcatatttcaattacgacagcggcacaagtagcaacagtagatccattcaagctgatcagctggcaggacagtggtatactgcctcgtcaggcttgcccccgctttttgacgagcacaagataagaactgctctgcagaaaatatttgaattcaatgtgatgaaggttaaaggaggacggatgggagctgtaaatggtatgactccaaagggaaaggtggacgagacatgcatgcaatctcgtgaaatctggactggtgttacatatgctgttgctgcaaatatgctgctccatggaatggagcatcaaggctttacaaccgcagaaggaatttttattgccggatggtcagaagaaggatatgggtattggttccaaacaccagaaggatggaccacagatgggcattatagatccctcgtatacatgcggcctcttgccatttgggcaatccaatatgcagtttctcctccaaaggctattcttgaggccccaaaagttaacctgatggaccgaatacatatatctcctcacatggcccgagcaattagcgagataagcattagaaagatagcacctgacaacagatgtttccctagctctgcctttcattgtgaatgctgatccaaaggtaacatgcagctgctgagcaacttaccaatctattcggcttag

SEQ ID NO: 424 - DNA, 1643 bp, Sorghum bicolor
gcgccttcttcagtgttagttctccacctcctccttggcggaaaaccctaacccctctcagcctcctctcgccgccgatccgacccaaattccgaacccctccggtcctctcccatctcccggcgtccccaccgcgctctccgccatgccggacgtgcagccgctcgtcagcgacttcgtcctcaagctcaagcgccggaaggtggaggggtcgcatgcggttgcccggcagacggcggagctgctacggtcggttgtgtcgcagcatcggatggttagcagcgccaaccaggctgccgcgcttgccgatgccgtacgcgctgtgggggagcagctcatcgccgccaatcccgttgagcttgctgttggaaacatcgtgagacgtgttttgcatataataaaggaggaggatatatcttccacagcagttggtatcgaaggtctttctgttactgttgacagtgatgatgaatataacagtgaacatgatgatcgtcctgcattatctgctgctgttcttgctgcacatgctagaaatgccctccgtgcaccttcattgcagactctgctagaagacattcctgtgagtcctgcagtttcccgcactgcatcatcaactggtgactcagacggaaaaagtaaatcagctggagataagagctcgactaggaaactgaagcatgatgtcatcgcagccattggtgatcttattgatgagattgactcatgctatgagccgatttctgagcaagctgtggaacttattcaccaaaatgaggtaatcctaactctaggtcgttctagaaccgtcaaggagttcctgtatgctgcgaaagagaagaagcgatcttttcgtgtatttgttgctgaaggtgctccaagatatcagggccatgttcttgcaaaagagctggttgagaaaggtgtacaaactacagttataacagattcagcagtttttgctatgatctctcgagttaacatggtcatagttggagcgcatgctatcatggcaaatggtggagtcattgcaccagtagggatgaacatggttgcacttgctgctcaaaggcatgctgtgccttttgttgtggttgctggtagtcacaagttgtgtccattgtatccacacaacccagaagtgttactgaatgaactcaaatcgccgtctgatttgctcgattttggcgagttctcagattgcatgaatttcagtactcaggatggcagccccttgctaaatgttgtcaacccaacatttgactatgtgccaccgaagcttgtgagcctattcatcactgacactgggggccacagtccatcttatatgtatcggctaattgctgagtattactcagccgatgatctggtagtgagacggaaggcaacatcttgaaagaagacaaaaagcactgcagagtctccttggtgctctgatgagcgatgttgctgtcttcagtggattcacctactgtcaaactgcaggaaatcagtgcaagcattctcgcgcattctttgtaagcattgcggcattttgagtgtaaactgttgaggaaatggggcgtgacgtcatggaaaggattgttttactataggagtggttcaaatatatggttgactggttgtgtagagggtggctgttt

SEQ ID NO: 425 - DNA, 931 bp, Sorghum bicolor
cactgcacatctctccagctctccactcgatcgaccaccgcgcgtcatggccttgttgcgcgagcacctcgacctcatccgcgcccacctcctcgacgaccaccacgtcgccgtgaccgtgagctccgatgactcggcgtcgttgcagtcgtcatcgccatcgccatcgcaatcgccgccggggcgtagtaggccgctgccagcgctttccgtctcgctgcccccgaggccaccggcggtagacctgcagcagcagcacctgtgggcgccggcgccgccgccgatgcagattcatcggcaggagcagcagcactactgctacccaccggaacccgaggaggaggaggacgatttccggcggtaccgcggcgtgcggcagcggccgtggggcaagtacgcggccgagatccgggaccccgcgcggaagggcgcgcgcgtgtggctgggcacctacgacaccgccgtggaggccgcgcgcgcctacgaccgcgccgcgttccgcctgcgcgggtccaaggccatcctcaacttccccaacgaggtcgcgttcggcgccgccgcacggtgggcggcggcgcctgctgctgctcctcagcccagcgtgaccgtggccgggaacaagaggggccgggcgaggtcgccgcaggagcaggacgccgggtgcttattggtcagggaggtgaagaaggagcgggttcaggagcccgcagcggcggcagcgggttgtggctgggatggcaaggatacggcggcaagcggcggaggggcggactacttctgggaggacgagtcgctgaagggggcgatctgcagcctgccgccgctctcaccgttgtcgccgcacccgcacctggccgtcccgcagctctccgtcagctgagacctgagatgtggcagcaagacagcggacggtggtcgcttaattaactag

SEQ ID NO: 426 - DNA, 1154 bp, Sorghum bicolor
tcccaaaccagaattattggacggtgcatgccatgacacccctcgactgcgacatgcctcctgcagcttcctgcaagaagcgcctctcgccgtcgcggcctctccctaaccgctgcttgctgatcttgatcgttgcactggcggccgccgccgcggtggccagcgcgcagctgtcgtcggaggactactacgacgcctcctgccccgccgccctcttcaccatccggaccgccgtctcgacggccgtgctcctggaccgccgcatgggggcctcccttctccgcctccacttccacgactgcttcgtgcagggctgtgacgcgtcggtgctgctagacgacacggcgagcttcaccggcgagaagggggcggggccgaacgcggggtcgcttcgcggcttcgacgtgatcgacaacatcaagatgctgctggagctgctgtgcccgcagaccgtctcctgcgccgacatccttgccgtcgccgcccgcgactccgttgcacaactgggaggaccatcgtggtcggttcccttgggcaggagggacgccaccacggcgagcgcgtccctggccaacagcgacctgcccggacctaccagcaacctcaacggccttctcaacgctttctccaacaagggtttgagcagcaccgacatggttgccctctcaggtgcccacaccgtcggccgggcgcagtgcaagaacatccggtcgcggatctacaacgacaccgacattgacgccacctacgcggcgtcgctgcgggcaagctgccccgcgcaggccggcggcgccagcgacggcgcgctcgagccgctcgacgacgccacgccggacgccttcgacaacgcctacttcggcaacctgctctcccagcgcggcctgctccactccgaccaggcgctcttcggcggcggcggcggtgcgacggacggcctggtcagcacctacgcgtccagcgccgaccagtgggggagcgacttcgccgcggccatggtcaagatgggcaacattagcccgctcacaggcaccgacggcgagatcagggtcaactgccggagagtgaattaattagctagctcacaaacacattgcattgattgcatcgtctgtgtgtatattttgcaaagaggcagagaagaattgaagtggtag

SEQ ID NO: 427 - DNA, 3298 bp, Sorghum bicolor
catcgcaagctcctggttacggcggcaaccatccttctgccgcatcgtcctccctctcgcgacgctgcccaaggtccatcgcgcctagggttcgcccagtccggcggcgcccagacaatggctggtcaccgaaacagtcatggaaagcgccactctgattatactgaaaatggaggcggtaagagaagaaatcctggtgatgatacctatgcccctggtcctgatgacactgtgtatcgctacctctgcgcctctagaaaaattgggagtatcattggcaggggtggagaaattgcaaagcagttgaggactgagacccaagctaagatcaggattggcgagagcgtccctggatgtgatgagcgagttattaccatatttagctcaagcaggaaaactaataccatcgatgatgctgaagataaggtttgcccagcacaggatgccctctttagagttcatgagaggcttgccactgatgagagtattgggaacgaagacagcgaagaaatttcacctcaagttactgttcgcttgcttgtgccatcagaccagattggatgcattcttggaaaaggtgggcacatcatccaaggaatccgcagtgagactggtgcacaaatacgcgtgcttagtaatgatcatatccctgcatgtgccattagtggcgatgaacttctccagatatctggagacacggtagttgtcagaaaggctcttcatcaagtgtcatctcgcctccatgacaacccatccaagtcacagcatcatcttgcatccagcttgacccaaccttatccagggagcaccacccaccttggtggttcctctactgcacctgttgtagggatcactccagtaattcctccttatggaggctacaaaggtgatgcggcaggagattggtcctctttataccaaccacgaagggatgagagctctgcaaaggagtttagcttgcgtttactttgtgctgctgcaaatgtggggggtgtaattgggaagggtggtggaattatcaaacagattaggcaggaatctggggctttaatcaaagtggctagctccaattcggaccctgatgatgactgcataattacagtttctgcgaaagagttctttgaagatcctgtatctccaacgattgatgctgcagttcgtttgcagcctagatgcagcgagaaaagtgattcagaatcagccgagcagtcatatacaacacgcttgctggtgtcaacatcacgtattggatgcctaattggcaaaggtggttcaatcattactgagatacgaagaacatccagagcaaatatacgcattctttcaaaagaaaatgttccaaaggtagcagcagaagatgaagagatggttcagatcagtggaggccttgatgttgcaagacatgctcttgtgcaaatagctacaaggctgaaagccaatttctttgaaagagagggctctttatctgcatttccatctgtgatcccttaccatcctttgccttctggtgcttcggatgaaccaaaatatctaagcagagacactaagcctgttgggcattatctatattcaagtgcttttcgtacatcagatgacatgattccttctgacagctatgcaagttatggtggctcccaggcacttggaggaggatatggggcttacagcggatacagtgctcgctcctctggtagtgggttatctggtcatagttctcttcactatggaaagcgtcatggttattaggatttagattgcttgataaagcaggtatgtttcttcaaccttttcttgatatgtcagaacgattatgtgattgtgcattgcccaccttaatgctttttttgccttttgaacacattgaacccagctctgctatctgatggacctgttcttttcacctttgtcccccccccttctcccctcccgtactaaaaacagccaagacattgaagtttggagcctgcttattggtgccccttcccaaaccagatgaccaagagagcccatcctggaagctttgattaagaggacctatgtggatgccatagaccacctgatattcctcacactacattactcatgtcttcctctgggcctatgtttttagccctgccgtaaatgtttcgaacctatgtattgaaaggtcgcatttgagactgcatgtatttgcttgtttgaaacctgctccagtttagtggtttttgttcaaaatatttgtttcctatgtgccacccaaaaagccaggaatatgttactcgaagaaaaaacccatagggagctgttacttgcctttccacggaagatgtgggttacttccttctcagtgatatgtgtggctgccatcctaaataaaagtaacactagaaccacattgccattttgaaagtaccatcagaaactaggtataccaaactttgctcctgcctgccaatatttcactgaattgcacattttgctttattcacctaccccgccaccaaacacaatcagtttcaccccccttgcctcaatcttcagggcctgtttggaatccagacagctttgcctggctcttcatgcaatcccaggctttggattttgtgttcctggggtgtagattgttgcctggcaggctttgaaccaaacagactccaagatcattgttgaactgaggttagctagctgaacatacatctgtacttgttcgattacaatgccgttgcaacgcacaggcaagtttaaacataaacttcaaatcattttttttgaatgagaacattaagccaatttgaagttggcgttttaagcatgagctttctaatttaattggttatagatacatgtactttggtgtaagtagctaatatctgagactttaggtagcttgaactttttaactaagctagaagttttttttggtcgtatcgatttattatatcacaatggcccaaaatttgcgatagagcatgctcatgatcttactgaacgctttgacctgatgcacatgttccaatgctttaacgactaaatgagtattggtgactgaagttctgataatgtacttggcaatttgctatgatggggaaaccatatgccaaagactgaatcgtgtgcatgaggccacagccgcaagtgttttgcaggttcactgttcatttcatgtagatttagaaggttctaagttcaccgggcttgatatgagctttttgaccttcatgtctgggagtcttgttacccaggaatgtgcaggaacatgcaaaagtaagcatgcaggtattgtttctggacgaaaatgaattagcttctggagtcgcac

SEQ ID NO: 428 - DNA, 1700 bp, Sorghum bicolor
ggatcacatatctcgtagcgtgtgggggctccggcagggagagtgaagcgaagcgaagataatggaggtggccatgactgtgactgtgacgaaggtggtgctgagcctgtgctgcgtgggggcgtgcggcctcgccgtgtacctctaccacatcctctggctcgtgccgcagagggtcctcgccaagttcaaggatcagaggatcggcgggccgcgcccgtcgttcccttacggcaacctcgccgacatgagggcggcggctgctgctgcgaaggctgcgcgcgcgtcggcatgccgtagcggcggcggcggcggcggcggcatcgtgcacgactaccggccggccgtgctgccctactacgagaaatggaggaaagagtacggtcccatattcacttactccatggggaacgtcgtattccttcacgtgagccggcccgacgtggtccgggacatcaacctctgcgtgtcgctggaccttggcaagagctcctacctcaaggcaacgcacgagcccctcttcggcgggggcatcctcaagtccaacggcgaggactggctgcaccagaggaaaatcatcgccccggagttcttcctggacaaggtcaagggcatggtggatctgatggtcgattctgcgcaaccactgctgaagtcatgggaagagagagttgatagaaatggtgggatcacagacattaagatcgatgatgacattagggcttactctgcagatgtgatctctagaacatgctttggaagcagctacatcaaaggaaaggaaatctttatgaagatcagagaactccagcaggctgtgtccaagccaaatgtgctagctgaaatgactggcctaaggttctttccttcaatgaggaacaagcaggcatgggagcttcacaaacaagtccgcaaactaattcttgaaatcgtaaaggaaagtggagaagacaggaacttactgagtgcaattcttcacagcgcaagcaccagtagggtgggcattgccgaggcagagaactttatagtggataactgcaagagcatatattttgcaggacatgagagcacagctgttacagctgcttggtgtctaatgctccttggactgcacccagaatggcaggatcgagtacgagcagaggtgcatgaagtctgcggaggccagccagtagactcacggtcacttcagaagatgaaaaatttgacaatggtgatccaggaaacattgaggttgtacccagcaggtgcctttgtatcaaggcaggccctccaggaactgaagctcggtggcgtacatataccaaaaggtgtcaacatctacatccctgtctccacaatgcatcttgaccctgagctatggggccctgatgtgaaagagttcaacccggagcgcttctctgatgttcgaccccagctacattcatacttgccatttggtgctggggcccgaacctgcctagggcaaggatttgctatggctgagctcaagatcctcatctctcttattgtctccaagtttgttttgaaactctcaccacactaccagcattctccaacactgaaactcattgtggagccagagcttggtgtggacctcaccttaacaaaagtgcagagtttctacactaagaggggcactgcaattcaagcacgttaatattagtcatcatacaatgtgatggaaagaaacctgtgct

SEQ ID NO: 429 - DNA, 2450 bp, Sorghum bicolor
tcacaatttctctcgtcgtttgttgatctgatccgatggaggctatgacgggtggcaaattccttgaaaagtttcggctctacgaaaccagatcgaaattttatcttattggaagagacaagagcagaatacactggagggtgctaaaaattgatcggttggagtccactgagctgggtgtcgaggaggatccaactatttacacagaggatgaatgccaagaactgctttgccggattcatgtggggaacatgttgactggtggactgaaatttgtcacaaaatgttacggaatagttggttttgtaaagtttcttggtccttattacatggttataataaccaggagaaggaaaattggcacaatatgtggccatgaaatttactccgttggcaagagcgaaatgatcgcaattccaagtgttatagtctggcccaacgtggcttattctagggatgagaacaggtataagcgcctgctttgttcagttgatctttcgaaggatttcttcttcagctactcttacaacatcatgcgcagccttcagaagaacatatccgagaagaatactgggcaggttgtttatgaaacaatgtgtgtatggaatgaatttctgacgagagcaattcggaatcatctcaagaatacctgttggactgttgccttagtccatggattttttaaacagtcgaagctctctgtatctggcaaggatttttggttgacccttatagctaggcgctcgcgacattttgctggaaccagattcttgaaacgtggagttaatgaaaagggcagggtagccaatgatgttgagactgaacagattgtttttgaagacacatctgatggaatcccaactcagatagcttctgttgtacaacatagaggatcgatacctcttgtctggtttcaggagacttcaaggcttaatattagaccagatattatattaaaacctgatgtggactacaaggcgactcgccttcattttgagaaccttgcacttagatatgggaatccaataatcatcttgaacttaataaagacccgcgagaagaagccccgtgaatctctgctccgtgcagaatttgcaaaggctatccattacattaacaagagcctacctgatgacaagcgtctaaaatttttacacatggatctgagtaagctttctcgaaggaaaggaaccaatgtgcttgcactgttgaacaaggtggcatcagatgtgttggatctaactgaattcctccactgcgaaataagtacatcaacaaaacctgatgacacctcaagtggagaagaaactgttggcagaccacttgatgacagaagtagcagagatcaaactgaatgtgcagctaagttggcacctcttttattacagaagggtgtcctcaggacaaattgcatagactgcttggatcgcacaaatgttgcacaatttgcatatggtttagttgctttagggcgtcaacttcatgtattggggcttattgaagcacagaaaattgaattgcatgatcctctggctgatgatctgatggatttctatgaacggatgggtgatacattagctattcagtatggtggttctgctgctcacaacaagatcttctgtgagcaaaggggccaatggaaggcagcaacccaatctcaggagttccttcgaacccttcaacgctactacaataatgcctacactgatcacgagaagcaggatgctataaacatgttcttaggtcatttccaacctcagcaagggaaacctgcattgtggaagctggactcagatcagcattacaacattgggaggcaaggaactttaaaagaagagattggaagatcattcataaagaggtcgctatcagatggtaacatattgttggagaacagcttgcctataactaactgtaacaatgaaacaaacagcacagaattgctcccaatgcaacagctggatgatattagagaaccttctgattctgcgccagagatctccatatgcgaacctaacccgtgctccagtatgaactatggcacagtgcctggaagacactccatgtcagaagagcggcagagttatttgaaaagattaggttaccctgaattgcattcttcaaatttccttgaccttgatttgttgtcatcttcagggaattcgtgtgatgaggaagtttttgagaggtcatcactgatcaattcacctatggatgtgatcagtgttgaatcatctacgtcatacagtgaacaaggacacatagatgagggcagggatgacacagatctttcccgttctagcagccagctctcagacgttcgggactattctgatcgctttgcgcactgggtcgcaaatggaggcatgctttgctactaggccctgggttttgtcttggtgaccgaatttgtgacacagcaagaaatggatgtctagcggatagagcag

SEQ ID NO: 430 - DNA, 945 bp, Sorghum bicolor
ctgaagctgacgcatagaaggtgcatgcacagcacaacaacgaaggggaaaggtgcgagcaatggacgctgacgccggaccagagcgatacgggtgcgtgcactacaggaggaaatgcaagatacgggcgccgtgctgcggcgaagtatttgattgcaggcactgtcacaacgaagctaaggattcactcgaggtcagcatccaagaccgccacgtggttccacgtcacgacatcaagctggttatctgctctctctgcaataaagaacaggatgtacaacaagattgttcaaattgtggagcatgtctcggtaaatacttctgcgcgaaatgcaacttcttcgatgatgatgtatcaaagaaccaatttcactgtgatggatgcggcatatgtagaactggtggtgcagaaaatttctatcactgtgataaatgcggttgctgctatacctctctattgaaggattctcaccgttgcgtggacagagctatgcataacaactgccccgtatgcattgagtatctattcgactcgacgaaagctatcagtgtgctccattgtggacacacaattcacctggaatgcctttacgagatgagagcgcatcagcagttctcatgcccagtttgcctgaggtctgcctgcaacatgtccgacatatggcaaaagctggatcaagaggttgcagcgtccccgatgccggcgatctatcagaagaagatgatatggatcctgtgcaacgactgtggcatgacggcgaacgtgcagttccacatattggcgcacaagtgccctggatgcagctcttacaacacccggcagacgaggggcgatccagctgcatgctccagagtttaagaacaagtcacgaaaagcaaagaaacgagactgcagtgcgcagaggctcgtgtgtgatcgatcgatcaataagctctaggccctag

SEQ ID NO: 431 - DNA, 1520 bp, Sorghum bicolor
cgtgaatggtgccaccagagggcgcccagacctgctggcgctggcgtccgcctccctataaaaaggtggagtggaggcacacttggaccacaccaaaccaaaccgttctcggcgtctccctccctccggcggcctccagagcccacccaaaaccacctcggtctccctgtctgtctccctctcgccccccgtttgcgtttgcccatcccatggcgacccacggcggcgagaacggcagcgggcacgcggcggcggagtggcggttcgcgcgggcggcggcggccaaggacgtggccggggcggacaagatgagcatccgggcggcgcggttcaagatcagcgcgagcgtggacgcgcgcgacccgcggcccgtgctgccgctggcgcacggggacccctccgtgttcccggccttccgcaccgccgccgaggccgaggacgccgtggccgccgcgctccggaccggcaagttcaactgctaccccgccggcgtcggcctccccgacgcccgccgtgctctggcggagcacctgtcaagtgatcttccatacaagctgtcaactgatgacatcttcctcactgctggaggcactcaagccattgaggttgtcgtctcagtccttgcccaaccgggcaccaacatattgctcccaagaccaggctatccaaattatgaggcgcgtgcagggctgcacaacttagaagttcgtcgtttcgatctgattcctgaaagaggctgggaaatcgatatcgactctctggagtcgattgctgacaagaacaccaccgcaatggtcatcataaaccccaacaatccttgcgggagtgtctatacccatgaacatttagcaaaggtcgcggaggtagcaaggaagcttggaatactagtcatcgctgatgaagtatatggaaatctggtgtttggggacacccctttcgtccccatgggtgtctttggccacattgcccctgtgttgagcataggatcactatcaaagagatggatagtgcctgggtggcgacttggttgggtagctgtatgtgatcccaacaagattctgctaaacacaaagatcattgcatccatcacaaacttccttaacatttcaactgacccagcaacttttgttcagggagcacttccccatattcttgagaacacaaaggaagattttttcaagaggatcattggtctgctagcggaaacatcagagatatgttacagagaaataaaggacatcaagtgcatcacttgccctcacaagccagaaggttccatgtttgtcatggtgaaattaaatttgtatcttttggaagggatcaatgatgatattgatttttgctgcaagctggcaaaagaagagtccgtgattttgtgtccagggagtgtattgggaatggaaaattggatccgtatcactttcgccattgattcatcttctcttcttgatggtcttgagaggatcaaatctttctgccgaaggcataagaagaagaatttgcttaatggccattaataa

SEQ ID NO: 432 - DNA, 818 bp, Sorghum bicolor
agtggttgttcgtcctgtcggcggcgggcggcggagggatggagacggcggccgcggcgatgctagaggccggggtagggcggttctcgcgggcgccggcgatggccacggcgctgctggcggagatgtgggcgccgctggccgtggcgctggcggcgctggccacgctgcccagcctgctgcgccgcctgcaggtcatcgtgctccgcctccggtcccgcgggaaggaggtcatccagtcgcacatcgggacctactactcgtcctgcgacgaggaggatggctccgacgacgaagacgagagctccgacgacgaggacgaggacgccagctcctccggcgacgacggggagggggaggatctgaagcggatcgggttctacgagggggcctcggacggcgtcttcccctggggcggcgccgtggtccgcacctggcagggcctcccgcgccgcttctccggctgcgcctcgggtatcggaggaggtttcggcggcgccaccggaggagcgttccctggagctgtcaggctgtggggcgccagcacggccagcggcggcgagccgtggtgggccgccgtctgcagcgccgatgaaggcggctgccgtcgcgacggcggcgcggccgcggccgcggaggcggaccaggtcgtcgtcgggtggcggcgcgagcacgcgtcgcagcagcagcagcagcggcggcgccggcggcgtgccgttcccctcgctcacacgggccagtgaaacggaacggcacggcaacggggatgggggaagactggttaggcgccgcgccggattggttggtgacaacattaa

SEQ ID NO: 433 - DNA, 2163 bp, Sorghum bicolor
aaagtcgacgccacggttatttatctccctcgctccgctccgctccgctttcctaatccgcgagctggggggagatcgagacctaaagcggagggcgggcgggcggcgccgagggccttaggcgaatggcggtggaggaggccgcggagagctgcggcagtcacgccgcggccgccgccgcgtccggcggccgcgcggcggggcccgcgacgtcctcgtcatcggccgccgcggcggcggcgctggcgcggaagcagcagcagcagcagcgccacaagctcgaggtgtacacggaggttctccggcgcctccaggacgccggcccgcccgacgcgcgggcgcccgggttcgacgacgagctctggaaccacttcaaccgcctcccagcccgctacgccatggatgtgaacgtggagagggcggaggacgtgctcacgcacaagcgacttctggagcaggccaaggatccggctcagcgcccggctttcgcggtgcgggccgtgcaggtatctccaattcttgatgggaatcagattgatgctgattcgaacactgcaggggaggaagtcgcttcaagactgaacaggcagcaaagcatacatcctcctgctttcggttcttctacaaatcttgaagcccttgctcttgaagctagcaagtctcatcaagatcatgatagcacttctgataatggtcgatctctgtacaggcccatgcatgaaatcaccttttcaaccattgacaagccaaaacttctcagtgagctgacatctctgctcggtgagcttggtctaaacattcaagaagcacatgcattttcaacaaatgatggctactcacttgatgtctttgttgttgtcggttggcatgacgaggaaacagaggatttagtagaagcagtgcagaaggaaattggcaggattgaagagacacaagcatggtcttcatctcattcatggtctactccagttgaaaacatacagattgctgagaattcagcagctgaccatgttgagataccaacagatggtgctagtgaatgggaaattgatgtaaaactgctcaagtttgggaataaagtagcatcaggatcatatggtgacctttaccggggtacatattgcagtcaagatgttgctattaaagtgctgaaacctgagagaataaatgcagacatgcagcgcgaatttgctcaggaagtatatattatgaggaaggtccgtcacaagaatgttgtgcaatttattggtgcttccactaaacccccaaatctttgtataatcacagaatttatgtccagtggaagtgtgtatgattacctccataaacataaaggtgttttcaaacttcctgctttagttggagttgcaatggatgtgtcaaaaggcatgaactacttacaccagaataatattattcaccgtgatttgaaaactgcaaaccttctgatggatgaaaatgggactgttaaagttgctgattttggtgttgcacgtgttaaagctcaatctggagttatgactgcagaaactggtacttaccgttggatggccccagaggtcatagagcacaaaccctatgatcacaaggctgatgtttttagttttggaattttgttgtgggaactactcacagggaagattccttatgagtacctgactccactacaagcagctgttggtgtggtgcagaagggattacggcctacaattccaaaacatactcatgcaaggctttctgagcttcttcagaaatgttggcagcaggaccctgcccaaagaccagacttctccgaaattttagaaacccttcagagaatagcagaggaggtcggagatgagcacgaggggaagcacaaggacagaacactgggtggtttcttttcagctttcagggggcggagccattgagacacggttgaagaatgaagacttgtaatgtacatggtcccggtccatccttgaaggacctacaaccagcgcctgttcctcgcacgtcagcaccagtacacagaaatacagacctgctgcagctgcagttgactgaagtggcaatttttagctgcagccatcgctttccgcctatctgcttgttattcctgagttccattattacacaatgtaacataaggagaggaagcttgggaactgtacaaggcctttt

SEQ ID NO: 434 - DNA, 2455 bp, Sorghum bicolor
ggtgtggaaccacttctgatgctgtctttgtaaatattgatggagctagctgagtagaaatggactgtagtcaagattcccaagaagaaagccatcaaagaagggagaatggtgaagaagctgaaaaggcggctgactatggaaatgctttgagccgtaaggaggcaacagaagagcttcttggttgtgttgttcatagtgaggaagaggcatacaggctgtactgtgattatgggcatcgaatcggtttcagcgtgcggaagggcaaacagtcttacttcattggtaccaagaatattcgaacaaaggattactactgctcaaaggaagggcttaaatatgatgagcctgttacagaagcaaattttaatcgaccagacacaagaactaattgcaaagcaatgatccgctttagagttgacgagaaggggcgatggacagttatacgctttgttcctgtacataatcaccagttggcgaaacctggagaaaggcacatgctgagatcagctaaatcgcttgctgttggcaaatcaggtgttatagatccatcagcatctacagagtcacatccaatcaatggtttctctgatatgacaggtgatatagctgagaattcagggtatactataagggaatgttacaatcaagtgtgcatgcagaatataacgataattgaggcaggggatagccaaagtcttgtcagctatttcaagcgtagaactaatgaggaaggcatgttctattgggatgtccaagttgatcaagaagggcgcatgactaacttcttctacagagatggtaaaagtagaaatgattatggctgctttggagatgccattatattcgacacaacctaccgcacaaacaaatataacttgatatgtgccccatttgttggtgttgaccaccattggcagaatgttgttttcggctgcgcattcttgttagacgagtctgtaacttcctatgcctgggtatttaaatcattcttggagtcaatgggaggccgatcgccaaaatcaatattcactgatcaggatgaagctattatgcaggcagttgaacaggttttccctaacacacaacattgcttttcctactggcatattgtgaagaatgcacaatctcatttaggctcactaaatacatctcaagcatttcaaagtatgtttaccaagtgtatgcaaggatccgactcagaagaggattttaaggaatcatggactgcaatgatccaggaatacaagctacaggataatagctggttgattgacctttatgcattccatcgtaaatggtgttcagcatttaacaaagacacatttgatggtggaattaattcttctcagtggggggaggtttcaagtaatattttcaatggaatttctgatgaaaatacctctcttacacgttttgcccttttgctagaaaaggttgtcaaggatctacgtagaaatgaatctgaagaggattttcgctgtagccaaactgctccagtccgtgcaattaagcacagtacagttctgaagcaagctgcagaatcatatacacataggatctacaaattatttgaagcagaatttctggatgggtgtggagcaacttcttgccacgaaacttcgagtggtggaaatttattgaggtttggaattacaatgcagggaaggggttcaaaagtatgggatgttgttcttgacacttccactatggagatcagttgtggttgtagaaagtttgaaaggatgggtcttctttgttcgcatgccctcaaagtcttcaccctgcagaatgtggacacaattccagaaaagtatgttttgaaacgctggacaaaagatgccaggagaagcatgtatacacttgctcaggatgattcaacccaacaggaatgcacagaggctgaacttgcatatcgcaatcgggcaatgcagtatgcatataacctaattataaagagccaggaattggaagaatcaagaaaaatattctgggattcccttgaaactggagagaaggcactggaagtattctttgaaatgagaaacatgcgcactcaagcagcaaaggatgctaataagaatgagaaaaagaagaagaaaacatcaaaaggaccaaacccaaaaaaagcaaaacaagccccaggagtttcctcaactgatctggagctgatagtccaaactaatgagcatcaatttcaatcttcacaagatgctcagggtaatgcaaccattggaagaccatattactatcaggttccgcagacttttccaaatgcccctatccaaccaaaccagatgtacatgcatccaaatatgcacacagtgcccctttgcacaccgcagcaggatctgtctgcatttgcaatacgccccaattcaacttttggtggtgccaagaacatctgaacttctgaaggatattaaggtccaggttcctctggatgtcattggaa

SEQ ID NO: 435 - DNA, 1531 bp, Sorghum bicolor
aaaggatcccagactgcccaccagctaagccacccagcagcacgaccgcgatcaccggccagtgagacggtacggtacaggaaaaattcccccgtcgcgcccggccggccattacgacggcgccagccgagcagacgccgccgccacgatgccgcccgccaccggcgccgtcgcatctccccccgccgctgccgggaccgtgctccttggcaggtacgagctcggcgacctcctgggccgcggcgcgtccgccaaggtgtacctggcgcgagacctgctcacgggccggtccttggccatcaagtcgttcccgaacccgcgcgccgccgccgctggtgaccggcccgtggccatcgagcgggaggccggcatcctccgtcgcctgcggcaccgccacgtggtgcggctccacgagatcctcgcgacgcgcaagaaggtccacttcgtgctggacctcgccgccggcggcgagctgttctcgcttgtcgacgcgtcgggccgcatgacggaggaccttgcgcggcactacttccggcagctggtgtccgccgtgcggtactgccacgcgcgcggcgtgtaccaccgcgacatcaagcccgagaacctcctcctcgacgagtccggcgcgctgatggtggccgacttcgggctcggcgccgtggccggcaccgccgacggaggcggcagtctcctccggcacacgatgtgcggcaccccggcgtacgtggccccggagatcctgtcgcggaaagggtacgagccggcgaaggtggacatctggtcgtgcggcgtggtgctgttcgtgctggcggcgggttacctccccttcaacgacgcgagcctcgtgaacatgtaccgcaagatctacgcgggccggttccggtgccccgggtggttctcgccggcgctgcgcgacctgctgcggcgcgtgctggacccggacccgtcggcgcgcattgacgcggacggcatcgtggcgcacccgtggttccgccacggcgccagcgacgaggagctgggccgcctgatgcacggcggcggcggtgagcaggaggaggaggaggaggcgtggtttgggccggttggggagtcgaaggcggacgaggaggacagggagccgaccgcgttcgacatcctgagcttctccccgggctccgacctgtcggcgctgttcctcggcgccgggaaggagcgggtgttcgtgggcgagcccgtggcggccgtggtggcccgcgtggaggctgccgggaggaaaggagggtaccgcgtgcggagggacgggaagagggccaccgccgtgtacgtggaggaagaggagagcggcgtggtggttgcgaaagtgagcgtgtttaggatcgccgacgccgtgtccgtggtggaggtggtaaaaggcgacggccccgacgccgtggtgttctggagcgagctgctggagccggccgtgaagcccccggcgctgagctgctgaggaggtgaagccgtgcccgcgcgcggcggggagctgtgcgatgtgattatttaggaattcttt

SEQ ID NO: 436 - DNA, 1391 bp, Sorghum bicolor
aaaggatccagggtaggtgccaggtaaactctgaaggcgaccaccgggaccgggcggcgatggcgaccgccgcgagggacaggcgcctgccgccggcgctgcccctggccacgctcatcggccgcgagctccgcgcggggggctccgagcgcccggcgctgcgctatggccacgccggcttcgccaagcgcggcgaggattacttcctcgtcaagcccgactgcctccgcgtccccggggaccccgcatccgccttctccgtcttcgccgtgttcgatggccacaacggcgtgtcggcggcggtctacagcaaggagcatctgctcgagcacgtcatgagcgcgctgccgccggacatcggccgcgaagactggctgcaggcgctgccgcgcgcgctcgtcgccggctttgtcaaggccgacatcgattttcagcgcaagggggaagtgtctggaaccacggcgacactggtggtcatcgatgggttcacggtcacagtggcgtcggtgggcgactcgcgctgcatcctggacacgcagggcggcgagttgcagctgctgaccatggaccaccgcctggaggagaatgcagaggagcgggagcgcgtcacggccagcggtggggaagtaggtcggctcaatctcttcggtgggcaggaggtcggtcctctccggtgctggcctggtggcttgtgcctttcaagatccattggggacatggatgttggggagttcattgtgcccattccacatgtcaagcaagtcaagctatcaaacaccggaggaaggctgataatagcatcagatggcatatgggatgcgttatccaatgaagcagctgcacaagcatgcagaggattgcctgcagaactggcagccaagcttgtcgttaagcaagctctgaaaacaagcgggctaaaggatgataccacctgtgtcgtagttgacatcatcccatccgatcatttgacatcaccgcaattgtctccaaagaaaaatcagaacaagttgaagtcactttttcgtagaaggtcgcatagttcagttggaaagcttggaggaaagtctgcctccattggttctgtggaggagttatttgaagaaggctctgcaatgttagaagaaaggttgggtaggaatttgtccttgaaagcagcttcaccaccttttcgctgtgcaatctgccaagtggaccaagagccattcgaagatttgatgacagataatggaggtggttactgctcttccccatacgctccatggggtggtccacatctctgtttggactgtcggaagaagaaagatgcaatggaaggtaagagatctagccgctctacagcatgcaggtgaaacaatcaagactctgtttaagtcaagcctgcgggtaccttt

SEQ ID NO: 437 - DNA, 1343 bp, Sorghum bicolor
aattccagtccgttcctcgtccgtttcctcctccggggccaggcttcaccgcacctagctagctttctttcttgtcgttcgccgccgtgtgccgtgccgtgccgtccatggctaggaagtgctctagctgtgggaacaatggccacaactcgaggacctgcagcgggcacggcaggacgacggtcttcgtaggccacggcggcatcggcggcggcggcgtgaggctgttcggggtgcagctgcacgtggccgggtcctcgcccatggccatgaagaagtgcttcagcatggagtgcctgtcgtcgtcgacgttgtcgtccgccgtgacgccgacgtactacgctgccgctctcgccgccaccaccaacagcaactcgccgtcggcgtcgtcctcgtcgtcgctcgtgtcggtggaggaggctcctgagaagatgaccaacgggtacctctccgacgggctcatgggcagggcgcaggagcggaagaagggcgttccatggacggaggacgagcaccggcgattcctggcgggcctggagaagctcgggaagggcgactggcgaggcatctcccgtcacttcgtgacgacgcggacaccgacgcaggtggccagccacgcccagaagtacttcctccggcagagcagcctgacgcacaagaagcgcaggtccagcctcttcgacgtggtggagaacgctgacagggcggcgacgagctccattaaggacagggagcaggagcagcgcctgaggctcaaggatgctgcgatcgcgacgaccgcctctgcagcagcacccggaacgacgacgccgacagagctcccggcgctgtcgctcggcatcatcagccggccagcaaggaggcctgagcacgtcgtcctgcctccgaccagcctgtcgctgcagctgccgcggtgctcggcggcaatgggcagcctggccctggccgcgccgaaacacacacacccttcgtcgaccctgacgccggcggcaacggctagtagtagccaggcgctgccggacctggagctgaagatctcgatcgcccggccgcagagcgacgtccaccaggtccagactgggtcgtcgccgccgccgccgaggacgccctttctgggcaccatcagggtcacataaccgaaaagacgtcgccgacgacgacgcgggaatatcctgctggtagatgaagagcagcttttgctcatctgaagaagggttggttcaacgacgggacgaggtttgggaaaactgaaaaggaggagcttttggcagtggtgtatgagcgtgtgtgttggtggcagccgtgacgacgacgacgatggcgtcgtttatcatgtgggtgta

SEQ ID NO: 438 - DNA, 3384 bp, Sorghum bicolor
ccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggattggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataagggaatttctatatacaccggtactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaatcactacttatgagaccttttttggcacataccccttagctcaagtttttgatcaaaccaatccattgacacaaacggttcatgggcgaaaagtgagttgtttgggtcctggaggattgacggggagaactgcaagttttcgtagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgacaaacagctctagattcgagggtttccgttatagccgaacgcgagggaaagatcatttctagtgatagtcacaagatccttttatcaagtagtgggaagaccataagtattcctttagttgcccatcggcgctctaacaaaaatacttgtatgcaccaaaaatctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacgtttggtatatgaggatatttatacttcttttcacatccgaaaatatgaaattcagacggatacgacaagccaaggctccgctgaaaaaatcactaaacaaataccacatctagaagaacatttactccgcaatttggacagaaatggagttgtgaggttgggatcctgggtagaaactggcgatattttagtaggtaaattaacgcctcagatagcgagcgaatcgtcgtatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagccggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaatgctacgatctggggaaaaagagtgcctaatcacgaggatccgccagaatcttttcgagtgctcgttcgagaactacgatctttggctctagaactgaaccatttccttgtatctgagaagaacttccgggttaatagggaggatgtttgatcggaataaatataaatttttttcttatttctattttatgattgaccaatataaacataaacaacttcaaattggactcgtttccc

SEQ ID NO: 439 - DNA, 2018 bp, Sorghum bicolor
tactcagttcagttgcgctgcatttggaaggcgagggcctgcactggtggtggagcaagagcaacagccgcggccgcggcgggaggtttggcgcgagagcagcgcaccgtatggcgggatcaggggaggggggaaacggcggcgtgccggcgggaggtgaagtcgcgatggcgccgggcgtggtgactggcggcgaggaggacgcctacggcgaggatcgcgccaccgaggaccagcctgtcactccgtgggccgtctgcatagcaagtggtcactccctgctgagggatccaaggcacaataaagggctctcgttcacggagaaagagcgggaagcgcactacctgcgaggattattgcctccggtagtgctatctcaggacctccaggagaagaggatgttgcagaatgtgcggcaattccaggtcccgttgcagcgctactctgcgctaatggaccttcaggagagaaatgagaggctgttttacaagctcctgattgacaatgtagaagaactacttcctgttgtgtatacaccaacagtgggggaagcttgccagaagtatgggtcgatcttcagacgaccgcagggcttatatgtcagcctgaaggataaggggaggatcttggaggtactgagaaactggccagagaagagtattcaggttattgtggtcactgatggtgagcgtattttaggcctgggagatcttggttgccagggcatgggaattcctgtggggaagcttgcgctgtatactgctcttggaggtgtacggccatccgcttgcctgcctattaccattgatgtgggaacaaataatgaagatctactaaaggatgaattctacattgggttaaagcaaagaagagcaactggccaggaatactctgagcttctggatgagtttatggctgcagttaggcagaactatggacaaaaagttcttgtccagtttgaggacttcgcaaaccacaatgcatttacacttcttgagaagtacaggacaaaccatcttgtatttaatgatgatatccagggcacagctgctgtagtacttgcagggcttattgctgctctgaagtctgttggtgggactctagctgatcatacattcttgttctttggtgcaggagaggctggtacgggcattgctgaactagttgctctggagatatccagacaggcaaaggtttctgtagaagaggctcgcaaaaagatctggctggttgattcaaagggactgattgtgacctcacgtaaagagacactccagccgtttaagaagcgatatgcacatgagcatgaacctgtcaaagatctcttgggtgctgttaaggctatcagaccgactgcactaataggatcagctggtgtgggtcaaagtttcacgaaagaggtgattgaggctatgtcttcgatcaatgagagaccgattatccttgctctatcaaacccaacatcacagtctgaatgtactgctgaacaagcatatacatggagtcaggggcgtgccatatttgggagtggaagcccgtttgatccagtgaaatataatgacaaactatttgtgcctgcccaggcaaacaatgcatacattttcccggggtttggactaggggtggtgatctcaggagcagtccgggtgtcagatgatatggtccttgctgctgctgaaggactagctgaacaggtaacaccggaacatattgagaaaggcctgatctacccgcccttttccatcatcaggaagatttcagctaacatagctgcccgtgtcgcggcaaaagcttatgatctcggaatggctagccagctccctcggccaaaagacctggtgaagtatgctgagagttgcatgtacagccccgtctaccgaacgtacaggtgatgtgaagagcgaacagtgacattggatacacggatgggtgtgtatacaacttcacctgaagattgcatatgcctatacattaacatctactgctgagctttgtacatatcttccctgtgaccgtgt

SEQ ID NO: 440 - DNA, 1432 bp, Sorghum bicolor
aaaggatccgatcacactgatcacaagcctcaaaacttttccaaaccaagttagctgcggagtgggtgctctaaagctaacgctctctgcagtctggactctggttcgcggtggccgcagctgcagcgtcccctccctttttttgccaccgagcatcacctgtgccgccggcgcgtaactgcaccgcggtcaccgcttaagaggcagaggaggaggaggacggcagcggcgttggggggtctagtctcgtcgtgcgggtggccatgggcgtgcacgccaagtcgatgagctggtacatgagcccgccggggtcgccgccggcgccggggagcgccgccaccgaggcgcagcacgcgctgagcagcagccccgggggcagcagcgacgccagcttcgacaccaacatggtcatcatcctggccgcgctgctgttcgcgctcctcttcgcgctgggcctcaactcgctcgcgcgctgcctcatccgctgggcgcgccgcgcgtcggagggggaggacggcggcgccggcgccggcgcgggcgggctcaagaagcgcgcgctccggagcatccccgtcgaggtgtacggcgcgtgcggcgccgacggagccgccgtcgacgccgacgtctgcgccatctgcctcggcgagttcgcggacggcgagaaggtgcgcgtgctgccgcgctgcgcccacggctaccacgtccgctgcgtcgacacctggctcctgtcgcacgactcctgccccacgtgccggggctccgtgctcgacggcgcgaaggccgccgccgccgccgctcccgctcccgccgcagggggcagccggcggcagggcagcgaggctgctgccatcgccgttgtcatcggatgacgtggacgggagggaggcgggccctgcgtgcgcgcccactgctggtggagccacacggcaggtatgcgagagcttcgttccgtggtccgtgagatattttgctgtgagaggccgacgagtggggccagcactctttgtaggtcacagtctagtcaaagattgcagcatgtccttcacgatattatcccttgggtctgtactttagcttggcttgctcgtcagtcgtccacgtcgcagctggctgtttgtgtatactgggagtggatggcggcgacggggtacgccgctataggcagctaggcttgcaataatacagtttagtttgtacatgttcgatttggcacagttttggagcaccgagcagagcacggaggtttgcaggtcactagattttggaaactatttttttcctttctttcctcatattacatattcgattttggcactagtatattaccgaaatgattttggcacgtcgaaaccgaaatgattccatcaatcgtgtgctctggactcctccacgcatggctgtggactgagatgctgtcgtgataggtaccttt

SEQ ID NO: 441 - DNA, 1080 bp, Sorghum bicolor
caaaccctaacggagccaacggaggcgcgcgagcggaagcatccatggacggcggccgcaagagggggaaggccgacggcgccaaaggggcctccgccggcgcgaagcggtcgcgagaatcggagtcatttcaaagtggcgtaggaagcaaatcgaagccatgcaccaattttttcagtacttctggttgtccctttggtgagggctgccattttctccattacttccccggtggctaccaggcagtttcaaaaatgaccaatctgggtggcacaacaattgcatctcctggaagaatgacgatggacgggccacctacacccaccgtgaagactcgcttgtgcaacaagtacaacactgcagagggatgcaaatggggtgacaaatgccactttgcacatggtgaaaaggagcttggcaagcctaagttgatgggcagctatatgccacctcccatggggccaagacccactggtcattttgcacctccaccaatggccagccctggcttggccactccagctagcttcggcgcttctgccacagccaagatcagtgttgatgcatcccttgcaggtggcatcatcgggaggggtggagtaaacacaaaacagatatcccgagtcaccggggcaaagctggccatccgggaccatgaatcagacaccagcttgaaaaacattgagcttgagggcacctttgatcagatcaggaatgctagtgctatggtcagtgagcttattgtcagcatcagtggcaatgcccctccacaggccaagaacccagctggcggtactcatcgtggtggacgcacaggaagcaacttcaagaccaagatgtgtgagaacttcgcaaaagggtcgtgttcgtttggcgacaagtgtcactttgcccatggtgacaatgagctgcgcaagcctgctgctgcttgagatctatgccctgtttcatacctcagtagtcattagtcaatgtaactctaaacgtcgtctctgatgatggatttgctgacttctttaggcctgcgctacagatttactgacttcagggctactactgaatttgcggacttctttaggc

SEQ ID NO: 442 - DNA, 3258 bp, Sorghum bicolor
agctcgctcctcgtctcccggtccaggaggaggtgggtgtgagggatggagaggctggagagctacctgaaggagcacttcgaagtgccggcgaagaacccctccgaagaggcgcagcggcgatggcgctccgccgtgggcctcgtcaagaaccgccgccgccgcttccgcatggtgcccgacctcgaccgccgcagccaggacgaggcccagcgacaatccgtccaggaaaaaattcggcttgccctggttgtgcagaaggctgccatcaccttcattgatggtgccaagcataaagaatatcggataacagaggatatcataaaagctggattttccattaatccagacgaactggcatcgatcacaagcaaacatgacgtgaaagctttgaagatgcacggtggggcagacggtatatccaaaaaaatccgatcgtcattcgaccatggcatatctgctaatgacctagacacaaggcaaaacatctacggcgtcaatcgctatgcggagaagccttcaagaagtttctggatgtttgtctgggatgcgttgcaggacatgactcttatcattcttatggtttgtgctttggtatctgctgttgtcggtctggcgtctgaaggttggcccaagggtatgtatgatggtttgggaataatactcagcattttgctggttgtgatggttactgctatcagtgactacaggcagtcgcttcagttcaaggagctagataatgagaagaagaagatatttatccatgtgaccagagatggctctcggcagaagatctctatatatgacttggcagttggtgatatcgtgcatctatcaattggagaccaagtacctgccgatggactgtacattcatggatactcccttttgattgatgagtccagcttgtcaggtgagagcgatccagtttatatttctcaagataagccgttcatcttggcaggaactaaggttcaggatggatcagctaagatgatggtaaccgctgttggtatgcgcacggaatggggaaggttgatgagcacattgagtgaaggaggagaggacgagacgccactgcaggttaagctaaacggagttgcaaccatcattggcaagattggcctgatgtttgccacattaacatttgtggtcctgatggttagattccttattgaaaaaggtttaacagttggtttgtccaaatggtattctaccgatgcactgactatagtaaactactttgcaacggcagtcactattattgtcgttgctgttcctgaagggctgcctctagctgttactttgagtcttgcatttgcaatgaaacagctaatgaatgataaagcacttgtaaggcatctttcagcatgcgaaacaatgggatctgctggtaccatctgcacagataaaacgggtactctgactacaaaccatatggtggttgagaagatatggatatctgaggtctcaaagtcggttaccagtaacaatagtttggaagatctgacctctgccatttctccagctacattgagcctacttttgcagggcatttttgagaacaccagtgcagagttagtcactgagaaggatggtaagcaaactgttttaggaactccaacagaaagggcaatatttgaatttggcttgaaattggaaggtcttgatgctgaggataggacctgtaccaaggttaaggttgagcctttcaattcggttaagaagaagatggcagtgttggtctcattacagaatggcatgtaccgttggttcaccaagggtgcatcagagattattgtgcagatgtgtgacatgatgatagatggcgatggaaacagtgttcccttatcagaagctcagagaaagaacatcttggatacaatcaactcctttgcttcggatgctttaaggacactgtgcttggcgtataaggaagtggatgatttcgaagatgatgcagatagcccaacaagtggttttactctagtatccatttttggcatcaaggatcctttgcgcccaggagtcaaggatgctgtgaaggcctgtatgtctgctggcatcattgtgagaatggtgactggtgataatatcaatacagctaaagctatagccaaagagtgtggaatactaactgatggtgacgtagcaatagaaggaccagaattccgcagcaagagcccagaagagatgagggacataatacctaagattcgggtcatggctcgttctttaccattggacaagcatacccttgtgacaaacttgcgaggtatgtttcgtgaggtggttgctgtgacaggtgacggcacaaatgatgctccagcattacatgaagcagatattggccttgctatgggcatagcaggaacagaggttgccaaggagagtgcagatgtgatagttcttgatgacaattttacaactataataaatgttgcaaggtggggtcgtgcggtttacataaacatccaaaagtttgtgcagtttcagttgactgtcaatattgttgctttggtcatcaactttgtttcagcatgtattacagggagtgctcctctcacagcggtgcaactgttgtgggtcaatatgattatggatacattgggagctttagctctagcaacagagcctccaaatgatgacatgatgaagaggccgcctgttgggcgaggggaaagtttcattaccaaagtcatgtggagaaatatcattgggcaaagtttatatcagttggttgtacttggagttctcatgtttgcaggggaacagtttctgagtatcaagggtgcagattccaaatctgttatcaatacactcatattcaactcctttgtgttctgccaggtgttcaacgaaataaacagcagggaaatggagaagattaatgtttttcgtggtatggtcaccaactggatctttattgcaatcatagctgtgacagtcgtatttcaagtggtgatcatagaattcctcggcacttttgcaagtactgttccacttaactggcagcattggctgctaagcattggccttggatcggtcagcttgattatcggtgccatcttgaagtgcataccagttaccaaatcaaatgaagttcctgcaagtccaaatggctatgcgccgcttcccagcggtcctgatgacatatagctgaagaagagtgatggaaaaggaattgcatttggtagcaagaaacccttgtcccgcaattacacgtttttcccccctgtttgctgttgctgctattag

SEQ ID NO: 443 - DNA, 2604 bp, Sorghum bicolor
agttcaacgtctgatgcgtttcctacatggcgctgacgaggctgctcatgatggcctcgcgcccgccgtgctcgctttcgctctcgctcccgtcgccgtcgtataagacatcgcggtgctgctgctgccactgccaccgcggtcgccgactcctccgcagcgcaatgcgggtaggagcctgccatgacctcagcaccgtcacgcccacgccgcggcagcagagtatggcggcgcagctcgatcgcgggtccctactggttggcgggcgcgagctcctcgtccgcgccccgcctaacgtcaccctacggcctgccggtgaggccgccgccgccgccgactcgggcgccgcgttcctcggagccacggcggcggcggcgtccagccgccacgtgttctccgtcggaaacctggcaagtgggtggaggtggctgtcactgttcaggttcaagatctggtggatgatcccggccacgggcgccggcgcggcggctatgccggcggagacgcagatgctgcttctggagtacaggagcgaggccaggacggagcgtggctcactgtacgcgctgatgctgccggttcttgacggcggcttccgggccagcctccaggggagccccgaggacgagctccagttctgcttcgagagcggtgatcctgatgtccagacgatggaagcagttgatgcagtgtttatcaactcaggggacaaccccttcaagcttctgaaggaatccatcaagatggtgtccaagatcaaaggaactttcagtcatatagaggacaaggagattccttcaaatttggactggtttgggtggtgcacttgggatgcattttacaaagctgttaacccaagtgggattgaggagggccttcaaagtctgcgtgaaggtggtgtgccaccaaggtttctgattatagatgatggctggcaagaaacagttgacgaattcaaggaaggggacgaagccatccgtgagcaggccgtatttgcgcataggctgagtgatctgaaggagaaccataagttcaggggagaaacctgcaagaatcttgaggacctcattaagaagataaaagaaaaacatggagtcaagtacatctacatgtggcatgctctacttggatattggggaggcgtcttagcaacatctgatgcgatgaagaagtataatccaaagcttctttacccagtccaatcaccgggtaatgttgcgaatctgagggatattgccatggacagcttggagaaatttggagtgggcatcgttgatcctgacaagatatatgagttctacaatgatcagcacagctacctttctagtgtgggtgtggatggagtgaaggttgatgttcagaacgtgttggaaactcttggacgcggacttggtggacgtgttgcagtaactcaaaagtatcagcaggctcttcaggaatccattgcccagaacttcaaaacaaacaacctaatctgctgcatgagtcacaattcagacagcatctttagtgccttgaagagtgcagttgctagagcctcagaagatttcatgcctagggaaccaacactgcaaactctgcacatcgcttctgtggcattcaatagcctattgttgggagagatcttcatacctgactgggatatgttccatagcaagcatgaatcagcggaatttcacggagctgctagagccctgagtggtggtggggtttatgtcagcgataaacctggggtgcatgatttcaatgttctaaaaaagcttgttctaccagacggctcgattctaagagcaaggtatgctggtcgtcctacacgcgattgtctgttcactgacccagtcatggatggcaaaagtctgctgaagatatggaacttgaacaatttcactggtgtcattggagtgttcaattgtcagggagctggacagtgggtttggccagtgaaagaaactgcttatgttcctatcaacgtaaacatcattggtcagctctcaccgtccgatgtagagtctctcgaggagatagctggtgatgattgggatggagagactgcagtatatgctttcggttcatgttctctttcaaggcttcagaagcacaaaagtttggaggtttcattgtctactatggcatgtgagatttacaacatttcaccaataaagattttcagcgaagccgtttggtttgcgcctcttggactgatcgacatgttcaactccggtggtgcacttcacaatgtttcaagtgttgcagattcttcagctacgaccgttcatatcagatgccgaggaccagggtggtttggggcgtattcagccaccaggccagagctttgcagagttgatgaacacgaagtggagttcactcatgcagaggatggcctgctgaccttttatctccccctttcttcctcccaggacaacctgagacacattgaaattgtctacagagctttatgaacgacatttacccttatgattcttacgctcaagcatgcaatttctgccgtgttcttcagtaaccataacacgtgcacattgaggtaatgttccaaagaaacattgttcttgttggatttgattgtgtagcagtatgctgtcctgc

SEQ ID NO: 444 - DNA, 1455 bp, Sorghum bicolor
cacctgtgagaggcaccgcctatggcaaccccgaccgtcgtcttgctgccggtctggggcgccggccatctcatgcccatggtagaagccggcaagcggctgctcgctagcggcagtaggcgggcgctctcggtcacggtgctcgtcatgcggccgccgacggagcagcacgcgtccgagctcgagggcgacatacgccgggcggaggaggccgccgccggcctcgacgtccgcttccaccgcctgcccgccgtcaagccgccgacggaccacgctggccccgtcgagttcatctcccgagtcgtgcagctgcacgcgccccacgtcagggcggccgtctcgagcctgtcatgcccggtggccgcgctcgtcctcgacctgttctgcaccccgttcgtcgacgtggcccgcgagctcgccgtgccggcgtatgtgtacttcacctgcaacgccgcggcgctctccttcttcctgcgcctgccggcgctgtgcgaggaggtggccggcgagttcggggagatggacggcgcggcggacatccccgggctgcccccggtgcccgcactctcgctcccgacgccaatcatggaaaggaagaagcctgattgcgcgtggtacgcgtgccacggcaggcgcttcatggacgccgacggcatcatcgtcaacacagccgccgagctcgagcagggcgtcctctccgccatcgccaagggccggtgcacgcgcgggaccgggagccggcctgctccgacgctgtacccgatcggcccggtgatctcgttccccccgccggccgcagagccgccgcacgagtgcctacggtggctggagtcccagcctccggcgtccgtggtcttcctctgcttcgggagcggagggttcttcaccgcgccgcgggcgcacgaggccgcccacggcctggagcgcagcgggcaccggttcctctgggtgctgcgcggcgcaccggcgcccgacacgaggagccccacggacgcggacctggcggagctgctcccggagggcttcgtcgagcggacgaggaacagggggctcgtgtggccgacggcagtgccgcagaaggagatcctcgcgcacgcggccgtgggcggcttcgtgacgcactgcgggtggaactcagtcctggagagcctgtggttcggcgtgcccatggcgccgtggccgctgtacgccgagcagcacctgaacgcgttcgcgctggtggccgccatgggcgtcgccgtggcgatggaggtggacaggaagagggacaacttcgtggaggcggcggagctggagcgggctgtgaaggcgctgatgggtgacggcgaggaggggaggaaggcgagggagaaggccgcggtggtgcaggcggcgtgccggaatgccgtcgacgatggcgggtcgtcgaccgctacgctgtcaaagctctgcaacgatatctgtcgacagtgatga

SEQ ID NO: 445 - DNA, 1044 bp, Sorghum bicolor
tcttaaaccctgcgtaagcctcgtctcgtcctcgttccccaacacaggcccctcctccttcggcaggtcgctgcctccctgcagcctcttcgttctcctctttccgtgtggtggcgcggctccggccgggggaaaaggaaggcgtgggtgcacgtacgccgggaaggagaagaagcgcacgccccgctcgctctgccgctggttcggtcttccccgccggtgacacagacagctcgtgccgtctccaccgcaaccgatccccctgttgctcgatcgctctccttccgcacgcagtggactgtcgccgttgatcctgcaggaaaaaccgggtgggcaaggaagctagtgagcccagggtgaagaagatgatgatggctgaggtggccaaccacagcaaaaggaaccacaccgacagctacttcagtggcaaagccgccgccgtcgccgtctcggccaccggcccagaggagttcgcaagcatgtcctcgaagaagccgaggaataccagcccgagaatcgcgcccgtatcaccaaaggagaagaaggacaagatcggcgagagagtcgcggcgctccagcagctagtgtcaccatttggaaagaccgatacggcttctgttctgcaggaagcatcgggctacatcaagttcctgcaccagcaactcgaggtcctgagctccccttacatgcgtgctcctccggctcccggcgctgtgcctgaggaccccgagcactacagcctccggaaccgcgggctgtgcctggtgccggtggacctgacgctgcagctgacccagagcaatggggccgacctgtgggcgccggcgaacacgaccaggcgcaggtgaggagaagcctgtcggcctcgctccttcaccatcaccaggaggagccggcctgggccggtctgcccggaggaaaccaagcaagtactactgcatctgcatgtgcgccgtggagtagaatttccaagcgcctgacccgattcgatctcctaacaagaaactaagcaaagcgtcatcgtccgtatcagccaccttgtat

SEQ ID NO: 446 - DNA, 1502 bp, Sorghum bicolor
tcaacatccacaaactcagtcgcctggcgacgagcggcgccgcaccgggccgctacgtgacctcgggacccgccgtcggcggcggggccacggccatggggatctacgagcggcagcgccacctggtggcggccggcgtgtccgtgtggggggagccgttccggcccgacgccgacgccctgcccctgtccgcggtcgtccccacggtcaccctggcgacgccgccggcgccgccgcttgacgtcgtcgaagcagaggaagtcaagttcggcaaacaccagctgttacaggcacagcagtacgacttcccgccgcaggtggaagaagaagcgccgccgccgtcgtcggatagcttcggccacgaccacgacgacgacgccgcccggccaagagacaagattcagagacgcctcgcgcagaacagagaggcagctcggaagagccggctccggaagaaggcgtacatccagaatctcgagacgagccggatgaagctggcgcagctggagcaggagctcaccatggccaggcgccagcagcagcagcagcagcacggcgcgtacggcgttggaggaggaggaggaggagtcgcggcggcggcgggcgcggacccgcgggtggccgcgttcgagctggagtacgcgcgctgggtggaggagcaggggaggcaggcgacggagctgcgggcggcgctgcagtcgcacgcgccggaggtgcagctgcgggtgctcgtcgacgccgggctggcgcactacggcgcgctgttccaggccaaggcgcaggcggcgcggtccgacgccttcttcgtgctgtcgggggtgtggcgggcccccgcggagcggttcttcctctggatcggcgggttccgcccctccgagctgctcaaggtgctggcgccgcggctgaacccgctcatggaccaccaggcggccgaggtgcgcaagctgcagaacacggcgaggcagctggaggacgcgctgtcgcagggcatgagcaagctgcagcagacgctcgtcgacgccctcatgaccgtcgacgtcgcctcgccgctcggcgccggcggcgggtacgcggcgcagcagatggccagcgccgtcggcaagctcgccgacctcgtcgacttcgtggacaaggcggaccatctccggcagcagacgctgcggaacatgcacaagatcctgacgccgcggcaggcggcgcggggcctgctcgcgctcgcggactacggccagcggctgcgcgcgctcagctcgctctgggcggcgcgcccgcgggagccggcgtaagtgtaacggaacacccccgcgacggcgacggcgacggcgacggagaagaggaagcggcattacaggcacgtgcgcgcgtggttggctttggctgccgccccggacggccggcggagcaaggctgcggcggtcagtgcctcagtctcctctccttccagctctgcatctggtattctggtacgggcaaccggcgtgttcttctgttggctctcagga

SEQ ID NO: 447 - DNA, 1068 bp, Sorghum bicolor
tattaacccacgcaatcggaccggcgcacacgacgccgccctcccatctctcgaatcccaccgtgctcagcgcgatggacggctcatccaagcggatcgacggtggcggcgccgacaagcccagccccgacaacgaccagaaccagaacgctagccccaacgtaccggcggcgtccgccgccggagacgacggcgcctcggtcgctgctgcggcggcggcggctgccgcgccgcccgccgacgggaggcggccgttcaccagcctcagccaagaggaggccgacctcgccctcgcccgcgttctccaggagcaggagcgggcgtacatgatgctgaccggcggcgagtacgcgatctcggacgccgggagctacgactacgacgaggaggagggggaagatgacgacgatgggagcgactacgaggaggaaggggaggcgctcgacgaggacgagcaggttggggacgcggaagcggagggggccgagggggaccaggacctggaccttgaccctgcgcagtacgaggacgacgaggccttcgcgcgcgccctgcaggacgccgaggagcgcgacgtcgccgacaggctcatggcgctcgttgggatcggtgattggcgagccatggagcaggatgatgctggggaccacgaggaggacgaagatgatggggttcatacacaggatgcatgggaagatgttgatccagacgaatactcttatgaggagctaattgcattgggtgaagttgtcggtacagaaagcaaaggccttgctgctgatactattgcttcattaccttcggtaacttaccatgcacaagacaagcaagatggcaacatggaacaatgtgttatttgtcgtgtggagtttgacgaaggcgagtcattagttgcacttccttgcaaacatccttatcattctgagtgcataaaccagtggctgcagttaaacaaggtatgcccgatgtgcagtgctgaagtttccacctctgcgaacaatgtgaacaagcaggcatgactattcagttggaagaaaatagcggcggcttgatttatctgccattgct

SEQ ID NO: 448 - DNA, 1966 bp, Sorghum bicolor
aaaggatccagcgggatggactcggacgtggagatgaacgccgccagcgacgaggaggtgatggacgacgaggactactacgactactgcgacagcgacatgggcgatgacggcgacggcgggagcgaggaggaagaggagctggtggccggggactacgacgagggcatcgaggccgaggggaccgacgaggtggtgtctaggcgtgagcagacatttgtggttttaaacgaagaagttatatctgagcgtcaagcggaagatgtaagcaaggtatctgccgtgttgttgatcacaagggaagaggcgtgtgccctcctgcatcactataaatggaacatcagcaagttgagtgacgaatggtttgcagatgaagaaaaagtccgccatactgttggcttacttttgaatggaaatcatgatccctgctctaggaagctaacttgtggaatatgttttgaagggtattcttctgatatgatgagctccgctggttgtgctcatttttattgccatgaatgctgggaaggctacattagtgctgcaataggtggtggtccaggatgtttgtcattgagatgccctgatccatcatgtagtgctatggttcttcaagggatgattaataaattagctaaagatgaggataaagaaaaatatgcacgatttctcttacgtgcatatgttgaaggtagcaagaagactaaatggtgtccagctcctgactgtacatgtgctgtggagtttcttggtgatgaaaactatgatgtctcatgcaattgcaagttcagcttttgctggaattgcactgaggaagctcatcgaccagtgaactgcgagactgtttctaagtggatattaaagaacagtgcagaatctgaaaacatgaactggatactggctaattctaagccctgtccgaagtgcaaacggccaatagagaaaaaccagggatgcatgcatatgacatgcacccctccttgcaaattcgaattttgctggttatgtctgggcgcatggtcagatcatggagagagaacaggtggcttttatgcttgcaatcgttatgaatcagcaaagaaagagggagtttatgatgagactgaagcaaggagggaaagagctaagaactctcttgagagatatatgcattactatgaacgctgggcatccaatcagacatcgaggcagaaggcccaagcagatctgctaaaagcggaaaaggatcagcttgcaaatttaactgacatttttgggataccagagacccagcttaagttcataattgaagcttggtcacagattatagaatgcaggcgagtgctgaaatggacatatgcttatggctactatctggatgataaggtcaagagtgaattttttgagtatctgcaaggtgaggctgagtctggcttggaacgtcttcatcagtgcgctgagaaagacttgcaaaaatttttgccttctgtgaaatctgacagcactgaaacgacggcaccaacaccggatgaatttagtgaattccgcgtaaagcttgctgggctcacaagcgttactcgtaattactttgagaaccttgttcaagctttggaagctgggttggaggatgtccgtgccactgcccaggctgctggtacatccagcgctgccaccagctccaagaaaggaggaactaaatccaagaagaagcagcccactaagccatcatctgaccacactgatgatgggtggccctgcgagcgctgcacatttcttaaccctccctcagtggatgcgtgcagcgtctgcgaaaagagtaggtactagatgatggaatagctcaaagggaggcaccccaagaaaagctcaaagttcatgagaaggaggggcgctttagatccagcatcagatgctgagcttccagcagctgcaatggtgtacagagagttatttaagggcctcaaatggttggaaacggctcgagaaa

SEQ ID NO: 449 - DNA, 1740 bp, Sorghum bicolor
ggtcgcttctttcctacgactcgcagcttcgccgtcgccgctcttcttctccttcccctacagataaagcgggtggctggcttggaagccttgcggtggagacggcggtctcggatccaacggaggcacccagatttgctgccatggcgaggtgggcggagatggtggaggaggacgacgacgacgagtacgctaagctggtcagaaggatgaacccaccaagagtggtcatcgacaatgacgcgtgtgacaacgcaactgtcatccgggttgatagggtcaagaagcatggcattttactggaagcagttcaagtccttgtcgatctcaacctcgtcatcaccaaggcatacatttcttcggacggcaattggttcatggatgtgttcaatgtgaccgatcaggacgggagtaagcttcagaacagggaggtcattgaccatattcagaaatgcctggaatcagacggctacctgcctcctccggcaaacggcggctttgtgccaccggaagaccagttcacctccattgagctgaccggcgcggaccgcccgggcctcctctcggaggtgtgtgcagtgctcgccgccctgagctgcaacatcgtgaaggccgaggtgtggacgcatgacaggcgcgccgccgccgtgatccagatcaccgacgaggccacagggctcgccatccacgacgtgggccggctgtccaaggcgcaggagcttctcagcaacttgatgcagagcgacggcaggtgcaaccgcggcgccacgggcgtgtccgtgggcaccgcacgcacggagaggcgcctgcacaagatgatgctggatgaccgcgtcggcggtggcgaggaggctgttggtggtggcgaggagaggggcggctgtggcaaggctaggcacaaggctgccaaggtggtggtgatggactgcacggagaggcagtacacggtggtgatcctgcggtgcagggaccggccgaagctgctgttcgacacgctgtgcgcgctcaacgacctgcagtacgtcgtgttccacggcacggtcgacgccgagggagccagcaaggaggcctaccaagagtactacatccggcacgtcgacggccacccggtgcgcgccgacgccgagcggacccgcctcgtccggtgcctggaggccgccgtcgagaggcgcgcgtccaacgggctggagcttgagctggaggtgaggacggaggacagggtgggcctgctgtcggagatcacgcgcgtgttccgggagaacagcctctccatcatccgggcggcgatcacgaccaaggacggcaaggcggaggacacgttctacgtgtcggacacgtacggcaaccccgtcgacggcaggaccatagacgcggtgggcgagcagctcgggcacgccgtgctgagggtgaagcgccgcggccacgacgcgtcggtcaagcacgaggccgagggcggcgcagtgtccgtcctgggcagcctgctcaagggctccttccagggtctcaggctcatcagatcctactcataaaccgtaatccaagaagtctgactagttacacaagatctgggcattgtacatagctttgattagttacacaagacctgggcatgggcattgtacataataactctgattagttacacaagacctggccattgtacatatataaatctgatgtaggttaggaaatagtgcagcagcagaacatggttcctgctttgtgcatttgcagtcaatc

SEQ ID NO: 450 - DNA, 1922 bp, Sorghum bicolor
ccgctctcgtcatcgtcgccgggcatgggcctgttcagctcgccgccgaaggtgtacaagccggccgccgacgtggacctcggcgccggcagcgacgagttctacatcagccccaatgtcaaagctcctcgggtcgccgggctcctggtgaagatcttcgtgtggatcctggagatgcccatcgtcggcccgatcgtcctctacatcctcaagaaggacaacctcatcaacaagctggtctctgacgccgacatcccggagccgccgctgttcacggcaacgcacagctgggaagacatcccggagcagaacgtgcggctgacgaagccggacctgtcggcggcggagcgggtgcaggaggccgtcggctgcctcccggcgcggctggaagccacgctggccgccgacgcgccgtcggtggggctcaggcgctggaccgtccgggacttccacgacgcgtacaggtccggcgagacgacgcccgtgcaggtggccacgaggttcctcgcggcggtgagggagagctcgagctcggcgggacctgctgggatgaacatggctttcttcatcagctgcgaccacgacgacgtcatgcggcaggccgaggaatccaccctccggtaccagagaggggcgccgctgtcggcgctggacggcgtgctggtgggcgtgaaggacgagatcgactgcgtgccgtacccgaccaccggcggcacgcggtggctgggcgcggcgcggcgctgcgaggcggacgcggcgtgcgtggcgcagctgcgggcctgcggcgccgtcctcgccggcaaggccaacatgcacgagctcggcgccggcaccagcggcatcaacccgcaccacgggtcgacgaggaacccgtacaacgccagcaaggtcgccggcggctcctccagcggctccgccgccgtcgtctgcgccggcctctgccccgtcgcgctcggcgtcgacggaggcggctccgtccggatgccggcggcgctgtgcggcgtggtcgggttcaagcccaccgccgggcgcctctccaacgccggcgtcctcccgctcaactggaccgtcgggatgccgggcatcctggccgggaccgtcgaggacgccctcatcgcctactcggcgatcgtcgatcagtcccagccatcctacttgcggccggaactgaatcttcctcagctcagctccacgccctccatcggcaacatcaagctcgccaaatacggaaagtggttcaatgacagcgctgaggacatcaggagctgctgcgacaaggctctgcaggcgctgcacgcgcactacggctggcagacggtggacgtgacgatcccggagatcgaggagatgcggctggcgcactatgtcaccatcggctccgagtgcaccacgtcgctcgccaaatacctcgacaacctgaagaggtctgagatcgggtgggacgcgagggtggcgctcagcgtctacggctccttcagcagcagggcgtacctcaactcgcagcgactccggaaccgtcagatgtacttccacaagcagatcttcaagaccgctgacgtcatcgtctcgcccatgaccggtgtgactgcctacacgctgcaagacgacgcactcaacaccggcgagctcgactacataaacggagcggcgctggtccggtactccatagccggcaacttcctgggcctgccggcgatcaccgtgaaggtcgggtacgacaggggcggcctccccatcgggctgcagttcatcggcaggccgtggtccgaggccaccctgctccacgtcgccttcgccacgcagcaggcctgcgccgacggctacaagaagcccgcggtcttctacgacctcctcaccaaacaacaccagtgaaaagcatgatcagcgatcgccgccgccggcgagccagagaggacgtgttt

SEQ ID NO: 451 - DNA, 2207 bp, Sorghum bicolor
gtgcgctagctttctctcaatccgcctcgctcgcggcgacggctgggcgtctgcccccgccgccgccgtcgccctactccaggtgcgtaggtcatctccgggcccatcaccggcgacgagcacccgccaggggcgtggaagcctggagtcctatctgatcggaaaatggttaagatcgaagaccatgccgaggacggcggcatagatgctgatgtcaggggcctcggggaggctgctgtggatccgctgcctggctcggtgcatgccaccttcaaggaggaggagggtgaaccgagttcttcatctggtaaactaagatcagagttcattggaatgggtttctcatccaagctggtagacaaggttctccagagacatggtgatgatgattctaacacaattttggaatctcttctgtcctattctgaccttaagcaatctggatccgagtcatcgggttctcttggaagtttatttgattctgataatgaagagaacaattcttctttagagtctaggaaagtaatcaaccaagacatcaagccagagcttgattctttctcagagaagtggtcatttttactcagaacaatgaacttttcacaacaagaagttgatttagccttcaagcaactaggtgatgaagcgccattagaacagctcgtggacttcattgtcaatgctcaatcaggagtatcgtctggaggaccggaaaatggtgatgctacaaatgaggggaagactgaattactctatggtgtgatggaaaaaacacttagcttgcttcagatgggctttaccgaggaagaggtatcatcagtgcttgagaattctgaccagagagcaactattcaggagctggctgactcaattttggcaaggcgaatagccaatagcattgagcagaaagaggtaaaaattgaatctgactttctaggcgaggcagaacctgattattcttcataccagccctcatactctgctgcaagctattatgacgatgacaacaacaatatacgggttaaaagggctaagcatgtatttatcgatgacacaggtgcctccagtagtcaccttggcaatccatggtctatggggacaagtgatatgcctgttaaggtagaacttgaggcaatgacaccaggccgccgtgcaaatgtacaaggtgaccttgctaaacccccatttttcttgtatggaaatatggtagacatcccaaaagacacatggtatcaactcacacagttcttatacaatgtggagcctgagtttgtgaacagtcagtccttctctgctctgactcgaaaggaaggttacattcacaaccttccagtggagaaaagacgtgtcgtggttccaaagtctccaatgactattgaagaagcacttccgttcaccagacagtggtggccctcttgggatacaaggaaacatatcagtgtagttactatagaggttggagagattgagcagacatgtgaaagattggggagcatggttagagagtcaagaggtgtgctttcagaagcaagacagatgcagattatacaccagtgcagggtttcaaaccttatttgggttggccagaacaagttaggccctttggagcctcgtcaagtggaaaggatactaggctacccacataaccatacaaatctgtttgaattaaaccaatctgatagatttggtgccatgaaatttgcatttcagactgatacattgtcatattttctatcagtcctgaaaggcatgtatccagatggaataagagtgctatccatctacagtggcattggaggtgcagaagtaacacttcatcggctaggcattcctttaaaatgtgtaatatctgttgaggaatctgaggtgaataggaaaattctaagaaggtggtggtcaaaaactgaacaaactggagtgctaaggcagcatccgggaatctggaagctcaaaacacacgtgattgaagacttggtgaaagagtttggtggttttgatctgattatcggtgggaattatacttcttgcaaaggtggtaatacagtaaatacgacaatgggcttggattccaaccgcttctatgagtatgcccgtgttgttaaaagagtaaggactgcagttggactcagttgatgagtccatctttgatgaagagcgcacatcttcataaaactagcctgtaggaggatgtagaatcatctgatgtg

SEQ ID NO: 452 - DNA, 2369 bp, Sorghum bicolor
taacaccaccctcgtttctctctctctctctctctctttcccccccactccatgtgggtggcctcgagctctgcttagatcacagctgtgcgcgctggttgggtgatccactgatccgcccccttccccccttgtcggctctcctttctttcagcccgagagctccgggacagggagatctgcgctgtcgccgcgctcgcctcgcctttcttgcgcgcgcgcgtgtgggctgggcagcagtgagcttcccccgtcttcctcagcctcgcttcccttcttcctgctggatctggctcgcaagatccgacgtttcgtgccccgtttgctcaaagatcctcgcttgggtggtggttcctggagatttctgggaggatgcagcacgaccagaagaagaaggcaccttcagagatggattttttcacggagtatggcgagggaagcaggtacaagatagaggaggtcataggcaaaggcagctacggcgtggtttgctctgccatggacactcatactggcgaaaaggtggctataaagaagataaacgacatcttcgagcacgtgtctgatgcgacgcggatacttcgggagatcaagctgcttaggctcctgcggcatccggatattgtggagataaagcatatcctgctccctccgtcgaggagggagttcagggatatatatgttgtttttgaactcatggagtctgatttgcaccaagttataaaggctaacgatgacttgaccccggagcattatcagtttttcttgtatcagctgcttcgaggattgaaatacatacatacagcaaatgtatttcatcgagatctcaaaccaaaaaatattctggcaaatgctgattgtaagcttaaaatatgcgactttggcctagcaagagtagctttcaatgatactccaactgccatcttttggacggattatgttgcaacaaggtggtaccgagcaccagagctgtgcggatctttcttctccaagtatacaccggcgatagatatatggagtattggttgtatatttgcagaattgttaactggaaaacctcttttcccggggaaaaatgtggtacatcaacttgatataattacagatctcctgggaacaccttctccagaagcaatatcgaggattcgtaatgaaaaggccaggcgctacttgagcagtatgaggcggaaaaagccgattccgtttacacaaaagttcccaaatgcagatccacttgcactaagtttgttagagcgaatgctagcttttgagccaaaagacaggccaagtgctgaagaggctcttgctgatccttatttcaagaacatagccaatgtagatagagagccttctgcacaggctgtcacaaagcttgaatttgaattcgagaggcggagagttacaaaggaagacataagggaactcatatatagggaaattcttgagtatcatccaaagatgctgagggagtttcttgagggaactgagtcaagtggtttcatgtacccaagtgcagtagaccattttaaaaagcagtttgcgtaccttgaagaacattatgccaagggatctacaggaactccacctgagaggcaacataattcattgccacggccttctgttgtctattcggacaaccgatcacaaaccacagccaacatcaccgaggatctttccaagtgtataatcagagaaaatacacaaaagccacatcaacattctgcttatgttgcaagtaaatttccaccccatgttcctcaaggtgttgttgcaaggcctggtaaagcggttggttcggtgatgcagtacaacccctatccagcatctgctgccgagcaatatgagcaacgaagaattgctaggcacccagcagttgccccaaacaatatcccttctggaagctcatacccgagaagaagtcagacctgcaagagtgagacaggtgatgctgaaaggatggatgtgaaccaagctgggcagccaaagccatatgcagcgaacaaattaccagctacggttgatggtcgtggtggccactggtagaatttctgcagtgcaccagcaaaccatttcaatccatttcttaacatgttatcagtatcgactacttatgctaagcgctacattattctgacaaaattcagaaatgtagttctgtacagatttatattctttgtcaggatacctgaatacccaaagactgtagaactgtactctttattgctgatttctactccttgttgctattcaatcacaaaaagatacgtgcctggtggagaggatttgccagactgaagtatagtgggaactcactggcagcagtgggatctcagtgcagagttcttgcctgacgttgtcatggacttgtt

SEQ ID NO: 453 - DNA, 1699 bp, Sorghum bicolor
acagaggagatcaatcaatgtattaccagccgagctgagctgagctgagctgagctgatcaccctctctccttcccccaccgtccccgttctctctcacaagaatcactctcctctcagatctcacagccaaaaagagaggagctttaaccgccgggtacggtgggctcaaaggtagccatggccaggcggcggccaccaccattccacgcccgtgtcgccgccgccgtgttcctgctgctgctgctgacccccgccccgacctcccagctcggcctgggcgccgccattgccgcctggatccacggctcgccgcctgctcctcctagccctagcactgacgacgacaccgccaccgcctcctcctcgggcgcgccggccagcagcccacggagccaggagtacgcggcgctgcaggcgctgaaggcggccgtcaccgaggaccccaatggcgcgctgtcctcgtggcagggcgccaatgtgtgcgcctacaagggcgtgtactgctccgcgccgcccgacggcgcagccgccgccgcggccggcgcgttgtccacggtggtcgccggcatcgacctcaaccgcgccaacctgaggggcacgctccccgacgcgatgtccctgctcgcgcacctcacgttcctgcacctcaacagcaaccgcctcggtggcgccgtccccgacacgctccgggacctgcagtacctgacggagctggacctcagcaacaacctcttctccggcccgttcccgtcctccacgctgctcatcccgtcgctggtgtacctcgacctccgcttcaacgccttctccggggaggtcccgccggaggtcttcgccaaagagctagacgccgtgttcctcaacgacaaccagttcgaaggccagatcccggacacgctatggggttccccggcgacggtcatcacgctggccaacaaccacttcaccggcgccgtcccggccgcctacgagttcggcgccggcggcggcggccgggtccgcgaggtgctgttcctcaacaacaacctgacggggtgcgtgccggaggcgctggggttcctccccagcatcgaggtgctggacctgagctacaacgcgctgtcgggccacgtccccgggacgctgtcgtgcctgtccgggatcgaggtgctcaacctcgcgcacaaccagctgaccggcgagctcccggacctgctgtgcgacctgcggcggatcaccaacctgtccgtgtccttcaacttcttctccgggatcagccagcggtgcgaccggcagctcgggagccgcggcgtgtttgacttcgtggggaactgcgtgccggggagggacatgcagcggccgcagcccgagtgcgacgagttcccgggggaaggaggactcagctgcctccacatccccggggcgcgcccagccgggtgcgacggcggcggcggcggcggcgtgactattggcgtcggcgttggagttggtgttggcgggctgccgttcggcctgcctggcgccgccgccggaggcgtggtcaccgtcaccgtgccgtgatctgccgccgggggcggggccggccaccttgcacctcgatctttctttgggtttcgtttcttccttttgctttcgggaggcaatttattaacctcgatcatcggctttggcgtaacgtacacatcgatggtaatggggtgaatattggttggttctcg

SEQ ID NO: 454 - DNA, 2216 bp, Sorghum bicolor
acagcagcagtaacaatggctagcggcgcgacgagcgacgcgtggccatcctccccctactcctcgtcggcgcccgacggggaggtcctacgctccctgcaccgcctggcgcgggacctgtctgcagccgaggcaccggcgccgttcctccgggcggtcttcgcggcggtggcgaggcgggcgcgcctgctggcggccgtgttcgacgacctcctcctctgcggcgctgccgcgggcccgctgctcctacttccgcggtccgcgtcgctgtgcctccgggagctcctgctggtgctgcagcggttcaaggcgctggtggccgactgcgccgcgcgcagccgcacgcgcctgctgctccagtcggacgaggtggcggcccgggcgcgggagctccagcacgacctcgccacgctcctcgacctgctccccgtcgccgacctcggcctcgccgacgacgtgtcggacctcctggcgctcgcgtcgcggcagtgccgccgcgcggtcgcggcaccggagctggagctcaaggcgggcgtgctcgcgctcatccaggaggtggagcgggagatcgtgccggggcgggagaggctggagggcgtactggaggacgtgggcatcaatgatccggctagctgtagcgacgagatcgagaccctggagcgagagatcggcgaccgtgtcgctgagaggtggacgtcgtcgatgatcgccctcgtcggcctcctccgctacgccaagtgcgtcctcttcagtgccgccacgccgcggcccgtggactccaacaaggtggatctcgacgacggcgacggcgacgacggcgcggagccaccgtcgccaccgctggatttcaggtgccccatctccctcgagctgatggccgatcccgtcgtggcttctagcggtcagacgtacgaccgcgactccatcacgcggtggttcggctccggcaaatccacgtgccccaagaccgggcaggtgctgccgaatctggagctcgtgcccaacaaggcgctcaagaacttgatatcgcggtggtgccgggagaacggcatccccatggagagcagcgagtctgggaaatccgagccggcgccggtggttgtaggcgcgaacaaggccgcgcagaaggcggcgcggatgaccgcgtcgttcctggtgaagaagctgtcggcctcgttctcccccgaggcgaccaagcgcgtggtgcaggagatccggcagctggccaagtccgggtccgacaaccgcgccttcatcggggaggccggcgccgcggggctcctcgtgccgctgctccggtccgaggactcggcgctccagctcaacgccgtcacggcgctgctcaacctctccatcctggaggccaacaagaagcgcatcatgcacgccgagggcgccgtggacgcgctctgccacgtgatgtgctcgggcgccacgtggcgcgccaaggagaacgccgcggccacggtcctcagccttgcggccgtgcacgcgtaccgccgccggctcggccggaacccgcgcgtcgtcgacagcgtggtgcagctcgcgcgcgcgggccccgccagcaccaagaaggacgccctcgcggcgctcctgtgcctgtccgccgagcgcgagaacgtcccgaggatcgtcgaggccggcgccgcggaggcggcgctgtcggcgatcggcgacgcggaggcagccgcggccgtgctggcgtccctggcgaagcgcggcggcgcggaggcgatcgtggcgctggacggcgccgtggcgcggctggtggccgagatgcggcgcggcacggagtggtcgcgggagtgcgcggccgccgcgctggtgctgctgtgccgccgcgcgggcgccgccgccgcgtcacaggtgatggccgtcccgggcgtggagtgggccatctgggagctgctgggcaccggcacggagcgcgcgcgtcgcaaggccgcgtcgctcggcagggcgtgccgacggtgggccgctgccgccaacgcggagcagggcaccgagtgccccacctccggcgacgcgtcggggctcacggtggcgtcgtgaaatccactactacacgatcagtatagtagatagaagctcaaaaaaagaagcgaagccattttttttttaccacgattcttgtacaaaatttgttgttggccgtcaaggccttcacgattctttggtccgtgatttgggccgtgggtaattgatcaactgtg

SEQ ID NO: 455 - DNA, 1615 bp, Sorghum bicolor
gcaactgcatgtacttctgcacaggtagccacgagagaccaaaaactaagctgcgatgaagaagaccgtcgtcctgtaccccggcctcgccgtcagccacttcgtccccatgctgcagctcgccgacgtccttctggaggagggctacgccgtcgtggtcccgttcatcgaccccactgagaaaggagatatcgccttggccgccgtcatcgaccgtgtcgccgcctccaagccgtccgtggtcttccacgtgttgccaaggaccgaggactctccatgcacctttgtccacgactcggagttcatcgtcaggtacttggaaatcgtgggccgctacagccagcacctccacgacttcctcctctccatgcctcctggcagcgtccacgccctgatcgtcgacatgctgtctatcgaggtgctcgacgtcaccaccaagctcggcatcccggcttacgccttcttccccccgaatgcctccgcccttgccgtgtccgtccaggctgcatcacttcattcagaagggcagcagccaagtttcggggagctaggagacgcgcctctaaacatccatggcgtgccacctatgccagcttcccatctcaatgctgaaatgctcgacgatccagggagtgccactctcaaggcaacggtgaacatgtttcgcagaatacaagaagccaatggaatactagtgaacacgtttgcatccatcgagcctcgtgcggtgtcagccctcagcgatccacggagtttcccgaaaatgcctccggtgtactgcatcgggccgttggtcaccggtaagggcagccagggaacagagaagaagcacgagtgcctggcatggctcgacgagcagccggagcagagcgtagtgtttctctgttttggaagcacaggcgccggcaaccattcagaggagcagctaaaggagatagccactggcctggagaggtccggccaccggttcctgtgggtggtgcgcgcgcctccccacgacgacccggagaagccgttcgactcccgcgcggacccggacctcgacgcgcttctgcccgcgggtttcttggagaggaccggcggtcgcggccgcgtcgtcaagctgtgggcgccgcaggtggaggtgctccaccacgcggcgacaggggcgttcgtgacgcattgtgggtggaactcggtgctggaggggatcatcgcgggggtgccgatgctctgctggcctctgtacgcggagcagaagatgaacaaggtgttcatggtggaggaatatggagtcggggtggagctggtcggttggcagcagggactggtgaaggccgaggaggtggaggccaaggtgacgttggtgatggagtcggaagaaggcaagctgctcagggcacgggtgtccaagcacaaggaaggtgcggcaatggcatggaaggatggcggttcgtcgcgcgctgcgtttgcccagttcctgtcgcacgcaggcaacgccacgggcaggggctgagcctgacacgcccttgatgccggaggtcagcaccaaattggtggtagctttcctatctttcatctttgtatcttggaccaagacaaataatatagctcgctactggttgtgtgaacgaat

SEQ ID NO: 456 - DNA, 1610 bp, Sorghum bicolor
aaagggatccaccggcaattgtagaaaccagcaccggcggaggatttgaggacgccgattcgatgcgcggctccgcggacgccgtcgcggttgctcgggacgtggcctcgtcgagcccgtcgaagcccccgtcggcattggacatgatgagatacccgaggccgagctcagacggcctcccgctgcccaatggcatcggcagcggcgtgagcaagaagcctgcagcggcggcggctccggctccaccggcacccagatcgagcaaggatgacgtggcgccgccgaccgtcgccaccgacagctcccgcctcgcggcgttccttgccacgacgtcgctcgagtccaagccgcgccctcgcgtgccgcaggtgcagccacagccacagccgccggcacaggccgcacctacctcggcgcccactgccgccgccgcggtgaccaagagccccgcgcgcgaccagggccacggcggcagcggccaacacccctcctccgaccactccgaccccgcctccccgagctccaccggagccggcgaattgctgctccagtggggacagaacaagcgcatgcggtgccgccgcgactccgcgtccgcgtccgcgtcgccgcagcgccggcaggcgggcggcaacaagatccagcgccggtcgtcgtccccactgccggcggcggacaagctgatgccgcccccgagcacggcgccctacacccgcgcgtccaacctccgctccgcctcgcctctcccgccgcgctccggctccggctcttctggcggcgccagcgacgcgcaccacccccgcccccaccccttcagatcggcggaggaccgtgccgcggggaagttctcggcggcggcggcgagggccgagaagcagcgtgcggtgtcgccgcacaaggtgggcccgggctccgtgatgggcctgggcgtcccggacccgaagcagcaccagcagtacaaccaggggggcagcggcagtggccagcatcagcagcagcaggccggcgcggtggcggcggcggcgtcgacgaagccggcgccgaagctggaggtgccgcggatctacaccacgctgtcccggaaggagaaggaggatgacttcatggccatgaagggcaccaagctgccgcagcgccccaagcggcggcccaagaacgtcgagaagaccatcaatttgatctgccccgggatgtggctgacggatgtgaccaggagcaggtacgaggtgcgcgagaagaagtgccccaagaagcaacagaagaaccgaggcctcaaggggattgagatggagagcagcagcgactccgactgaccgcccgacgacagcctgcgttgccaggccgaagggcggtggcggcagcggcggcggcggcggaagaggaagaagagtcggcgacagtgacgggagacgaggggagcgtgtcaaacagcacgcgctcttagacatgatggtcgcgctgggttcagggaagccaaagaaaaaagaaaggttggattcagagaaaaaaacgaaaaaaaacttttttttgagttaatcatagcggcgccgtgctatttatatagcctcgattccattttgtatatctggcgaggatgtcgtggtaccttt

SEQ ID NO: 457 - DNA, 1177 bp, Sorghum bicolor
aaaagctcacgagttgcgtcgcgtcgcggccatggaggagagaattccccaacgaccaagagaggcacaagcacccaccgtcgctgagccggcgccgacgaccggcaagccctgcgatgacggcgatgctctagctcccgccatccagctgctttcgtcgtcgtcctcaggcgaggagtcgtccgacgacgagggggagctcgagttcgagttcccgttcgtcagcagggactcccccgcgggcacggccgccccggccgacgagctcttcgccgacggccggatcaggactttctacccggtgttcggccgcggcgccagcagccacggcggctgcacgacgcgtccggctgctccggcggctgccccgccgcgggtgaggggccagctgggaaagttgttcctggaggaaacccgggagcgcaactcctccactagctccacgtcgtcgtcgtcgtcgtcgtcaggggccgccacggacgacgacggcctggaaggcgtggcgccggagagctactgcgtgtggcgtccgggctcgtccgcgtcgccctccccgccgacgccgcccaggaagagcgggtccacggggtccatggcgcgatggctccgcatcagcgacctcgcggtgggccgcagccacagcgacggcagggagaagttcctctttctcgccgccgcgccggcgcacgacgcgcccaggcggagcaagaagcctgcccctgtccctgcccggcctgcaggcgccaggaagcctgcgccctccgccgccgtcgccgccgcagacgccgacaccgccgccgcccaccggatagcgcacctcgccagaggcggactcggcgtccccgtcccaccaggcggcacgccgcggcgcacgttcctgccgtaccgcgaggagctcgtgggcttcttcgccaacgtgaatggcatcagccggagccaccaccatccgttctgacgtcttgtcacaggcgaacaaactattcgatcagttacacaccctgattaattattcagttttcagggcttggattggattgcggcaaaaaaaaaaaaaaaatcaaattctactgtatgtgattatcgctttttttactagtgcgtaagtaggcggttatagctaatgatttcgggttagaaattgatcacgcgactggaggtggtgaggtgaagcatactc

SEQ ID NO: 458 - DNA, 970 bp, Sorghum bicolor
agtacatctgacagagcccgaccacagccatggcagccgccggagcagcgctgcggctgcgcctgctgtaccggatgctgcgcgtgggggagctcctcgcgctggtggcgttcctctcctggtcgtcgtcccgcgtcccgtccgccgccgccgccgcgctgcggctcgcggggtcgctcctcctcaacgcccgcttcgtcttcgtcctcgggaacgccatcgtgctcctcctcctcgcgctgtcgcggcacgacctctccgcctcctcctcctccagcggccagcagacgagcacggcggcggcgacgagcacgtccgctgccccgccaccgcaggatgccgcgccggccgctgcaagcgacagcttcccttcctcgttcgccggtactccgataactccaccgcctcccgccacctcgctggaagccttcagcgcgctgccggcggctccagcgacggagccagcggcagccgctttgaacacgggcacggcgttcgacgacaggccactgcaggcggcgtcggcggcggtggcgcgggtgagcaagcaggcgcgcgcgccgaggcggagcaggtcggagaagatgggcccgcgggtgctacagctgaggcgcgcggcgtccccgccgccgacccccgagctgcggcggtccgagtcggagaacgggcggcggcggtcgtccgtgtcggcgcgcgacgctcgggcgtgcggatggggcgcggacgacgccgacgagttccggcgcaccgtggaggcgttcatcgacaagcacaagcgattccaccgccaggagtccatgacgatggccgtcgtcgccggctccggctccagcgggcactgcgaggcggccccggccttcaccggcgccctcgccgtcgtcgaataataagtcttcaccggcgcagttggcagcagagtacatagcggaggcggagaagcttccctggctgaacttgtcgtctcgtgttc

SEQ ID NO: 459 - DNA, 1463 bp, Sorghum bicolor
ccgtcctcctcctcatcagcagcagcggcagccgccatgggcgtggggaagctgatgaacgacgtgaagccgtacctggcgatggtgctcctccaggttgggttctccgggatgtacatcgtctccgtcgcctccctcaagcgcggcatgaaccacttcgtcctcgtcgtctaccgcaacctcgtcgccaccgtcgtcatggcccccttcgccctcatcttcgagaggggtgtccgccccaagatgactcctctcatcttcctcaagatcatggggcttgccgtgctcgagcctgtgctggaccagaacatgtactacctgggcgcgaagctgacctcggccaccttcgggtcggccctcgtcaacatcctcccggccatcacgttcctgctggcgctcgtcatgaggatggagaagctgaggctccggagcctccacagccaggccaaggtcgtcggcacagtctgcaccgtcgccggcgccgtgctgatgatcctctaccacggccccgtcgtgccgttcccgtggtcgtcggccggccaccaccacgccgccgccgcagccgccgccgcggcgagccagagcagcgcctcctggctcaacggcaccgtcatgatcattggtagctgcctgtgctggtccggcttcttcatcctccagtccaacacgctgcagagctaccctgcggagctgacgctggcgacgctgatctgcttcctgggctccgtgctcaccggcggtgtggcgctggtggcggagcgccacgacatgagcgcctggatcattggcttcgacacccgcctcttcaccgccgtctactccgggatcgtgtgctccggcgtggccttctacgtgcaggggatcgtgacgcaggcgcgcggcccggtgttcgtgacggcgttccagcccctgtgcatgatcatcaccaccgtcctgggctccaccatactcaaagaggagaccaccctcggaagcgtgattggcgcggtgatcatagtggtggggctctactgcctcatctggggcaagagcaaggaccacctcggcagcaacggcaagcccggcgccgcggccgtcgccggcgagctgcccctgacctcggctcccacggccaacaacggtagttacggcaagcacgccgcgctcggcggcggccaccatgtcgtcaccggcgtcgagacgacgccgccgccgccgccgtgtgtgcccaagtgcgttcactgacgacgccgggccgggatcgacctccatctccatgatgcatgactactccttctccggactgttcactgcacacgtactagtagtgcattgccggtggctgtaagccacatatgatcttgaaggaacttggatcatcgctctgctctcgtagaggcgcgaccgatgccccgattgttgcgttttaaccactttaattttgatgtagctctgctgtaccaccagtccaccaccactaatag

SEQ ID NO: 460 - DNA, 1331 bp, Sorghum bicolor
gaagtggcgaactgaatcgcgcgatggcgacggtgtcgatggacatcccgaagccctcggcgctgacggcggctggacacgaggctgccacggcgaagacgaggggcggcggcgaggggctggggaagtactacaatcagcacatccaggacctactcctcgcagtccagcagaggatcagtgacctaagccgcctagaggcccagaggaacgatctcaactcccaagttaaaatttgcagggaagagttgcatctgcttcaggaaccaggttcacatgttggtgaggttgtgaaggtgatgagcaagtcaaaggttctagtgaaggtgcatccagaaggcaaatatattgttgatgttgataaaagtatagatattgcaaagctcacaccttccacacgagttgctcttcgaagcgggagctatatgcttcatgttattctgcccagcaaagtcgatccattagttaaccttatgaaggttgagaaagttcctaattctacatatgatatgattggtggtcttgatcagcaaattaaagagatcaaagaggtaatcgagcttccaataaagcatcctgagttgtttgagagtcttgggattgcccaaccaaagggtgtcattctctatggccctccaggtactggaaaaacattacttgctcgtgcagttgctcatcacacagactgtaccttcattagggtgtctggttctgagctggttcagaagtacattggagagggttcccggatggttcgtgaactttttgtgatggctagggaacatgcaccatccattatatttatggatgaaatagactccattggatcggctaggatggagtcaagtggcagtggtgatagtgaggttcagcgcaccatgcttgagcttctaaaccaacttgatggttttgaagcaacgaacaagattaaggttctcatggcaacaaacaggatagacattttggatcaagccctcctgaggcctggacgtattgacaggaaaattgaatttccaaatccaagtgaaacttcccgctttgatattttgaagattcattcaagaagaatgaacttgatgcgcggcattgatctgaagaagatagctacgaagatgaatggagcctctggggcagagctgaaggctatttgcacagaagcaggaatgtttgcccttcgggaaagaagggtgcacgtcacccaggaggatttcgagatggcagtggcaaaggtgatgaagaaggatacagagaagaacatgtctctgcggaagctctggaagtgaggggctcgtgtctctgcgccaggcttacactgccatgtccaaacatag

SEQ ID NO: 461 - DNA, 677 bp, Sorghum bicolor
acgcgatgtccgttgtggcggccgtggggcctgtcgccgccgcggcggcggcggcggcggcgggggcttacgggcacgggcagccgctgtgcggtggcggcggcggcggggcgaggaagaggaaggacgtgggcgtggtccaggaccaggaggcggggttgcggggtagtcacgtcggcgccgcggcgccgcggcgtggcgccgggctgttcgtgctggagacggtggaggaggaggcggaggcggagaggttgtcgtccatcggcgcggtgtccgaggacgaggaagaggacggggaggaggtgaacagcggcgggacgtcgtcgtcgacgacgaagggcgccgcgctcgcgtccatggacatggacgccctcgacgacgcgctccccatcaagaggggcctgtccaacttcttctccggcaagtcgcgttcgttcgcgaacctgcaggacgcggcgtcggcggtgaccagcgcccgggacctggccaagccggagaacccgttcaacaagcgccggcgggtgctgcggtgctgctccatccggagggtcgcgtccacctcgctcaccgagctgccgccctttttcctgccgcccaccacggaccccggcagcaccggggacgacgacgacggctgtggcgccggcggtcgtcgccacagtggctgatgaagaacg

SEQ ID NO: 462 - DNA, 1249 bp, Sorghum bicolor
ctcaagataaggagatcgcagcctctcggggccacccccaatctccaacgacgccgtcccccgcacttgtccccaactcgccactcatggccatggccttccacttccacccgctggccgccacgcgcgtccacctctccccactcccgttcgccgccgccgccgccgcgggggcgccctccccctcgtcctcctccgtcgccatcgcggcgccccaccaccaccacggccgccgccgcttctccgccgtcgtggccacggcggccgcctccgcggcggccaccacggagttcgacttcaaggcgtacatgggggagcgcgcggtcgcggtgaaccgtgcgctggacgcggccatccccgccggggaaccccccgccgcgctgcacgacgcgatgcggtacgcgctgctggcgggcgggaagcgcgtgcgcccggcgctgtgcctggccgcgtgcgccgtggtgggtgggcccgaggcctgggcgatgcccgccgccgcggccgtcgagatggtgcacaccatgtcgctcgtccacgacgacctcccctgcatggacgacgacgacctccgccgcggcaagcccacctgccacgtcgtctacggcgagcccatcgcggtcctcgccggggacgcgctgctctcgctctccttccaccacatggccagcgtcgggtcctaccctccggacgtagacccggagaagcatcccgcccgcgtcgtccgagccattggcgagctcgcgcgctgcatcggatcggagggactcgtcgccggccaggttgtcgatcttgagatgacgggcacatctgaacctgtgccccttgaacgccttgagtacatccatctccacaagactgccgcattgcttgaggcctcagtggtgattggggcaatcattggaggcggcacggatgagcaaattgagcggctgcgaaaatatgcgaggtcaatcgggctgctgttccaggtggtcgatgacattcttgatgtcaccaagtcgtcagaggagctcggcaagacggcagggaaggacttggcaagtgacaagacgacgtacccaaagctattggggttagaaaagtcacgcgagtttgcagaaaagttgctttctgatgcaatagagcagcttgattgtttcgacaaggagaaggcagcacctctgttgcatttggccaactatatcgcccataggcagaactgaggaggaattggggtgatgcttattccattgttgctcattgtcgatct

SEQ ID NO: 463 - DNA, 731 bp, Triticum aestivum
tctcagccacacagagaaagagcgtccaagctccagctagctagccaccaatggccgccgcactgagcctccgcgcgcccttctccgtgcgcgccgtggcgccaccggcgccccgcgtggccctggcgcccgcggccctcagcctcgccgccgccaagcaggtgcggggagccaggctccgcgcgcaggcgacgtacaaggtgaagctggtgacgcccgagggcgaggtggagctggaggtccccgacgacgtctacatcctcgaccaggccgaggaggaggggatcgacctgccctactcctgccgcgccggctcctgctcctcctgcgccggcaagttggtgtccggcgagatcgaccagtccgaccagagcttcctcgacgacgaccagatggaggccgggtgggtgctcacctgccacgcctaccccaagtccgacatcgtcatcgagacccacaaggaggaggagctcaccgcataagctgctatacctatctctctttgcaacgagatcgagctgatatcatattatctccttatcatgcatgcattgacatggccagatactccgatttgtttgtgctcgaatgaattgctcgatgcgtgatttggtcaagtaataatgtctccgaattacctttttgtaccgtaagatatactactgtcgtaatactagcgtgtacgtaattcaacgtactgaaatgaatcctgatggctgaggagtctctct

SEQ ID NO: 464 - DNA, 1764 bp, Triticum aestivum
ccatcgccgttaccttctttagctaagctataggacacccgcacacgcgcatacatacacgagaaagagaaagagaaaggattcactcacgggagggagaggaggaagaagagatagggggagagatcgatcgatgggggacgaccatggcgccaagctggtgaagagcctgcggggcgcggcgcagaagtacgtcggcgtggggttcttcctcggcttcttcctcgtcctcctcacctacttcaccctctccgagcagttcgccatcgccgcgcccaacgctatccggaggacctcggcggcgcacccgacgccgaccaccccggccgtggcagagaagacggtgcagcagcaacagctccccgtcaaaaaggaggaagcacctctgccagagcatgaacaagtacaagagaagccaccacctgtcgacgaggagccccacagagaaacagaggagcccaactcagaaacagaggaggaccccaagcccatcgatgaggctagcaagatcgtgaccaccgcggaggagagcgcgccggcgaagaagccggcgtgcgacatccaggggccgtgggcgtccgacgtctgcgacctcgccggcggcagcggcggcgtgcgcatccacggctcgacccacacggtgctcgtcccgcccaccatcgagtccggtggcagcaaccccaacccgcaggagtggcgcgtgctgccctactcccggaagcacatgtccggcatcaaggagatcaccgtgcgcgagctgcccacggcggccgacgcgccccgctgcgccgtcacctcgcaggtccccgcgctcgtcttcgccatgggcggcctcacgggaaactactggcacgacttcagcgacgtcatgatcccgctctacctccaggcgtcccgcttcgacggcgaggtgcagctcgtggtcaccaacatccagccatggtacgccggcaagtaccgccacatcatcgcccggctctcccggtacgacgtcgtggacatggacaaggacgaccaggtgcgctgcttccccagcgccgtcgtcggcatccgcatgcacaaggagttcagcatcgaccccaccaaggagcccacgggccactccatgcccgagttcaccaagttcctccgcaacgtcttcgcgctcccgcgcgccgcgccgatgagggtcaccgccgggagcgacaagaagccgaggatgatgatcatctcccggcgccacccgaggaagctggtcaacgtggcggaggtggtggcgctggccaagcggatcgggttcgaggtggtgatcggggacccgccgttcaacgtggacgtgggcgacttcgcgcgggaggtgaacgccgccgacgtgctcatgggggtgcacggcgccggcctcaccaactcgctcttcctgccgacgggggcggtgttcatccaggtgaaccccttcggcaagatggagcacatcggggaggtggacttcgggacgccggcggtggacatggggctcaagtacatggcctactcgtgcggcatggaggagagcacgctggtggacacgctcgggcgcgaccacccggcggtcaaggacccggagtcgatccaccgcagcgggtggagcaaggtggcggagtactacctcggcaagcaggacgtgaagctcgacctccagcggttcgagccggtgctcctcaaggccatggccatgctcagagagtagccgctccgatcgagcttgcagccccggcgcattggttgattcgcactagcgtagagcag

SEQ ID NO: 465 - DNA, 554 bp, Triticum aestivum
attcgctaccgacctgacctcgccgccgttctccgattctccgctcgcctgctctgctccgccgcctctctgggaaaaaacacacaggtggcactgaataatagacaaggatggcttctactggcgtgaaagatttctaccggcagaagaagaaaggaggtgttggcaaaacttcagcatcttctaagaagaaaacacagaattacactggaggggcctctgttggggcctcaaataaggctcagacagcagcactaatttctcacggatccttagacctcagagatgatttcagtgagcaagaggagcagctgcggcagtttgacatggacatgaagtttggcccgtgcatcggtgtcaaccggcttcagcgctgggagcgtgcttccgccatgggcctccagccaccgccccaccttcgtgatctcctagcgcgcgcctcctccggaaacaaccgcaacaacggcggcccctcccctgaatgcctctgggagggtaagatctagaatcaaatttcttccgccgcaagtgctccttggcaacctagcatgtag

SEQ ID NO: 466 - DNA, 1421 bp, Triticum aestivum
actctacctggcaactgcgacctccgtcgccccggccggccatgtcgcaggtgaggatcgtcgacgcgagctacgtcgatgtgccggagaccgccgtccggccaccggggccgatcaagctgaccgccatggaggcgctgtggatcgtcatcccggtgctgcagcacgtgctgctctacgagggcgacgacgacacgccgcccttcgacgctatcgttcagtcgcttcgttcctccctcgccgcgactttgcgcagcttcgcgccgctcgccggcaagctggtccacctcgaggaaacgggggacgtcggcatcagctgctccgcctccgacagcgtccggttcgtcgtcgcggagtgcgacgcagacatcgggcgcctggccggagacgaggagcacgacctgcgcgtgctcgaggggctcgtgccggaggtggacatgagcctgctgccgacccccgtgctggccgtgcaggccacgcgcttccagggcggcgtggcggtcggggtgacggtgcaccacggtgtcgccgacggccgggcgctgtggacgttcgttgaggcgtgggcggcggcgtgccggggcgagacgccggccacgacgccgtgcttcgaccgctccctcgtcaagctgcccggcggcgaagagctggccaggagcgtcgtacggaaggtggccccgaatttgccttcggtggcactagcatcatcagtcttcgaagaccgaaagcggctcattcgccgaacgttcaccttggacgaaggagacatccaacgcctaaagcagcacatcgtccacctcaacgagtcgggcggcacgcccctgcctcgcccgccgtctgctttcgccaccgtcgtcgcactcgcgtggacgtgcttcgcccggtgcaagtcgttctccttggaggacgacgtgtggctcttcttcttcgccgacatccgtgagcgccttgaccctcccgtcggcgcggggtacattggctcgtgcctcaccaagtgcttggcaaggctccccgcccgggagcttcatggcgagcgcgccctggcggctgcggctgcggcggtccaaggcgagatcaacaagatgaaggaagaccctatcgctgggtggaatttcttctcattcgatcccatgccttccatggaccggctaatgaacatatcaggctcgtcgggttttagtgcataccagatcgccgactttgggtggggcaagccaaggcgaacagagccgattaggatgaactcggatggtcaggtggcactgatgggcagcagggatggccggggtgtgcaggtctcagtggcactgctccaagcggcacaaatggacgagttcaaatctaactttctggcgctacttgagtgacaatatttgttctcaaagagacctacttaggtcacttcaaaacagtacacccaa

SEQ ID NO: 467 - DNA, 1375 bp, Triticum aestivum
ggcctactgctctaggtcttcctgccacccagagttttcgatatactggttttgatatggagtgattggtggagctggtcgtccggaagctctgctggtgaatccgatggggagcaacgatcctagcacgccgtctaaggcttcgaagccaccagaacaggagcaacctccggctactacctctggcaccacagctccagtttaccctgaatggcccggctttcagggctacccagcgatgccaccgcatgggtttttcccccctcctgttgctgcaggccaggctcatccatacatgtggggacctcagcacatggtgccaccttacgggacaccaccacccccctatatgatgtatccaccaggaacagtatatgcccatccgactgctcctggtgtgcatccatttcattatcctatgcaaacaaatggaaatcttgaacctgctggagctcagggagctgcaccaggtgctgcagaaacgaatgggaaaaatgagcccggcaaaacatctggtccatctgccaatggggttacgtccaacagtgaaagcggaagtgatagtgaaagtgaaggaagtgatgccaattctcaaaatgattcacattcaaaggagaatgatgtaaatgaaaatggcagtgctcagaatggcgtatctcattcatcatcgcatggaacatttaataaacccatgccgttggttccagtacaatcaggtgcagtgataggagttgctggtcctgcgacaaacttgaacatagggatggactactggggtgcaactggctcttcacctgttcctgcaatgcgcggcaaagtaccgtctggttcagctcgaggagagcaatgggatgaaagggaactgaagaagcagaagaggaagctgtccaaccgggaatcagcgcgcaggtcccggctgcgcaagcaggctgagtgtgaagagctcgggcagcgcgctgaggctttgaagtcagagaactcgtccctcaggatcgagctcgaccggatcaaaaaggagtacgaggagctcctttcgaagaacacctctctgaaggcgaagctaggggagtccggcggcggcggcggcagcgatgcggtccccgacatgaacgaacggggcgacaccaacggcggcagccaccagaaggagccctgactgaccgatcgacgacgcatgcggcctctgctactctacttacatagctcgtgatgattgatgatgatgattcttgtaacaaacaaacttggcgaccccgatccgccacacactcacacaatgagatggttcttcttttttgtgcctcttatcgacctgatgacaatggcgacgccgtcgccgccacctgcagactcctgtgcttgtttcgtccctact

SEQ ID NO: 468 - DNA, 1028 bp, Hordeum vulgare
tgagggccaaagtttagcttgacgccaacatgtcgtcgaagaagatagagctagaccacaaggacatggttcatgattctgccattgactactatgggaagcgccttgccacagcttcctcggactccactgtgaagatcaccaacattggaggtgcatctgccccgtcccagctcgttgccaccctcactggccactatggtcctgtatggcgtgttggatgggcccatcccaagtatggttcaattctggcatcctgcggctatgatggccgtgtgatagtctggaaggaggctgccactgggcaatggtctcagctctatgtgtttgacaaccacaaggcctcagttaactcaattgcttgggctccatatgaacttggcctttgccttgcctgtgggtcttctgatggcaccatctctgtcatctccatgcggcttgatgcaggaggctatgacgctgcaaccatcgagcgggcacaccctgttggagtgacagcagtctcctgggctccagcagcaccccttgggtcaatggttggctcaggtcagctcgtccacaagctcgtgtctggtggctttgattgcgtcgtcaaggtgtgggagtttgtcaatggtggctggaagctggagagcgctatggtctccgacatgcacaaagaatgcgtgagggatgtttcatgggcaccggtcctgggcttggcaaagtcaaccattgccagcgcgtcccaagatggcaaggttgtcatctggaccagtggcaaagcaggaggcaagtgggaaggaaagctcatgcgtgacttcgaggccccggtgtggagggtgtcctggtccttgacgggaaacatactgtcggtcgctgccggcgagggcgacataactctgtggaaggaatcgtcggacgggcagtgggagtcgctgtggaccaaggcctcggaggagcagccgcaggagcaggccgcgatcgaggaggccatgcagtaggggggagtcggcgccatgtcccctgtctcgatttcagaccaatag

SEQ ID NO: 469 - DNA, 889 bp, Brachypodium distachyon
caacgggtctgtcttgctctcgtcggctagggcttcgccgcgccataccccaaccatggatgcgaccacggccgcctcgctcccacgcctctccgtcccgccggcccctcgccctaccatcaccccctcccgcttccgccccaacgacgcccctgtccccagccgccgccgcctcagcctccgtttccaccgctcgccggtggcagctgctgctgccgcaagctccccgtccgctacatcctcttctccggaaccagggtcgggcatcggtgatgcgctaggtggcgtctccatcttctctgcggccaccggcgagcccgtcctcatcagggatttgtgggaccagaatgagggaatggctgtcgttgcgctgctaaggcatttcgggtgtccttgctgttgggagttggcctccgtgttgaaggatgcgagggagagattcgattcggctggcgtcaaactaattgctgttggtgttggcactcctgataaagcccggattcttgctgagcgtctgccctttccattggattgcctctatgcagatcctgaacgcaaggcttatgatctcttgggtctatattttggtgtcggtcgtacattcttcaacccagctagtgtgaaagtgttctctcgatttgagtccctgaaggaggcaacgaaaaactatacaatcaaagccaccccagatgataggctgagtgtcctgcaacagggtggaatgtttgtgttcaaagggaaagaactgttatatgcaaggaaagatgaaggcacaggtgatcatgcccctttagatgatgtccttgacatctgctgtaaagttccagtcgcctgatgtcgaatcctacacaggctccgccgcgactggaaagcgtatttcacaagctag

SEQ ID NO: 470 - DNA, 1700 bp, Zea mays
tatctcctcgtgtcttgtcttcgtctcgtctcgtctcgccacaggcacagccagccctatcgatcggcggtacggtgtctgccaagccaagtgccaaccgcaaccgcgcccccgcgccgagcgagacgatggagacggagatggtggcggccgccgccgccgccctgtgctgcgcgctggcgctctacctgtaccacgcgctgtggctggcgcccgggcgggtgcgcgccgcgctgcgggcgcagggcgtcgcgggcccgcgcccctccttcccctacggcaaccgcgccgacatgaggcgggcgaccgcggggcaccgcggcggcggcggcgtcgtgcacgactaccgccaggcgctgttcccacactacgagcggtggaggaaggagtacggccccatcttcacctactccatcggaagcatggtgttcctgcacgccagccggtccgacgtggtccgggacctctgcctcagcgtgtcgtcgctggacctcggcaagagctcctacatgaaggtcacgcaccggccgctcttcggcgacggcatcctcaagtccagcggcgaggcctgggcgcaccagcggaggctcatcgcgcccgagttcttcccggacaaggtgaagggcatggtggacctcatggtcggctcggccacggcgctggtggcgtcgtggggggacaggacgggcggcggaggcgtggagctcaagatcgacgacgacatcagggcctactccgccgacgtcatctccaggacgtgcttcggcagcagctacgtcaagggcaagaggatcttcgcggcgatcagggagctgcagaaggcggtgtccaagcccaacctgctggcggagatgaccggcctcagcttcctcccgacgaggactaacagggaggcgtggaggctcaacagggtcgtgagggacctggtgctggacgtcgtcagggagggcggggacgacgacaggaacctactgaacgcgatgctccgcagcgcttcttcctccggtggctgcagcggcgaccgcgtggcggtggaggagttcgtcgtggacaactgcaagaacatctacttcgccggctacgagaccacggcggtgaccgccgcctggtgcatgatgctcctggcgctgcacccggagtggcaggacctggtgcgcgacgaggtgcgccaggcatgcggcggcggcgacttcgcgtccctgcacaagatgaagaagctgacgatggtgatccaggagacgctgcggctgtacccggcaggcgcggtggtgtcgaggcaggcgctccgcgacgtgaccctcggcggcgtgcgcgtgccggcgggcgtcaacatctacgtgcccgtctcgactatgcacctggacccggagctgtggggcgccgacgcgcgggagttcgacccggggcggttcgcggacgaccaccagcggcagcggcagccgcacgcgtacctccccttcggcgccggcgcgcgcacctgcctaggacaggccttcgccatggccgagctcaaggtcctgctggcgctcgtgctgtccaggttcaggctcgcgctgtcgccggcctacgtgcactcgccggcgctcaggctcatcgtggagcccgagcacggggtgcggctgctgctcaccaacgtggagcccaggggtgctagctagatgggcctcactggaccgggtatttaattcggcccagtagtc

SEQ ID NO: 471 - DNA, 830 bp, Zea mays
ataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaataa

SEQ ID NO: 472 - DNA, 1339 bp, Sorghum bicolor
cataggtgcaaggataggcaaccagtgtccaacaacacgtctgtggatcaattgacctgtatttcggcctttcagttgaggattaaactagagctttaagaagcttgataattggcatcatctcaagaatacattgaagtgcaagatgccaaaaataaagaatctctctaatgcatgtaaagtatcattttctccacaaggtcccatatctgaagaggcgcttgagagagtccgtgcactgttagatgagataagacctctagatgtcggcctagataatgaagcacaaattgcacgcaattggactagtactacgcgtccatcaaatgggagacgaggacgtaatggggctaaccagttcgctgctccaatcaaatatttgcacattcatgaatctgaaagtttctctatgggtatattttgtatgccaccttcttcagttattccacttcataatcatcctggaatgactgtacttagcaagcttctttatggaagactgcatgctgaatcttatgactgggttgacgtgcctgatcatccaattgatcaattacaatcgaggccagccaagcttgttaaagattgtgaaatgactgctccagagacaactattctttaccctaatgcaggtggtaacatccacactttcagagccatcacaccttgtgctctctttgacgtcctttctccaccgtactccgctgaggatgggcggcactgttcgtacttccgaaagtctcaaatgaatcaaccacctgttgttttgcctgctgagatagatagctcacaagtaatttggttggaggaattggaggaccatcagcccccagaaggctttgttgttgcgagaggtctgtataaaggccctgtaattaggagatgatttgccttggagcacagaatccaccaaactacaaatcagctgaaagacgatgcaggcttgtagtgtcaattgcaagcttcatcaggtcatgtgcagcctacggtttactttgtacatgtcaaagtgatctgtgataatttaacagcagttttacagaacaatggatgttttttttgttttgctgccattttaattgtgtcccactgctggagtattctctgaccttagttatggagctcttatcagatcaagaccgtggagcacatacttttgagcatagtctagcatagctattgtcatggtgtactagggagatcaatggacaaggttttccatttggtgatttcagaaagaatttggtgtgggggaaccattttgtctgtgtgtaatagcagcactactatttttgggcaagactgtaaattacgggggacgaaccgtaaacaaacctgt

SEQ ID NO: 473 - DNA, 1293 bp, Sorghum bicolor
tgacgtaattcatagtgggaagcccgcaatgcctagcttagggggccagggtgaggaagagcatggggagaagggcaatgaggacaactcaggggagagcgaggtgatcaacccgccagaagaggctagcggggaggccacctcgcctatggagggcaggaagcctcgccttggactttccaaggggaatcaaagccatggacctaaggctatcaaatccaagagcccaaggagtggagatgaaggtcaggcaaggagaaaaggggtgaattcttctcttcctaaggcacccattgtccaggtgtcccatggtgacgctggtgtcggcagtaataaagctggcaagaatgaatctcgctcatctcccatggatgcaacattgctggatgactccaaggagaaaaggaaaactcaaaagccatcagcacagctctcttccatcaaaagagatgaagaacagtcaaatggtgagagtgcaaaacctcgaaaagttggcagcactccatcatatggtttcaccttcaagtgtgacgagagatctgaaaaaagaagagagttctattcgaagcttgaggagaagattcaagcaagagagttagaaataagcaatttgcaagagaaatcaaaggaaactgaagaagcagaactcaaaatgttgagaaagagtttgaatttcaaggcaacaccaatgccaagcttctataaggaaccaactcctgccaaggttgaattgaaaaagacccccccaaccagagctaaatcaccaaagcttggtcgttctaaaaacaagtccacaccagagactgaagaaaatactactatggaccaatctgcccgtctgagccttgaggaaaaggtttctcaaaatggtgtgaaaaaatcaaccccgttgaattcagcaaagaagccccagaggaagtcactccccagactgccatctgaagaaactggtccgctcgatgccacctcaaggcagctaaagaacaccaaactgaatgcagttaatactcaggagacaggatctgctacagaacaggtacaaggaagtgagacgaaaacagattctgttcaggggccaattgaagctggagctaatcctgatgaacaagacgtcgccgaacagagtgtcgtttactgaagatcacggtgaccaaaatcaactgatttgtgatggatggtggtgtgcctcatctttgtataatattgtgcttgcctgctagagtaccttgtgcctgtattatgttatgtgatatatactcctgtttgttttcctggaattgagccttgtatgct

SEQ ID NO: 474 - DNA, 1693 bp, Sorghum bicolor
gacgctctctcatcaccaatcgcccatggccacgggcaccgaccgtccatggtgggcgccgccgccaacgccaaagccgcccgcggcggttccctccgccccgcggttcccctccccgccgtcgccgtcgtcgtcgttcacggccgacccgccggcggagttcctctgcccgatctccggcacgctgatggcggaccccgtcgtcgcgccaccgggccagactttcgagcgcgcctgcatccaggcctgcgccgcgctcgccttctccccgccagccgtcgccgccgacctctctcagtcccaccactcctcgtcgtcgtcgtccccgctcgtgctcgtccccaacgtcgcgctccgcaccgccatcctcaactggtgcgaccgcctcgcgctgccgcacccagcgccgctgtcgccggacaccgcccacgacatcgtgcgccgcctcatgccgccgcagcagcggagctcgctggcgcagccgcagcgaccgcagacgcaggtcgcctcgtcggttcgggtgaggcgacccagcgtcttcgacggcttcgcgcaggtgcaggagccgagctccagacagaggggtgacgctctggaggaggagatcatggccgcgctcggggcggacggcgccacccccgcggagcaggcgtcggcgatggccttgctgcggcaggcgacgcgggagaaccaggaggtaaggcggcagctctgcacgccgcggctcctcgccgcgctgcgccccatgctgctgtcgcccgacgccgacgtccaggtcaacgcggcggcggcggtggtcaacctgtcgctggagcccgagaacaaggtgcggatcgtgcggtccggggcggtgtcgccgctcgtggacgtgctccgcggcggacacccggaggcgcgcgaccacgccgcgggcgccatgtacagcctcgccgtggaggacgagaaccgcgccgccatcggcgtgctcggcgccatcccgccgctgctggacctgttcgcgggcgccggcgccacgggccaccgcgcgcggcgcgaggcagggatggcgctgtaccatgtctccctctccgggatgaaccgctccaagatcgcgcgcgcgccgggcgctgtgcggacgctgctctccgcggccgaggcgcgggaccgcgcgagcgagaccgacgccgccgcgctccggaggctggccgtcatggtcctggccaacctcgcgggctgccccgacgggcgcgccgcgctgatggacggcggcgcggtggccgcggtcgtcaggctgatgcgcaacggctccgtggctcccgggagcgcggagcaggagtactgcatatccacgctctacgggatgagccggggcagcatgaggttccgcgggctcgcgcgcgcggccggggtcgaggccgcgctgcagccggtggccgagggcgaaggaggcgtggggcgagacctggcgcggcgcacgctgcgggctatgcgcggcgaggacgacgacgccccggtcacggccaccggactactcggacggcagtgggacgacggcagcgtcgtgtcggaggggcttgtctccatccggcggccgccgcaccggagcaattacgccgggccgtccgggtcaaacacaacccagttctgaaaaaaaaaaaacaaagtcaaagtcttcgttttctgcacgctgtcctgccgtctcgatcaagtctag

SEQ ID NO: 475 - DNA, 1238 bp, Setaria italica
tctcgatggccgacgacggcgagccttccatcacgcgctggaccttcgaggacttcgaggtctactacgaggtgcgcctcggcatccgccgcgagcccgcggagggcgacggtgacgaccgcgacgatggccgccccccgctgcgcggatccgaccaactgtccggccgacccgccgtgtcacgcgccaacgggggcgcggacctcgctgtcttcgagcagttcgagcggatggagaggaaggtggagatgcgcaatggggctatagaggacgggccgccgcagaaacctctgcttccttcatttgaatccgcagaaacgcgcaacttagccgagacattgttgagggatataattcgtgggagcccagatgtcaaatgggaaagcataaaaggtctggagaatgcaaagcggcttctcaaagaagcagttgtcatgcccatcaaatatcccaagtacttcacaggcctattatcaccttggaaaggtatactactatttggtccacctgggacaggaaagacgatgctagcaaaagctgtggctactgaatgcaaaactacctttttcaatatttctgcctcatcaattgtgagcaagtggcgtggtgactcggagaaactagtgaaagtcttatttgagcttgcaaggcatcatgcaccatctaccattttccttgatgagattgatgctataattagtcaacgtggtgaagctcgtagtgaacatgaagctagccgacgattgaaaactgagctgttaatacagatggacgggttgactaagacagatgagcttgtttttgttctagcggccacaaatttaccatgggagctggatgcagcaatgctgcgtcggctggagaagcgtattcttgtaccattgccagagccagatgctagacatgctatgtttgaagagctcctgccatctactactggcacaatggagattccctacgatgttcttgtggagaaaactgaaggatattctggctctgatattcgccttgtatgcaaggaggcagcaatgcagcccctaagacggttaatgacagttctcgaacgcaatcaagaggttcctgaagatgagttgcctgaagttggtccagtaacgacagaagatattgaacttgctttgaggaatacaaggccgtctgctcatcttcatgcacatagatatgagaagttcaaccaagattatggcagtcatgtccatggctgaaggagactgttgtaa

SEQ ID NO: 476 - DNA, 382 bp, Zea mays
agcaagtagcagcttctgtcgcgtctccccctccctgaccgagcgatccagcgagagggagcgagtagcagccgcagccgcagccggaggagctcgccgaggccgcctaagacgaccatggggttctgggcgacgacgctcatcttcctcctcgccggcgttgccgcatccctcttcacgctcctctgctgcaaccgcgggccctccacaaacctgttccatttgaccttggtgactacagctgtaatttgttgctggatgatgtatgcaatcgtctaccttgctcagatgaagccattgatcaaccccattctgagcggagagtgagcgcagcatctgtattgaacagaacgaaagctagacctgctgtaccattgttcag

SEQ ID NO: 477 - DNA, 2435 bp, Zea mays
cggaaatggatctcgtcgcctccccctccaggtcaaaatccaagcccagatcctcgccagcgaagcccgtcgccgcccccgctgagtccaggatggacctctgcaccccgtccaagcccacgcccaggcggaagtccaaaacgacggcctcgccggcgccgatgtctccggcgacgccatccaccgtccgacgctcgcgtcgccttcttgaaacccccaccaaagcctccccggaggtgcaagtgaaggctacgcccatctccagggctaagcgcaccgcgccgtcaccgaaaacccctgttcagcgcgagaccaagaggcagaggcgacacccgaggaagagggcatactaccggaaggtggtgtatgatggcggggagttcgaggtcggcgatgacgtgtacgtgaagaggcgggagacggcggagtctgacgcggaggaccccgaggaggaggagtgccgcgtatgcttccgcactggcggcggggttatggtggagtgcgacgcgtgcctcggcggattccacctgcgatgcgtgcgaccgccgcttcggagggtgcctgaaggtgattgggcgtgcccttactgcgaggccgagcgcgccggtaaggtggtcgagcggcccaggccgcctgaggggaagcgcgtcgtgaggaccgccaaggaaaaactcctttccagcgacctgtgggctgcacgcatcgagagtttatggagggagcctgatgggacgttctgggcaaaggtcaggtggtacattatccctgaagagactgcagcaggaaggcagctgcataacttgagaagagagctgtatcgtaccaatgatcttgcagacattgagatggaaacaatccttagacattgttctataatgtgccccaaagactttagggatgctaacaacggaggggatgatgtattttattgtgaatatgagtatgatatacattggcataattttaagcgtttggcagatattgatgatgagccagagacaaaggaagatctcagtgacgagccctacaatgctggtgatgattataacagtgacactgatgaagattcagactatgacgaggaggaagaatccacatcatctttctctgtcagaaggaatcaatcacatgaatctgcggcgaattcaaggaaaggtagaatatatggcctgcaaaaaattgggatacaaaaaattcctgagcatgctcggtgccaccaaaagactgagctggagaaggctaaagcaaccctgttattggcaactcttcctaagtcattgccttgcagagataaagaaatggatgagatatcaatatttgtaaaggatgcaatctgcaacaaccaatgcctaggacgctgcctttatatacatggtgtacctggcactggcaagactatgagtgtacttgctgttatgaggaggctgagatctgaatttgattctggaactctgaggccatattgttttatcgaaattaatggtcttaaattagcatctccagagaatatctacaaggttgtatatgaacagttgagtgggcatagggttgggtggaaaaaggctcttcactatttaacagaacatttttcaggtggtactaaaattggaaagcaagcaaaccagccaattgttttgctgatcgatgaacttgatcttcttatgacaagaaaccaatcggtgttgtataacattcttgactggcctaccaaaccaaattcaaatctagttgttataggtatagcaaacacaatggatcttccagaaaagttattgcctcgtatatcaagtcggatgggtatccaacgactgtgttttggtccatacaattatagacaactgcaggaaattataacaagccgtttaaagggtattgatgcctttgaggaacaggctattgaatttgcttctagaaaggtagctgctatgtcaggtgatgctaggcgagctttagagatttgtagacgggcagcagagtttgcagactaccgtgtcaaacagtctcgacagtctgcacagactactgtttctgcaaagaaaggtgatgctgttgtttccatgggtgacatagaagctgctattcaggaagtcttccaggcacctcatattcaagtgatgaagaattgcccaaagtttggaaaagttatactggttgccatggttcatgagctgtacaaaagtggactaggtgaaataatgtttgataagttagcaacaacagttttctcctggtgccatgccaacagagaactattgcctggatacgacactctcttgaaaatttgttgcaagcttggtgaaagcaagatcatcctctgtgaagagggtagtaagcacaagttgcagaaggttcagcttaactatccaagtgacgatgtgacatttgccctcaaggaatccccagatcttccttggctatccaagtacttgtgatga

SEQ ID NO: 478 - DNA, 659 bp, Brachypodium distachyon
gcaagatggtgctgtgggtcttcgggtatggctccctgatctggaaccccggtttcgatttcgacgagaagatcctggggttcatcaagggccacaagcgaacgttcaacctcgcttgcattgaccatagaggcacaccaaagaatccggcgaggacttgcacgcttgagtccgaagatgaagccatatgctggggaattgcatattgtgtcaaaggtggtctagaaaaagagcgagaggcaatgcagtacttggagagaagagaatgtgagtatgaccagaagatttcagttgatttctacaaggatggagattctctgaaaccagctgtgacgggtgtattagttttcgtatccactcctgatccagttggcaacaaatactatcttggccctgcccctttggaggatatggcaaggcaaattgctacagccaatggccctaatggaaataatagggactacctgttctcaatggagaaggcactgtccaacataagccatgaggatgattcgatcattgagcttgcaaatgaggtgaggaaggtcctgagcaggtcagagaagattaccggctccgacatatcactaaaatcacatactcctcttgtgcacttgtctgcccttccagagggcactgtcgtggattcaagatagtag

SEQ ID NO: 479 - DNA, 711 bp, Zea mays
agttgctgtggctttgtgcgtggctgctgaatgggcatgcagcataaaggcagcaaaaaaaaaaggttgagacgggacgggacgacacagagagaatcaatgactcgtattcccaaatcccaaaaggccaaaaaccatacgccgcccaaatgcaaaagctgaagagggcgggggggcgtccaggttcaatgcatgtacacgacccccccttccgtcttgatctgacctgtggcctgtcgctgctgcctgcaactgcaatgcaggtcatctctttcaaaccccacacggcatgtttcaaaggcaggtccagattccagcagctctgagctatagaaaaaacggcttgggggcgacggagagagaggggtatttgcagtataagtacctttggatcgaagagcatcactcgaagatgcatcgaggactgttcttcttcttcctcaagctgtagcctgtgggaggagaggccggagaggcctcccatgcgtggagttcccccactcatcacttcttgttggtcccctgctagctgttcgttccctcagcaggtagctagagatgatcttgctttaattttgtgctgatctcttactcgtcgtgtacgctcatatatatgcatggggcgacggatttgtctctgatcgttcccatgccgcctcttgtatcttgacttggatctatatatcaatgcaaataaatcatcgatgggtg

SEQ ID NO: 480 - protein, 224 aa, Hordeum vulgare
MDARPRRASSSPAAATAAFSLLLLFPMLQGSQASAHGNDSVACGMTALQKHAAFFDGDKDGVVTFSETYAAFRALGFGYAASTLSATFINGVLGPQTRPENETARYSIYIENIHKGIHGSDSGAYDSQGRFVPDKFEAAFAKHAKTVPDALTSAEVDELITANRQPSDYAGWAGASAEWKMLYSIGKDKDGLLRKDAARGVYDGSLFARVVQERRTSSQEETQA

SEQ ID NO: 481 - protein, 777 aa, Hordeum vulgare
MMIPARHMPSSMIGRSSGGAPYGSSSALSLGQPNLLDGSNQHLLQHHLLEQIPVRAAESGDNNIGSGGGGVGMIRGRESMDPLGDEFESRSGSENVDGDAVDNAEQDQDPNQRPRKKRYHRHTQHQIQEMEAFFKECPHPDDKQRKELSRELGLEPLQVKFWFQNKRTQMKNQHERHENSQLRADNDKLRAENMRYKEALSSASCPNCGGPAALGEMSFDEHHLRVENARLRDEIDRISAIAAKYVGKPMVPFPVLSSPLAAAPGASAYDVFAGAASVLQAPPDDKQQGVVVELAVAAMEELLRMARLDDPLWATTVDQTLALDEEEYARMFIDPRGGLGPKQYGLVSEASRDATVVIMTPASLVEILMDVNQYAAVFSSIVSRAATLEVLSTGVAGCYDGALQVMSVEFQVPSPLVPTRESYFVRYCKRNADGAWAVVDVSLDGLQGVKCRRRPSGCLIQEAPNGYSKVTWVEHVEVDDRSVHNIYKPLVGSGLAFGARRWVGVLGRQCERLASAMASNIPTSDIGVITSSEGRKSMLKLAERMVASFCGGVTASVAHQWTTLSGSGAEDVRVMTRKSVDDPGRPPGIVLNAATSFWLPVPPKRVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHAAAGATGTGGSLLTVAFQILVDSVPTAKLSLGSVATVNSLIACTVERIKTAVISNGGASPPQ

SEQ ID NO: 482 - protein, 317 aa, Hordeum vulgare
MKNSSNLEAFLQAATPRLPWRSATMERFQGAPSSVWQHPEGKNKDAVEYFALSDLWEHYAESSAYGLAVPVRDAGDRAVVTTQHFVPYLSAVQLYTATKPTSHTLGATSRSTGSETDSWSDDSVGGDRFAGSGSSSWDAASDEDDASSTYDGTGSTGVSPKQNGYLNFQYREWDSPYERVPLAHKVEELARDYPCLMSLSSAELSPSSWMSVAWYPIYHIPAHVNLKGTSACFLTYHSISSVFQDNIDSGPEHDDGEMAALSPFGLATYKMQGDLWRRPGSSDPRRLSELHWAASSWLKQVGAHHPDFTFFTTSHRR

SEQ ID NO: 483 - protein, 162 aa, Hordeum vulgare
MARTIGLAMDYSPSSKAATRWVVENLVKAGDRIILIHVLPKGADASHKGLWKSTGSPLIPLLEFMEMNVQARYGVNPDKDVLEILQAESKSKQVEILAKIYWGDAREKLCEAVDDLKVDSVVLGCRGLGPLKRALLGSVSNYVVNNATCPVTVVRGPNGSLA

SEQ ID NO: 484 - protein, 441 aa, Hordeum vulgare
MAEHDLTASVAAWMDPHLVLPVLEFLQERGVYADEEILRGKIRLLGGTNMVDYAMDIHKSLHGTDEVPADMVARRSEVVERLRALQEAVAPIVAFLSSPQLVQELHADKQYNLHMLQERHHIGPDQIEALYQYAKFQYECGMYSDAADFLSQYRALCTNSERSLSALWGKLAAEILMQNWDVAQEELNRLKEMIDSSSFTSSPVNQLHSRIWLMHWSLFIFFNHENGRNGIIDLFFQDRYLNAIQTNAPHLLRYLAAAVVVNKRRRNMLKELIKVIQQEQNIYKDPIIEFLECLYVKYDFDGAQQKLVECEQVILNDPFLGKRVEERNGIAVPLRDEFLENARLFIFETYCRIHRCIDIGVLAEKMNMTYDEAELWIMNMVKSSKLDAKIDSVTGTLIMTTNRVDVHEQIIESMKNLNARTYMLAKSVVDPGHAAAQQAAR

SEQ ID NO: 485 - protein, 176 aa, Hordeum vulgare
MSGWFGGKTTDAKADEAAKTGPSVQDRAIEAKDQTISFIGEKSEAVTKAASDTADAAMKMGGDAMGKVSETGQAITDRAIESKDQTFGFIGEKAEAAKKMAVDTGDAAKQKSAEAAKCVEETAAQFTGEPAAPKEPAGNMFQQAGGQVMGAATGARDAVMNTLGMGGDKADAGSAK

SEQ ID NO: 486 - protein, 78 aa, Hordeum vulgare
MSCCGGNCGCGSACKCGNGCGGCNMYPEVEAAGATLLVAVTATHKASCGAMEMAAENGGCGCTQCKCGTSCGCSCCSC

SEQ ID NO: 487 - protein, 282 aa, Hordeum vulgare
MAAAAARSGSRRLFSISALVPPKPPTPPPKADPFASLFIPGLSKRTTTDGLREAFAKSGEVVHASSVKSSRWYMISANRSGPLTVRKEYRKVLPSFIRPSASYSTKASEKRPKQERTDLTTVEDPFNAPTYNIPEKPVTFVEGASYSVVILAGLGVAALAGYAVFKELIFEPKEYKIFGKALARVQSDSQVTAKIGYPITGYGTESRNRAARQRIQNRVWTDEDGVEHVEVAFHIRGPHGAGKVFAEMFKDNADRTWKFTFLLVEITSPRPAQIMLESYLPA

SEQ ID NO: 488 - protein, 438 aa, Hordeum vulgare
MRCLPFLHGDAKAGDDDDQRTGPSTAAMSASVRSFSTTTSTERDNPRSGSDLNSINVSDMSAESIRRTQYPSFTDRPANLRVFSFSELKAATRNFSRSLMVGEGGFGCVYRGVIKGSDDPTQRVEIAVKQLNRKGVQGQKEWLTEMNVLGIVEHPNLVKLIGYCADDDERGMQRLLVYEYMPNGSVDDHLASRSTSTLSWPMRLKVALDAARGLKYLHEEMDFQVIFRDLKTSNILLDENWNAKLSDFGLARHGPQEGLSHVSTAVVGTLGYAAPEYMQTGRLTAKSDIWGYGVLLYELITGRRPIDRNRPKSEQKLLDWVKPYISDVKRFPIIVDPRLEGHYNLKSMTKLAGVANRCLLRMPKSRPKMSEVYEMVQKIVDSVEIGPPEPPLHYHGSVSGPGAKRTKKGSLKRRLQEFKFGCRQIVWRGWKPEIIKTC

SEQ ID NO: 489 - protein, 132 aa, Hordeum vulgare
MLKPELLEERIFNSITWAPRIWRPWDNLFDCRVLFRSKDIRGGRFVRPILIFRTKRYWILFRIGPERRRKAEMPTDLCLFSNSPDPIVPVFGTSSAKVTEWVSHQSNPFDKSDVILDIIFYIYRNIIDRIDI

SEQ ID NO: 490 - protein, 635 aa, Hordeum vulgare
RCVRPPLRRVPEWDWACPYRKAEHEGRAMDRPKPPVGKKIKRTAKEKLLASDLWAARIESLRREPDGAFWAKVRWYTIPEETAAGRQPHNLRRELYRTNDVGDIEMETILRHCFVMSPKEFRDAANDGDDVFYCEYEYDIHWHNFKRLADIDDEPETKEDPSDEPYNAADDYNSDTDVDSEYDEEDEPAARCSARKNQSNEKILPANSWKGRIYGLQKIGIRKIPEHVRCHQKTALEKAKATLLLATLPKSLPCRDKEMEEISTFVKDAICNDHCLGRCLYIHGVPGTGKTMSVLAVMRRLRSEFDSGALRPYCFIEINGLKLASPENIYKVIYEQLSGHRVGWKKALHYLTQHFSDGKKIGKQANQPIVLLIDELDLLLTRNQSVLYNILDWPTKPNSNLVIIGIANTMDLPEKLLPRISSRMGIQRLCFGPYNYRQLQEIITSRLKGINAFEDQAIEFASRKVAAMSGDARRALEICRRAAEFADYRVKQFQQVEQTPSSANIGNGFVCMGDIEDAIQEVFQAPHIQVMKNCPKFGKVILAAMVHELYRSGLGEVLFDKLAATVFSWCHVNREILPGYDTLLKICCKLGESKIVLCEEGTKHKLQKLQLNYPSDDVTFALKESPDLPWLSKYL

SEQ ID NO: 491 - protein, 371 aa, Hordeum vulgare
MSSAAPAPAPEEQPPRPVRFGIMGCASIARKLARAMLLAAPAAAVAAVGSRSEAKARLFAADNGLPADTRLHGSYEALLDDPAVDAVYLPLPTSLHVQWATAAAARGKHVLLEKPTALCAADLDAILAACDASGVQFMDSTMWMHHPRTAKMRDLLPADVGDVRLINSLFSFRANEDFLQNDIRVKPDLDALGALGDAGWYCIRAILWAVDYELPKNVIALPDPVKNQAGVLIACGATLYWADGKMATFHCSFLTNLTMDLTVVGTDGTLHVTDFVIPYEEKSGPFSVASKSNFAELHTGWAPQPSKHVVMTDLPQEALMVKEFCRLVQGIRDAGAKPENKWPAITRKTQVVMDAVKASIDNGFKSVDVAS

SEQ ID NO: 492 - protein, 66 aa, Hordeum vulgare
MQAKKLTLLQTVAAAGVFSAVSCWYGFMFGRESARRELGGIIDDLRSGSTTGSAASSSDSHAHPKP

SEQ ID NO: 493 - protein, 380 aa, Brachypodium distachyon
MDFKGFWESRFGGKKEAEQNGHANGEANGSVKKRTADLAIYEQFEQQARQPEMRAAAIRDGNADVIQKPLLPSFESAEMRNLAETLLRDIIRGNPDVKWESIKGLENAKRLLKEAVVMPIKYPKYFTGLLSPWKGILLFGPPGTGKTMLAKAVATECNTTFFNISASSIVSKWRGDSEKLVKVLFELARHHAPSTIFLDEIDAIISQRGEARSEHEASRRLKTELLIQMDGLTKTNDLVFVLAATNLPWELDAAMLRRLEKRILVPLPEAEARHAMFEELLPAMTSNLEVPYDLLVEKTEGYSGSDIRLVCKEAAMQPLRRIMSVLEASDELVPEEELPEVGPLRPDDVELALRNTRPSAHLQAHRYEKFNQDYGSQILR

SEQ ID NO: 494 - protein, 192 aa, Brachypodium distachyon
MAAATARQLLVHRILCSCSSGTLPKRTFNSHGSSASSCFKAGKTEKLPASFRLRVALNPPRAVLGKGGIVPDDGVSLGTVKLPANIDLARFEALLFQWGNSLCQGATLPLPVPLKVDKVDGGIRLAFVEIDDGAVQLLAYIDCLVSPATDGSGFVFRAIRNGPMKDMEPPGEPRIMRSLLEALQKSIQIARV

SEQ ID NO: 495 - protein, 1965 aa, Brachypodium distachyon
MAAPGRRADFSSSSAQSPGPSPAGASGGGGGGRRLLRTQTVGGNMGESIFDSEVVPSSLVEIAPILRVANEVEAGNPRVAYLCRFYAFEKAHRLDPNSSGRGVRQFKTALLQRLERENDPTLKGRVHQSDAREMQRFYREYYKKYIHALQSAADKADRALLTKAYQTAAVLFEVLKAVNVSQSVEVDQAILDTHNKIEEKKKLYVPYNILPLDPESTDEAIMQYPEIRASVYALRNTRGLPWPKENEKKPDEKKTDKDLLDWLQAMFGFQKDNVSNQREHLILLLANVHIRQIPKPDQQSKLDDRALDAVMKRLFKNYKMWCKYLGRKSSLWLPTIQQEVQQRKLLYMGLYLLIWGEAANLRFMPECLCYIYHHMAFELYGMLAGNVSPMTGENVKPAYGGDEEAFLMKIVTPIYKVIEEEAHRSKTMKSKHSHWRNYDDLNEYFWKVDCFRLGWPMRADADFFKTPKLAYPNRLNGEERSAGSVHWMGKINFVEIRSFWHIFRSFDRMWIFLILSLQAMVIIAWNGGTPSDIFDSGVLQQVLSIFITAAVLKLGQATLDIVFGWKARTNMSFARKLRYVLKLVSAAAWVVILPVTYAYTWTNPTGLARTIKDWLGNGHQPSLYILAVVVYLAPNMLASGLFLFPCIRRYLESSNFKVITFMMWWSQPRVFVGRGMHEGPFSLFKYTMFWVLLLAMKLTVSFYIEIKPLVQPTKDIMGTPIRTFQWHEFFPHANNNIGVVIALWAPIILVYFMDTQIWYAVFSTLVGGIYGACRRLGEIRTLGMLRYRFESLPDAFNKWLIPSDAHKRKGFRAAFSTKPSKSPSDEQEIEKRAARFAQMWNLIITSFREEDLIDNREMDLLLVPYCKDRELNIFQWPPFLLASKIPIALDMAADSGGKDRDLNKRMGSDPYFSYAIRECYASFKNIINTLVSGQREKVVMQEIFTVVEKHINEGTLIKDLHMRNLPALSKKLIELLELLQTNKEEDKGQVVILFQDMLEVVTRDIMEDQELGGVLDSIHGGNSRKHEGMTPLDQQDQLFTKAIKFPVVESNAWTEKIKRLQLLLTVKESAMDVPTNLDARRRISFFANSLFMEMPNAPEVRNMLPFSVLTPYYKEDVLFSLHNLEEPNEDGVSILFYLQKIYPDEWKNFLERVDRKTEEEVREDETLEDELRLWASYRGQTLTRTVRGMMYYRKALELQGFLDMAKDDDLMKGYRATELMSEESPLMTQCKAIADMKFTYVVSCQQYGIQKRSNDPCAHDILRLMTTYPSLRVAYIDEVEAPSQDRIKKIDKVYYSVLVKASVTKPNDPGQSLDQVIYKIKLPGNAILGEGKPENQNHAIIFTRGECLQTIDMNQEHYMEEALKMRNLLQEFLEKHDGVRYPSILGVREHIFTGSVSSLAWFMSNQETSFVTIGQRVLANPLRVRFHYGHPDIFDRLFHLTRGGISKASKIINLSEDIFAGFNSTLRGGNVTHHEYMQVGKGRDVGLNQISLFEAKIANGNGEQTLSRDIYRLGHRFDFFRMLSCYYTTIGFYFSTMITVWTVYVFLYGRLYLVLSGLDEALATGKRFVHNSPLQVALASESFVQLGFLMALPMMMEIGLERGFRTALSDFVLMQLQLASVFFTFSLGTKTHYYGRTLLHGGAEYRATGRGFVVFHAKFAENYRLYSRSHFVKGIELMILLVVYEIFGQSYRGAITYIFITVSMWFMVGTWLFAPFLFNPSGFEWQKIVDDWTDWNKWIHNRGGIGVAPEKSWESWWDKEQGPLRHSGKRGTVVEILLALRFFIYQYGLVYHLNITKQYNKSVLVYGISWVVIFSMLLVMKTVSVGRRRFSAEFQLVFRLMKGLIFISFISTIVILIALAHMTVLDIFVCILAFMPTGWGLLLIAQAIKPVVEMVGLWGSVKALARGYEILMGLLLFTPIAFLAWFPFVSEFQTRMLFNQAFSRGLQISRILGGHKKDRATRNKE

SEQ ID NO: 496 - protein, 409 aa, Brachypodium distachyon
MEALAIGSVPSRPGLPPPTRHSHLRRPKTLLASAPPCRIIAAVPMDGAASRSPAPLRCTPAETDAVATSSDETAATAEATQQGDGIPVEDAAASIEGVDGIKIRRRPVTGPSVHYVGPFQFRLENEGNTPRNILEKIVWNKDVEVWQMKERRPLYMLKGPLDNAPPARDFVAALKASYDRTALPALIAEVKKASPSRGVLRENFDPVVIAQTYEINGAACLSVLTDAKYFQGSFDNLEAIRNAGVQCPLLCKEFIIDAWQLYYARSKGADAVLLIAAVLPDRDIKYMLKICKILGMAALVEVHDEREMDRVLGIDGIQLIGINNRNLETFEVDISNTKNLLEGERGQLIAQKGIIVVGESGLFTPDHISFVQNAGVKAVLVGESLIKQEDPGKAIAGLFGKDISHASAV

SEQ ID NO: 497 - protein, 722 aa, Brachypodium distachyon
MAAAASHKPLAAITADDLAAAGAAEAAALHSAVSRALGAKGSGGPAAVWAELSRAALRPDVPFAVHRMLYYGCYAGFPSPAPPAWMPDPEEAALTNVGRVLEARGRELIGEAYKDPITSFRDFHKFSNENPEAYWKMIFEEMGITFSVEPSCILRDNDAYPGGEWLPGAVLNAAANCLNAKPGRRSSDVAIVWRDEGKDSEPLNVVTLEELRKKVCLVANALDSLDLTKGSAIAIDMPMNVNAVIIYLAIVLAGYVVVSIADSFAAPAISTRLKISEAKAIFTQDCILRDDKELPLYSRVLEAKAPMAIVIPARGSTPIKGLRTDDLSWQDFLGRADRTKADIYTTVEQPVYEFSNILFSSGTTGEPKAIPWTHLTPLKAAADGWCHMDIRKGDVVAWPTNLGWMMGPWLVYASLLNGASMALYNGSPNSSGFAKFVQDAKVTMLGVVPSIVRTWKNTDCTAGFDWSTIRCFSSTGEASSVDDYLWLMGRACYKPVIEYCGGTEIGGGFITGCLLQPQALSAFSTPAMGCNLFILDSNGKPLPQDSAGIGELALDPTLFGSSTMLLNADHHEVYFSGMPEWNAKVLRRHGDEFERTADGYYRAHGRADDTMNLGGIKVSSIEIERICNRVNDDILETAAIGVPPVGGGPEQLTIAVVFKDQRPQAEDLNQLKLMFNSALKKLNPLFKVSSVIVVSSLPRTASNKVMRRVLRKELTLAKHSKI

SEQ ID NO: 498 - protein, 164 aa, Setaria italica
MAAAAPSLAPAPSPAPAAKVASPKAGDRKVVPVTAADVVELAEKHVLAVDDSSVDRAVIAKILRSSKYRVTTVESATRALELLALGLLPDVNMIITDYWMPGMTGYELLKHVKESSKLKEIPVVIMSSENVPNRITRCLEEGAEDFLLKPVRPSDVSRLCSRIR

SEQ ID NO: 499 - protein, 254 aa, Setaria italica
MVTTAAAPDGDVDQRQQILPAEASKKKGRRGRREMRRIEDTTSRQVTFSKRRSGLLKKAYELSVLCDAEVALIVFSPRGRLYQFASATDLQNTIDRYLNHTKGTPTNEKVHEPGVEKWKYEVTTLGQKIDAIEAYRRKLLGESLGSCSIQELQELELQLEKSLSSIRQRKQKKLMDQILELREKEQKLSKENAMLRDQCKALPLLELNDKGRVDAAAGGGEEEEDDVRMEDVETELAIGIGRRRPSNTSVGDDA

SEQ ID NO: 500 - protein, 216 aa, Setaria italica
MSKLQTEVLKDAISQVVSEAREKNRKFTETVELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 501 - protein, 173 aa, Setaria italica
MYPAKPSVAAASAPVTGVPMGGPPVAAGNATSQWSSGLFDCFDDCGLCCLTCWCPCITFGRVAEIVDRGATSCGMSGAMYTLLALVAYLTGFRCQWIYSCTYRSKMRAQFGLPETPCCDCCVHFFCERCALCQQYKELKARDFDPDIGWDLNAQRGAGAGQAMYAPAAQGMGR

SEQ ID NO: 502 - protein, 540 aa, Setaria italica
MRMKTLACCRRRPQDFSIDMDQEPDRVMTYNGLETCIINSSAYDDDSGISATTGGDGCVTTDSLDDEVSSCSSKDASGSSFSSHCLSKQEEHLFDELGTPVAVHLLPFKGKKPITYTLSASDIENMKEKFAKLLLGDDTSGGARGVCTALALSNGIINLSATVFGELWKLEPLCEEKKIRWKKEMDWLLSPTTYMVELVPTKQSGADGCTFEIMTPKARSDVHVNLPALQKLDAMLIEVMDSMIDTEFWYEESGSRADGRGKLTGPRKSKKWWLPSPRVPEQGLSQFQRKRLVFQAKLVHQILKAAKSINEQVLFHMPIPAAVMDALPKSGRASLGEDLYQAITTEYIPIEEIFVSLSLKTEHSVLETINRLEGAVFAWNQRILEEKSKKSPARHSWNFIKDSSSELDKMSVCIERVDTLVQLLKSRFPNLPPTFIDVLKVQYNVDVGHAIVEAYSRALVGVAFSILSRVAEILLEDDLIKKPNTPMATLKFDLSSDVYLAGITETPPGHIRRSLMDQISMVDGRFDAVAKKKGVKQLRW

SEQ ID NO: 503 - protein, 307 aa, Setaria italica
MARKCSSCGNNGHNSRTCGGNGRVMMENGGGGVRLFGVQLHVGSSSPMKKCFSMECLSSAAPAVYYAAALAASSSSPSVSSSSSLVSVEETAEKVTNGYLSDGLMGRAQERKKGVPWTEDEHRRFLAGLEKLGKGDWRGISRHFVTTRTPTQVASHAQKYFLRQSSLTHKKRRSSLFDVVENADRAATSANERLRQRRGGGLGAGHGAPGSVSRHHQPAGEARAHPASEPFVPAATVLIGDEQQQREHVAERAAPRQKHPSSLTLSKPHHASLQQAAPDLELKISTTADYQAGSSPRTPFFGTIRVT

SEQ ID NO: 504 - protein, 128 aa, Setaria italica
AFVTSHEGTGVELKIQTPSLSPLAFTGDLAYVLLDSGDLEEGKRQSEVESRGWVWILPRVGTVNWRRGVREVDGCARRCLLLIQKPWHIFWLIREPSYSILFSRKMGLLSCYSFLDVIWEEFASTCGS

SEQ ID NO: 505 - protein, 514 aa, Setaria italica
MAAAMASLPLHLLLLLPLLAVVSFLWLHRAVSRRRGRGGGARLPPSPWALPVIGHLHHLAGALPHRAMRNLAARHGELMLLRLGGLPVVVASSADAAREVMRARDLDFATRPVTRMVRLVIPDGAEGIIFAPYGGGWRQTRRICTVELLSARRVQSFRPVREEEAGRLLRAVASAAPPAWAVNLSELLSVYAADSSVRAIIGSRFKDRDTFLAMLERGLKLFAKLSLPDLFPSSRLAMLVSRCPRRMKQHRQETVVFMDALVRDHEESRAADDGDGKEDLLDVLLRIQTEGDLPVPLTTDNIKSVVGDMFAGRSETAATALQWIMAELMRNPRVMQKAQDEVRRALAGRQTVTEDDLGDLHYMRLVIKEALRLHPPLPLLLPRECRNSCQVLGFDVPAGTIVFVNAWAIARDPKYWDKPEEFVPERFEDGKIDFKGTDFEFIPFGAGRRMCPGMAFGLVHLELALAGLLYHFDWELPLGMEAADLDMTEEMGVTARRLQDLRLVPVVRVPVPVE

SEQ ID NO: 506 - protein, 311 aa, Setaria italica
MASASCLSLLVLVALASSASAQLSSTFYDRSCPRALATIKSAVNAAVSQEARMGASLLRLHFHDCFVQGCDASVLLAGNEQNDPPNLTLRGFNVIANIKAQVEAICKQTVSCADILAVAARDSVVALGGPSWTVPLGRRDSLKAASTSMVLQNLIPPTSSLTQLIQGYGNLGLNPTDLVALSGAHTIGQAHCPSYQDHIYNDTNINQAFAASLKANCPATGGSNVMAPLDTTTPNAFDNAYFKNLQSQKGLLHSDQELFNGGSTDNTVRNFASNPSAFSSAFVTAMIKMGNISPLTGTQGQIRTTCSAANP

SEQ ID NO: 507 - protein, 153 aa, Setaria italica
MDWLPGELCLKIFQLLDHQSLASAPQVCRKWRALTSDDELWRKLFSDRWGADAGAFYAPEGSKSWKDVFVVQDRCDRYGLGVRIIREGKDYYLIYQGEIQRYLGSRQDTDGDGGGKDAPRQDAEDEQRQISNRILFFLGDLEAACADAKRVKA

SEQ ID NO: 508 - protein, 1251 aa, Setaria italica
MYGICAQRSDGKVLNCANATKAVKPDTLFSSRIQSLCPTITGNVCCTADQFDTLHQQVQQAVPFLVGCPACLRNFLNLFCEMSCSPNQSLFINVTSVKQVFLFLIYFINSTMTVDGIDYYVTTNYGEELYNSCKDVKFGTLNTRAMDFLGGGAKTYKEWLAFIGRQANPNEPGSPYLITFRSDFSDSSGVKPLNSTIYSCGDPSLGCSCGDCPSSSVCTGSLLPQLNTDTSCSVKMGSLKAKCLDFSLVVIYLALLCAFLLWGLLHRARGRTASSLQTKPLKNSDDKSDSNQNGKSPHNSVQVSEAASSTVKPSYPSIVQTYMSIFFRKHGIFVARHPLLVLCVSLLIPLLLCIGLLRFKVETQPEKLWVSPGSRAADEKNYFDSHLAPFYRIEQLVLATSASSGSAAPSIVNDNNMKLLFQIQKKVDDLRASYSGSTVALADICLKPLSTDCATQSVLQYFQLDPKKYDDSGIDHAKFCFQHYTSEETCLSTFQSPIDPSTILGGFSGNNFTEASAFVITYPVNNKVETTGQENGKAVAWERAFINLVKEEILPMVLAQNLTLSFSSESSIQDELNRESTADAITIVISYIVMFAYISFTLGDRPSRWLSLFVSSKVLLGLSGVVLVMLSVLGSMGFFSAIGVKSTLIIMEVIPFLVLAVGVDNMCILVHAVKRQPDQSNLEERISEALVEVGPSITLASFAEVLAFAVSAINPMPATRVFSMFAALAVFMDFLLQVTAFVALIVFDFRRAQDGRIDCVPCARIASSPAAGDGGDGQRLHLLARYMRDIHGPILSYRAVKFVVITVFVGLAFSSIALSTRLQPGLEQQIVLPRNSYLQDYFDDLAKYMKVGPPLYFVVKDFNYSSASVHTNQICSINQCNSNSLLNEIARQSLSPETSYIAKPAASWLDDFLIWMSPEAFGCCRKFVNGSYCPPDDQPPCCQLDQDSGTCSASRTCSNCTTCFLHSDLDNGRPSTTQFKDKLPWFLDALPSSDCSKGGKGAYSTSLDLNGYESGIIQASAFRTYHTPLNKQTDYVNSMRAARDFSSKMSKDLQMEIFPYSVFYIFFEQYLGVWKTAIMNICVCLGTIFVVCFLVTSSLWASAIILIVLAMIVLDLMGVMAILGIQLNAISVVNLVMSIGIAVEFCVHITHAFMIGTGDRETRARQALSTMGASVFSGITLTKLVGVIVLRFAKSEVFVVYYFQMYLALVLIGFLHGLIFLPVVLSLCGPPPKSVKPVEQNQPPSASTERT

SEQ ID NO: 509 - protein, 864 aa, Setaria italica
MGGGGGVFRFSSMASSSPRLLVLLLAWLCCAAAQAQTTTDTLRQGASLSGSATLVSLPDRVFEVGFFPPDPKQPSRLYLGVWYRGITPRTVVWVANRAAPAVSGAPSLALTDAGELQVLDGAAAVNGTAAPRLLWSSNTSRAAPRGGYYATIQDSGSLQVRSDDGPLWDSFWHPTDTILSGMQIAVQAPGPPGRAGNERMLFTSWASETDPAPGRYALGLDPNGSGQAYIWRDGNDIYWRSGQWTGVNFIGIPWRPLYLSGWTLSNDRDLGLHYTYTATNTSLQRFVVLPNGTDICYMVKKSSQEWETVWLQPSNACEYYAACGPNAKCTVGQDGKAQCTCLKGFQPKLWDQWNAGNWTEGCTRNPLLGCQVNQSGDGFLPMGNIKWPDFSYWMSTVADEKGCKSSCLNNCSCGAYVYTTTTGCLVWGDKLIDIHELQTGSYTLNLKLPASELRVHHAVWHIAMIISAVVLVVLVACLVLWWWRGRNIKDAVHRSWRSRHSSTWSQQNSSMLDISQSIRFDDDVEDGKSHELKVYSLDRMKAATCNFSDSNKLGEGGFGPVYMGTLPGGEEVAVKRLCRNSGQGLEEFKNEVILIAKLQHRNLVRLLGCCIQREEKILVYEYMPNKSLDAFLFNPEKQELLDWSKRFDIIEGIARGLLYLHRDSRLRVVHRDLKASNILLDADMNPKISDFGMARIFGGDQNQFNTNRVVGTFGYMSPEYAMEGIFSVKSDVYSFGVLILEIITGKRAVSFHYHQDSLNIAGYAWRQWNEDKAAELIDPLIRASCSLRQVLRCVHIALLCVQDHADERPDIPTVIIMLSSDSSLPNPRPPTLMLRGREIESTKSSENEQSHSIGTVSMTQLHGR

SEQ ID NO: 510 - protein, 1908 aa, Setaria italica
MDGASWPARWPPPAPPAAPVPPLPNQMDGVTLRHLLRPFAAQEAAAGGRATAAPEQLITNPSTSQSGQPARAGPSNELLAQVPGSYSTFSLAPDLKALFDKPNASNAADVIDLTRTPPLCSAATLPKYSRHGLTASSSNEQSSAGALFLNKSANGMGTFTGEVSTNEGMANGGIQLQDSSLHALQKLPFRSTTHHHPTLLGDRIHVTCLNVGGEFFVGEAGLFGIICLCHRLRMSVAKFCEHAGGTPEKAGEIVHVENGMTIAQWFKFCIGVAGSIANTRWDWPDWACMKSSPEEYMLKSLASRNSGTGKVRLLGGYGKINGLINNPAYSSDLYIEGGGCTNVDKQMNGSVGTNYKKSVDVHEGLTKDSALLQNSTTMNVGLARNHTVHALNLNPLSTPSGSLHSEASMGRHYKGNHLAHNYGICLEKNLDASFRNPEPRSSRVVNHDSRACRPDFPHKILQDTLCNTSNTELKLGQSSYHQSMTTLFPLVQSAVIEFQKPQSHRPLINQNPCPKQATKVNNNLAEPEHNGPSISTGNKQPLLVTNGTKHSEVGELTDDTSKNSFISLFLSHLERNSTPEPIDDILNSNEHYHPKALDVACGSDHPKNASRHIETRVNDNHPKLAPTIIHMKRRSEGISLSASYSGYNPQDASHGNSQEHLIHGDCPSHLLPNQPNAGISNCARVSCPANCMCCTHMGNKSHQVAHGEIGVPCFYDKMARGHGTFERVDDLCTHRSLRAFAKISCENGKSCCSSQEFLPSFCQNDPSTLGKSICGCCCKIQEGVSKLGFIPGHLCRTRFSSDLGPVVSSKPTLEGQDELCACSSFMQRSSLCSREHILQSCYACPIDGLHYRNSMGHATDSLTKHSLFDGRSTKEQGPCCNGRCCYSVVPKCLSSCAFTKHCDVRVDQIGHTAPISKHQMQMPTRCCTLEENEKLTCQCLSNRIAGRSLSQASRCKDVSDKVMNQPSIAITERLKNISEASVADDSSSKAVTERKGPSKDSVVSKGQPKFGFSSGSSSIVVTKFQMSPEVHKVSSTAKHRKHKNVCDEGSRIEKCSASSYVPASSTGCEEALNSFTRSQLAPSRVKRKGNQISVGSRLEEKDNEELCFGLPKRMRTLRCSSKNSESEDCTRTSSQSSQKGGCQPQNEVNSFSCRVLRTKRKHPTMQLNKPVKQLHSQNKVFKGDGKLPDTKGNFFGGLDSFDRKKQVEDTTPGRTKHHQEGSRAFVRKLPKYVSLNCIVNEPNSEDACSGSAGIDSSLIATGMANDNRKSPKIVPLSLVLKKAKRCHSVKLCKTESTHLYEKKGSDCSVNSSSDCSVDKCPIDDEGCSPQAEYEMQGSKRSRYSSNGLRSHFMAHCKRPSGVLGEDDPLGLKDMETNRLSITSSRSNGTKNRRASVSLTRIKRHKKFANKSACYSSSGKENAVLTHEENVRRDSGRLSLDAPCCVCGISDPEPCNQFIECCKCYIKVHQACYGVLKVPRGQWFCRPCKTNTLNTACVLCGYGGGAMTRALKTKNILKSLLKSLMTTARSEKNVDSLRNGRSECTSLRNPVDSARGDSIANGENITSNSWTSINHNSSLLGPRTMQWVHMVCGLWTPGTKCPNATTMSAFDVSGASPAKRNTACSICGRTGGSFIKCRDVNCLVLFHPWCAHQRGLLQSEPEGERNENVGFYGRCIDHANDFSSRINPKECLRSSSWTCARTEGFKGRKGEGFHGSSHKKSEEYSGEFSVSQEQINAWLRINGSKPSGRGQKEYIHYKQLKGWKHLVVYKSGIHGLGLYTSVFIPRGSMVVEYVGEIVGQRVADKREIEYQSGKRLQYKSACYFFKIDREHIIDATRKGGIARFVNHSCQPNCVAKIISVRNEKKVMFFAERHINPGEEITYDYHFNREDEGQRIPCFCRSRYCRRYLN

SEQ ID NO: 511 - protein, 341 aa, Setaria italica
MGSSQESTFSSASGAAQVNASTLDLLPVYAKELTAGGAAGAFAKTAVAPLERVKILLQTRTEGFQSLGILQSLRKLWQYEGVRGFYKGNGASVLRIVPYAALHYMTYEQYRCWILNNFAPSVGTGPVVDLLAGSAAGGTAVLCTYPLDLARTKLAYQVSNVGQSGNALGNSGRQQTYNGIKDVFKTVYKEGGARSLYRGVGPTLIGILPYAGLKFYIYEDLKSRVPEDYKKSVILKLSCGALAGLFGQTLTYPLDVVRRQMQVQSKLPQNSSDGFRIRGTFQGLLLIIRCQGWRQLFAGLSLNYVKVVPSVAIGFTTYDMMKTLLGVPPRERVHASSGANK

SEQ ID NO: 512 - protein, 1135 aa, Setaria italica
PAPFFPPPAAPGFSRAVRCNAPSSFPADGGGFGGAGQQQHAAAYPGNAISTTKYTAASFVPKSLFEQFRRAANCFFLVVACVSFSPLAPYRAVSVLLPLLVVVSAAMAKEAVEDWRRKQQDIEVNNRKVEVYDGTQSFHETEWKKLRVGDIVKVKKDEFFPADLLFLSSSYDDGICYVETMNLDGETNLKRKQALDVTMGLNDEQFFHSFKAFIRCEDPNEKLYSFLGTLYYNEQQYPLSPQQILLRDSKLRNTSYIYGTVIFTGHDTKVMQNAMEPPSKRSSVERRMDKIIYLLFAILFAIATFGSIVFGMKTKHEISPGNYAWYLRPDQANIFFDPNRASFAAFCHFLTSLMLYVTLVPISLYISIEIVKVLQSTFINQDQNMYCAESDKPARARTSNLNEELGQVHTILSDKTGTLTCNSMEFLKCSIAGVAYGNSPTEMETSYGEIAETTANYGHKNTTEFKRLVKGFNFTDGRLMNGRWAKECSRDSIEMFFRVLAVCHTAIPVADRNSAGMPYEAESPDEGALVTAAREFGFEFYHRTQTTISVHEYDPVFGGKVDRTYKLLNILEFSSARKRMSVIVRTEVGRLFLFCKGADSVIFERLSKDNGKACLSKTKCHINEYSEAGLRTLVLAYRELTEEQYVLWNQKYSAAKNSVHTDHDEAVEKASEDIEKDLVLLGATAVEDRLQSGVPECIHKLAQAGIKIWILTGDKLETAVNIGYSCNLLRKEMEEIFITLDNSSTSASEGCSGEGNRMAPYEEIDRKLLDARTKVFMRGTSTLFALIIDGNALTHALTSSLKNSFLDLAVNCASVLCCRISPKQKALVTRLVKIRTGKTTLAIGDGANDVGMLQEADIGVGISGAEGMQAVMASDFAIAQFRFLERLLLVHGHWCYRRIAAMICYFFFKNITFGITLFWFEAHAMFSAQPAYNDWFISFYNVAFTSLPVIALGVFDKDVSSRVCLEVPSLHQDGVNNVFFSWSRILSWMLNGLCCSIIIYFGSLNAILIQAVRQDGRVAGFDILGVTMYTCVVWTVNCQLALYISYFTWIQHFVIWGSILIWYAFLVIYGLFPPAISTTAYHVFLEACASSPLYWLSTLMIVVTALIPFFVYKISRTLYYPQYHDKVQRTNSKNW

SEQ ID NO: 513 - protein, 147 aa, Setaria italica
MAGVSSSSVVGLKPAAAVPQAASAAKRVQVAPKERAAEGRRAALLGLAAVFAVTATTGSAKAGIIDEYLEKSKANKELNDKKRLATSGANFARAYTVEFGSCQFPYNFTGCQDLAKQKKVPFISDDLEIECEGKEKYKCGSNVFWKW

SEQ ID NO: 514 - protein, 373 aa, Setaria italica
MAHDEAVATQKTGNTASSPKDQPAPSPYPDWSTMQAYYGHGVLPPTYFAPAIAPGHPPPYMWGPQPLMPHPFGTPYAAMYPHGAAYPHPLVPMVSNPLSVEQTKSANSKEKSSSKKLKEIDRTAVSAGSGNSKRTMSSSEDYSAEGSSDVNDQKVNKTSRKRSLVDGPGAETSEAAKLANTAILPHHCFPAPVIKPSATNVANSRAMGATISPSPGVIVPPHTGGPTDLSIKDERELKREKRKQSNRESARRSRLRKQAETEELATQVESLTAENTSLRSEIGRLTESSDKLRFENSALMVKLKDTAAPTPAEPSPNKAATSSSSPGAAAAENFLSMIDSTNAPGVSRHTEHGEPKLRQLLDSNPSTDVAAVS

SEQ ID NO: 515 - protein, 344 aa, Setaria italica
MASWLLLPLPSFPWLPPPPPPGSSSGGRGGGGGGGDGGDWRPNVVAAFAGAQVGSALRRRFAGLLRSPEVRHLEALPNMGDICFGGSHSFATHPILGALGNVFPASYVCSFTLFNGNGSGGTYIGKGKVLSRRPRRIDSKKRLWTNVLLAINVLAYIAQVASQGKLLMWGAKINSLIDRGQFWRLATSSLLHANVTHLAFNCFSLNSIGPMVEMLSGPRRFIAVYISSALAGSLMSYRCCESPAVGASGAIFGLVGAHAVYMWRHRSYFGNARESLEHIGRVVVLNMGMGLLSRGIDNWGHLGGLLGGVAVAWFLGPAWQYQYVGKDGRVVFKDRAPVLRLIKG

SEQ ID NO: 516 - protein, 389 aa, Setaria italica
MGVGKVLNEVKPYLYMVLLMVGFSGMYIVSVASLRRGMSHFVLVVYRNFVGTVLMTPFALLFERGVRPKMTPLVFVKVMGLALLEPVLDQNMYYLGAKLTSAGFASALVNMLPAVTFLMALVLRMEKLRLRSLHSQAKILGTVCTVAGAVLMVLYHGPVVPFPWSSGGAHHHAAVAAGTAASQSGGAWLYGVAMVIGSCVCWAGFFILQSNTLQSYPAEMSLTALICGVGTVMSGAVALFAERRDMSAWVIGFDTRLFTVVYSGIVCSGVAFYVQGLVTRVRGPVFVTAFQPLCMIFTTIMGSTILKEETTLGSVVGAAIIVVGLYSLIWGKSKDHLGDGKPGAGVVTELPLTSAPTPNGNGYGKQHALGGHVVTDVETPAATVTKCAY

SEQ ID NO: 517 - protein, 768 aa, Setaria italica
MRRGRGHGGGGVSASLAALLCCGCVMVLAGAAAAQGPRLPSAYKTLRGDAPRVVAKGGFSGVFPDSSSDAYSFALIASAPGTTLWCDVQLTKDGVGVCLRDINMNNCTNVAHTYQARKRTYVIDGVRKNGWFALDFTKDELQSVSLTQAIWSRTYRFDSVGYSILSVTDLLSIVKQPSVWLNVQHDTFYKEHGLNMRNYILSIQKRVSVDYISSPELGFLQNISGTVHRKTKLVFSFLDKSLLDHSINQTYGSLLSNLTLIKSIASGIMVPKTYIWPVTKDNYLQPSTSIVAEAHNAGLEIYASDFANDRIIPYNYSYDPLAEYLNFISDGGFSVDGVLSEHPITASEAIGCFANLNSSETGHGEPLVISHNGASGDYPDCTDLAYNSAINDGADVIDCPVQVTSDGVLMCMSSINLLDTTNVQGTTFSSLSSVVPEIQATAGIFTFNLTWDDINSSTLKPKISSPVSDYYLVRNPRYTNQGKFLNLSDFLAIGMDKDLSGVMIIIENAAFVAKSLGIDIVDSVNAALSAAGYDNQTTKQVLIQSKDSAVLVKLKQQKTKCKLVYTLPLGIGDASTSSLEAMKKFADAVVVDRKSVFTLSQDFAIRQNSLVKDLQSAGLAVYAQVFRNEFVSQPLDFFADETVEINYYVQSFNLSGIITDFPKTVRRYKKNTCTGLGNDMPNYMQRIDVGSLYQLLQPFKAQPPSVPPMPTLNASSVEEAPLPPVASRNGSGGSSSGAETPGAPPAAAHKATVSTGMLFVMVFTALLI

SEQ ID NO: 518 - protein, 205 aa, Setaria italica
MDLPNGRDDAPIPNGGVGAEETVGRRKKVELVREAIHGLLEEKRMDGQGEKEMPARQRQEDEHLLSSLLTKPDALERDPDSDTLETHSLHPSHQPGRSETSKEVELADIAKDLNKIKRQNTVTHILLGAVIVLTAVWQVNEVSFLLWVQRKLSNPFKSLGDMIKGSLKLKGRKPVIESSPLPPVGVPDVSRPDLPSFVIGSTEGR

SEQ ID NO: 519 - protein, 614 aa, Setaria italica
MGLFSSPAKVYKPAADVDLGPDSDEHYISPNVKAPRVAGLLVKLLAWVLEMPVVGWIVLSVLKRDNLVYKLVSDAEIPEPPLFTATHTWQDIPEQNVRLTKPGLPPPERVQEAVVCLTAPLPEPAAALADPSPGFRRWTVRDFHEAYSSGQTTPVMVARRFLAAVKECSGPEVNMALFISCDAADVMRQAEDSTRRYQQGAPLSAMDGVLVAVKDELDCAPYPTTGGTRWLAAARRPCGAGDAACVAQLRACGAVMAGKANMHELGAGTSGINPHHGATRNPYCLARVSGGSSGGSAAAVCAGLCPVALGADGGGSVRMPAALCGVVGFKPTAGRLSNSGLLPLNWTVGMPGILAATVEDALIAYAAIVDQSKPSHLQPELNLPMLTCTRSMPNIRLAKYAKWFDDCSEDIRSLCGKALQMLRTQYGWECVDVTVPEIEEMRLAHYVTMGSECTASLAKYLDNMSKSEIGWDVRIGLSAYRSFSSRDYLNAQRLRNRQMFFHNKIFETADAIVTPMTGVTAYPLQEDALGTGELDYINGAALVRYSIAGNFLGLPAITVPVGYDTGGLPVGLQFIGRPWSEATLLHLAYATQEACAREHRKPKVHYDLLLSKEY

SEQ ID NO: 520 - protein, 207 aa, Setaria italica
MAVATETPFHVLAVDDSLPDRKLIERLLKTSSFHVTTVDSGSKALEFLGIHGEDSSPVSVHEDQLEVAVNLIITDYCMPGITDMILTGYDLLKKIKESSSLRDIPVLIMSSENIPSRINRCLEEGADEFFLKPVRLSDMSKLKPHILKSRCKEHYQEQHQQSDSNSNECSNPTNDSSSSSSDNSNSRKREAEDNEEILPQRNRSRHS

SEQ ID NO: 521 - protein, 382 aa, Zea mays
MAPLFAAASHASLLPLSSLDRPAAGHLVRGTLRPHTSSLRLRRPPGATGRGRGRGRGGIPDEWGERSPPDNPEPPAQPDPPIDEDEWGRDDSAEGNSRPIVVDEWGEPGVPEPEPPSAADPPSPSADDDWGKEPEAPAPAPAPAAEEDEQEVKREELKRCLVDTVYGSDLGFRASTEVRGEVVELVTQLEAVNPTTAPVESPDLLDGNWILIYTAYSELLPILAAGATPLVKVKQISQEIDSKIMTIVNASTLTTPFASFSFSATASFEVQSPSRIEVQFKEGSFQPPTISSSVDLPQQVDIFGQKISLGPVQQALNPLQQAFASIAGSISGQPPLKVPIPGNNRARSWLLTTYLDKDLRISRGDGGLFILAKEGSPLLDQL

SEQ ID NO: 522 - protein, 312 aa, Zea mays
MENPASVLVLPAQFTKLTFGNLYIRRAGPGSREITEEGRCDLDKRYVSDFPVYDGRGPDASLVARVQGITSEIGNAHQLFVVVFDTDRLKGSTLVTNGVITAGSDEWAIYGGTGVFAMARGVIRRRYLADRAGGNTDELNMDVFCRPFGSQSELQDKMQVQGQGSSVTKIGLWGGPGGSAQDITAERPPQRLHSVTVRAGVAVDSIEFTYTDSAGQRRAAGRWGGLGGNVRTIDLGDAEDVREVSGTYGAFEGATTLTSLRLVTSSRTWGPWGVENGTRFSVTAPIGSSIVGFYARAGTRLVDAIGVYLRQI

SEQ ID NO: 523 - protein, 89 aa, Zea mays
MKSSTLLAILVLQALLVSAAVAKGPAGPTTKKQCWCGECTSWSGVWTCDDLLTKCAATCKNCVPVSTDKGAIKYRCRDFLPENCGCKIH

SEQ ID NO: 524 - protein, 300 aa, Zea mays
MDIDLFPDIDLDALLASFSGDPAAVSGLIIPSPPPPAPATAHDAEAGSPESVTSRTNPLGEVALSEIERLLMQEGEAELGGEVDGISVDQFFDALYDGEEAKGEREAGASADVDSGRDDVLEVVTPEAGTVEVDGDDPISKKKMRQMRNRDSAMKSRERKKSYIKDLETKSKHLEAECRRLSYALQCYAAENMALRQSLLKDRPLGAPTATQESAVLTETLPLVSLLWLVSIVCLFLMPVLPNRSPAAPSSGGRDLVMAAGKTSSETPEILELILHGRRCKSTRAKIKLCILPFHAGAAC

SEQ ID NO: 525 - protein, 114 aa, Zea mays
MPRATSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLG

SEQ ID NO: 526 - protein, 782 aa, Zea mays
MDAEAGVAGADQLPRRQYYLNLLLLAYQSFGVVYGDLSTSPLYVYKSTFSGKLRHYQDEETVFGVLSLIFWTFTLIPLLKYVIIVLSADDNGEGGPFALYSLLCRHAKLSLLPNQQAADEELSSYYRNGFAPRNGSSPWSRRFLEKHKKMRTLFLLIVLCGASMVIGDGVLTPAISVLSSMSGLHVRATGLHHSSVVLLSCIVLVGLFALQHRGTQKVAFMFAPIVIIWLLSIGGIGLYNILHWNPNVYQALSPYYMVKFFRKTGKDGWIALGGILLSMTGSEAMFADLGHFTSASVRVAFITVIYPCLMLQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMLVTTFLMALIVIFVWQRNIIFSLVFLVFFGSIEAVYLSSSLMKVPQGGWVPLVLAFIFMSVMYIWHYGSRRKYQFDLQNKVSMRSILSLGPSLGIVRVPGVGLIYTELVTGVPSIFSHFVTNLPAFHEVLVFLCVKSVPVPYVSPDERYLVGRIGPKEYRMYRCIVRYGYKDVQRDDDNFENMLVMSIAKFIMMEAEDASSASYDIANEGRMAVITTTDASGSPLAMRDFDGLADSMSTRSSKSESLRSLQSSYEQESPSVNRRRRVRFEVPEEDGMGQQVKEELTALVEAKHAGIAYIMGHSYIKARRNSSFLKKFAIDVGYSFLRKNCRGPSVTLHIPHISLIEVGMIYYV

SEQ ID NO: 527 - protein, 621 aa, Zea mays
MFGRDPWGGPLEISNADSATDDDRSRDLDRAALMRQLDETQQSWLLAGPGDQAGKKKKRYVDLGCVVVDRKIFMWTVGTILGLGVFIGFIMMIVKLVPHKRPPPPPPDQYTQALHKALMFFNAQRSGPLPKHNGVSWRGNSCMKDGLSDSTVRRSLVGGFYDAGDAIKFNYPMAWSMTMLSWSVIEYRAKYEAIGELDHIKELIKWGTDYILKTFNSSADTIDRIVAQVGVGDTSKGSSQPNDHYCWMRPEDIDYKRPVTECHSCSDLASEMAAALAAASIVFKDSKTYSDKLVKGAKALYKFGRLQRGRYSPNGSDQAIFYNSTSYWDEFVWGGAWMYFATGNNSYLTVATAPGMAKHAGAYWFGSPNYGVFTWDDKLPGAQVLLSRLRLFLSPGYPYEEILRTFHNQTDNVMCSYLPLFNSFNFTKGGLIQLNHGRPQPLQYAVNAAFLASLYSDYLEAADTPGWYCGPNFYTTEVLRKFARSQLDYILGKNPLKMSYVVGFGNKYPKRPHHRGASIPHNGVKYGCKGGYKWRDTKKANPNILVGAMVAGPDRRDGYKDVRTNYNYTEPTLAANAGLVAALISISDIKTGRFGIDKNTIFSAIPPMFPTPPPPPSAWKP

SEQ ID NO: 528 - protein, 164 aa, Zea mays
MSTAPRRPFRGRGAMPSGTGYVRRGPAPGSADAAKPLRKPVFTTVDQLRPQTHGHTLTARVIAVRTVLDKPSTHLGRTRVAECLVGDSTGTVLVTARNEQVDLLKPDTTVIFRNAKIDMFKGTMRLAVDKWGRIEVTDSSVFKVNEDNNMSLVEYELVDVDEEE

SEQ ID NO: 529 - protein, 212 aa, Zea mays
MDEEEHEVYGQEIPEDGDMDGADVDMAASGDDAAKLQELDEMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEGVQEALNLNESELHGRQIKVAPKRTNVPGMKQRPPRGYNPYHGYPYRSYGAPYFPPYGYGRAPRFRRPMRYRPYF

SEQ ID NO: 530 - protein, 830 aa, Zea mays
MAPAAPAGLASVAVAVAVAVLAAAASAAVTYDRKAVVVNGQRRILMSGSIHYPRSVPEMWPDLIQKAKDGGLDVVQTYVFWNGHEPSRRQYYFEGRYDLVHFIKLVKQAGLYVHLRIGPYVCAEWNFGGFPVWLKYVPGISFRTDNEPFKAEMQNFTTKIVDMMKSEGLFEWQGGPIILSQIENEFGPLEWDQGEPAKAYASWAANMAVALNTSVPWVMCKEDDAPDPIINTCNGFYCDWFSPNKPHKPTMWTEAWTSWYTGFGIPVPHRPVEDLAYGVAKFIQKGGSFVNYYMYHGGTNFGRTAGGPFIATSYDYDAPIDEYGLLREPKWGHLKELHKAIKLCEPALVAGDPIVTSLGNAQQASVFRSSTDACVAFLENKDKVSYARVSFNGMHYDLPPWSISILPDCKTTVYNTASVGSQISQMKMEWAGGFTWQSYNEDINSLGDESFATVGLLEQINVTRDNTDYLWYTTYVDIAQDEQFLSNGKNPMLTVMSAGHALHIFVNGQLTGTVYGSVEDPKLTYSGNVKLWSGSNTISCLSIAVGLPNVGEHFETWNAGILGPVTLDGLNEGRRDLTWQKWTYKVGLKGEALSLHSLSGSSSVEWGEPVQKQPLSWYKAFFNAPDGDEPLALDMSSMGKGQIWINGQGIGRYWPGYKASGTCGICDYRGEYDEKKCQTNCGDSSQRWYHVPRSWLNPTGNLLVIFEEWGGDPTGISMVKRIAGSICADVSEWQPSMANWRTKGYEKAKVHLQCDHGRKMTHIKFASFGTPQGSCGSYSEGGCHAHKSYDIFWKSCIGQERCGVSVVPDAFGGDPCPGTMKRAVVEAICG

SEQ ID NO: 531 - protein, 292 aa, Zea mays
MAAPASSSCFHPRATASPPSSLSVGTKVFVGLRAQTKLGSSESSCPNVSAGFHTAVNRRISLRLSKKKATRARISMMPIGTPRVPYRTPGEGTWQWLDIWNALYRERIIFIGDNIDEEFSNQVLASMLYLDSIDNSKKIMLYINGPGGDLTPCMALYDTMLSLKSPIGTHCLGFAFNLAGFILAAGEKGSRTGMPLCRISLQSPAGAARGQADDIENEANELIRIKNYLYGKLAGHTGHSVEKIHEDLSRVKRFDAEGALEYGIIDRIVRPSRIKKEGSTAQRRDMRNLGLG

SEQ ID NO: 532 - protein, 900 aa, Zea mays
MGKRGHRRSASQDDDNVGCVWGLMRMLYFRRDPKLLLDAKQLSGRHAFREVSGRGHSAKRPNDFDGIEEDGNIEDRTLQKPTVKNLMEDELEKLMLLKKFPNDEVQRRKADLGIDVSLDTISEHTNKSTDNSYHQAGISTPSTPSMDYGVLNYTEEYNLESVLVNFLGEIYSCHNECPHSDCKNKNELCPSLKSLIHKKVNELNNLPHNIGRGQSQEGSDAKPSDQNNLYNTMAAQSKQFKDALEILGSNSELFVKLLQKPNQHIADSIQQHENSKVSAGLEPDKIHGQTNFVGGRGSSKQHPLATKEQAKERKYMFFWRKSKSNRRQMLDATDGAQTVSKIVILKPNPERGINQKAATARTLHQQPCTSNAPGCSGRENSKFSIKEVKKRFRFVTGERSERNLSPAEDLQGDPRKIKDSVVAINKYFRHLPEGSLANKSASDIENGIKPFISSKQKNQNGSITEISGHIVAPKGASVFYEEARRHLSEMLKGNDCSINYPEVQISKSLEGILSLPHGNVSTTGSSLRGKDYLDPSPGETDVYDACEVEREECTQERSQSQEDFGSIAHCTCTTVDDQVTVREGYYTNEAQEGPRHAHDEPDTLYIEGLDKFICRENIRNEESSPAEQSRDDIRQEILEEINQGKEHVKMSLASVEGIDEKLGQQEPETPEPRASAKLISDGSPNQSDEKQERPSPVSVLESSFEDIGSPDCINKKECELHGLQRTLYFPDNEPDVNVLWEDKNVRLDYIKLVLELSELCAEQNLEVWYLEDELISPCLFEELQSQGDQTDDRMLLFDCICEALTEIQERYFRLSSWLTFLKHDIRTPPTGENLITEVDRYVNGYIIQYSLPSTLEQTIKRDLEVQTWMNIRSKTEGIIMEMWEFVLDELIDETVSDLWI

SEQ ID NO: 533 - protein, 915 aa, Zea mays
MAPSSPSPAAPTRVSGRKRAAKAEEIHQNKEEEEEEEEVVAASSAKRSRKAASSGKKPKSPPKQAKPGRKKKGDAEMKEPVEDDVCAEEPDEEELAMGEEEAEEQAMREEVVAVAAGSPGKKRVGRRNAAAAAGDHEPEFIGSPVAADEARSNWPKRYGRSTAAKKPDEEEELKARCHYRSAKVDNVVYCLGDDVYVKAGENEADYIGRITEFFEGTDQCHYFTCRWFFRAEDTVINSLVSISVDGHKHDPRRVFLSEEKNDNVLDCIISKVKIVHVDPNMDPKAKAQLIESCDLYYDMSYSVAYSTFANISSENGQSDSDTASGISSDDVDLETSSSMPTRTATLLDLYSGCGGMSTGLCLGAALSGLKLETRWAVDFNSFACQSLKYNHPQTEVRNEKADEFLALLKEWAVLCKKYVQDVDSNLASSEDQADEDSPLDKDEFVVEKLVGICYGGSDRENGIYFKVQWEGYGPEEDTWEPIDNLSDCPQKIRDFVQEGHKRKILPLPGDVDVICGGPPCQGISGFNRYRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCMVAYDETQKPSLKKALLLGDAISDLPKVQNHQPNDVMEYGGSPKTEFQRYIRLSRKDMLDWSFGEGAGPDEGKLLDHQPLRLNNDDYERVQQIPVKKGANFRDLKGVRVGANNIVEWDPEIERVKLSSGKPLVPDYAMSFIKGKSLKPFGRLWWDETVPTVVTRAEPHNQVIIHPTQARVLTIRENARLQGFPDYYRLFGPIKEKYIQVGNAVAVPVARALGYCLGQAYLGESEGSDPLYQLPPSFTSVGGRTAGQARASPVGTPAGEVVEQ

SEQ ID NO: 534 - protein, 124 aa, Zea mays
MEGGETTLSGFGGAGAPGVDTKVLHAFQTSFVQVQTLLDQNRLLINEINHNHESKVPGDLSRNVGLIRELNNNIRRVVDLYADLSSLFAAADGGGGRAASEGGSVGTVRHQAGAGHKRIRSGLD

SEQ ID NO: 535 - protein, 771 aa, Zea mays
MAWHLDILVMVTTCLIFFSISEQSSQSELLQQLRKQLEYPRQLEAWGSPSSDPCYTQPTAVLAVTCEENAIRELKIIGDRITKPPKFSGFSVPNVTLSEAFVLDSFVTTLARLTTLRVVILVSLGLWGPLPDKIHRLSSLEVLDLSSNFLYGSIPPKLSVMSKLHTVTLDGNYFNGSVPDWLDSFSNLTVLRLQSNQLKGSIPASIGKAAMLTELALAGNSISGDVPNLVNLNKLEMLDLRDNKLDGELPEMPTSVVTILLSKNSLKGEIPEQFGQLNRLQHLDVSFNFLVGSPPAELFALPNISYLNLAANMLSGSLLSSLTCSSTLGFVDLSTNRLTGDLPSCLNGNLNNKVVKFDGNCFRVDPAHQHEDKYCQQSHNGRGSKKDVGLVVTVVGILFVILVLSLLLMASNKRSCQKVLAEQQIQQKHTQDNLLSGMSSELLVNARCISQAVKLGTQIQPSYHIFSLEELKEATKSFERSAFLGEGAIGKLYKGRLENATLIAIRCLPLHQRYSIRNLKLRLDLLAKLRHPNLVCLLGHCIDSAVDESTVKRVFLVYEYVPGGTLSSYLSACSPDKTLKWCDRLQVLIAIAKAVHFLHTGIIPGSLSNRLKSSSILVDEHHTAKLSDYGLSIITEEIYRHEVIGQKEKYLQNDATEMENLEDDVCSFGYILLEVLMGPKLHEKGGPFILKDLVVSMSTLEERDQVVDPVIIGTCSQDSLSIVVSIMIKCLSIECSARPSMEEVLWNLQYAAQVQTMADSDQRSEVSSQAC

SEQ ID NO: 536 - protein, 356 aa, Zea mays
MNMGGRSPAATTIRCKYCSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLVQGCSSGDSLVFHFSGLGAQVADADCDEQDGYDEAICPVDSFQKGPILDDEINETIVRPLVPGAKLHAVVDACHSDSVLDLPFLCNMSRTGNWQWEDHRPPSGVCKGTSGGQAVLISGYSDGKSKFSMTPEACAAVGAMTHSFIKAVECEPQGVTYGRLLTSMKAIMTNAGGCNQQLQGACAPARKVVNFSGVQEPNLSCSEMFDVYRKPFAL

SEQ ID NO: 537 - protein, 141 aa, Zea mays
MQDPRDDDFLAPKLHKKKVVYRPQPSGHLKGEPELLRREFPQSSGMVQKPPKRSLKGEPRTPPSDRGTPDSLPESGPTDEYRALRRKYLMLEEENFALDKELSMEDEEMKALEDEKLALLDQLVVLEGLVEPSQLQSQPRP

SEQ ID NO: 538 - protein, 844 aa, Zea mays
MEAALGALCRAGGWSYAAVWRFHPQDPRLLTLGDCYCEDEAKAMVQKMLNLVEVVGEGILGQALVSGECQWIYDDTCHALNQISHADNGDLHQGYTWWQHQFLSGMKTIAVLPLQLHGLVQFGSTRKVPRSSVFLNQVRDIFDRMKNASSDGPMEYTQNNSLACGQQPILTSSRPVNDMLVHNKVNPLQTEKLLEDIERTESIRSSICSPSNSQRSLNDLTSHGTGNSSMDTNILAMPVNSKSIYDLKRFDNVTELFHRSSNDRIGFQVSSSKEPDSTIAGVMSEYKSLNNIHMTENDSCGQNIGYTPYLYTTTNSSNSGLDELSYSGVALSSSFTAVSGKVKDCLQTESDKFLCKSVSFGSNPCASKFQENRLSPYHALMHEQSLIPDPGESVRLLSQEESFIVQGDSSQFKDTADFTGQGNSTFPELPNRSPEEATAETLENNMKDCSGNNSLLETMMLDLSTNSFVQDWWDNSVLLAENLPNSSEKDPEPAMELANRHSLPTGERGSPFIPVIEQLLGDVAHPPTPTGHSSLEAEATALAGRVSDYQLPQFAFRDCLTVDNAQIPALACSNYTCRTRSAQNGSSEVPSANVSVDDTCSLNTANSNGSQSSNPEGTKVAKRRARAGESTRPRPKDRQLIQDRVKELREIVPNGAKCSIDALLERTIKHMLFLQSVNKYAEKIKQADEPKIIDKGSGVILKDNPVAGTNGGATWAYEVAGQTMVCPIIIEDLSPPGQMLVEMLCEEQGLFLEIADNIRGIGLTVLKGRMELCDGKIWSRFLVEANREVTRMDIFLSLVQLLEQNSLVRPTDQMAKVMNNGVPSFANHQRSPLLVPVGIPERLQ

SEQ ID NO: 539 - protein, 792 aa, Zea mays
MAFGRGGKMDGRRPSSSSSSSSFCTTTTVVLFVALCLVGAWMMTSSTVFPLEISSNKKPVVKQQPAPVNFGASQEASPGIAGEGSEKFEDTDNNDATVPEEPNKQDASEQENFNEKPEEKELEVPVEKAETKDMFDDANGKSEGLSDETKNDDGEKSVEKKDNEITNESGDEKTDGESKDGQEEKPDGDATQEEQPKIEENVEENGEKDQSSNSNEVFPDGAQSELLKESNTQNGSFPTQAAESKNEKEVQALPKSSGVATSYTWKLCNSSASTDYIPCLDNEKAIKKLRTTKHYEHRERHCPEEPPTCLVPLPEGYKRPIEWPKSRDKVWYSNVPHTRLAEYKGHQNWVKVSGDYLLFPGGGTQFKNGALHYIDTIQQALPDIAWGKRSRVILDVGCGVASFGGYMFDRDALTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIYQKPMDNICYEKRSENSPPLCKESDDADAAWNVPLEACMHKLPGGSKVRGSKWPELWPQRLEKTPFWIDGSKVGVYGKPANEDFEADNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLRKRCKLAAVFAEVDRVLRPQGKLIVRDTADTINELESMAKSVQWEVRMTYTKGSEGLLCVEKSMWRPKELDAST

SEQ ID NO: 540 - protein, 387 aa, Zea mays
MLPSHLNGHSALGRRRPRLSAAAGESPAAAGVEAAAPLEEHDRIYFQAYSHLGIHETMIKDRVRTDAYHAAIMRHQKFIEGKVVLDVGCGTGILSVFCARAGAKRVYAVEACEIVVQAREIVKANNLTDQIVVIHGRVEDVDLEEKVDVIISEWMGYMLLYESMLPSVLFARDKWLKPGGLILPSHATLFMAPVTNRERYEDSVDFWRDVYGINMSALVPLAKKFTSEEPSIETIGGENVISWPSVFKRFDCYNFTAEEFKSITSKYKVSSMMLAPIHGFGFWFEVEFNEPIESSHNFPSSLDPLEIIQKKRRRSSEDIVLSTAPEDEPTHWQQTILYFPDPIEVKQDQIIEGSVTVSQSEENPRFLNIHLECFTGGQTLVKDCAMR

SEQ ID NO: 541 - protein, 262 aa, Zea mays
MAMAAVGVGGAVAFLLPQRRQGAVPWSGGRRRAPVAVRASYEAGVGVMATKVGMMTYFDPETGKPVPVTVVGFREGGNVVTQVKTAATDGYDAVQVGYHGVREDKLTRPELGHLGKAGAPPLRHLQEFRLTAVDAFEPGQPLDFADLFKEGDLIDVSGNSIGKGFQGGIKRHNFKRGLMTHGSKSHRQLGSIGAGTTPGRVYKGKKMPGRMGGTKTKIRKLKIVKIDNNLRVLMIKGAVPGKPGNLLRITPAKIVGKNIPKN

SEQ ID NO: 542 - protein, 290 aa, Zea mays
MSEHPASRSSVGSRSSALPPHQQRLTPAPDPLASVWIRRLHLSPNPPPPPRPPPLHIRAPPPAHQDAISTDESHTTPPPPPLTLRGTGFGPFRWSPRPLLGAPAGAWDAAAAASVGVAPGGSAVGGDQTMLSPFFRLPAPLPSVVDFEEAMPLRPLIGLGSHSGSGGFPGLSRQMVGGGDPCDGWLSSRVAGAAYPGHALDMVPTRTLNDLRDRQHGAIPAQPNLARHDPSSSSQRDEPFSYWNMGRFRRNTATSSVTPLGAAPANFGTKRNADSNDFLPLKLRKLSGAI

SEQ ID NO: 543 - protein, 95 aa, Zea mays
MASSNGQTEAPAPSVPKNPAMASCRKKKTDDATFLEDLKDHMDEFIHASMDEHKTCFKKTIQKMFGMSKAVAERSAEANKAEVESALPLQTSVSQ

SEQ ID NO: 544 - protein, 165 aa, Zea mays
METAAVAAAGAGRRIMVAVDEGEESLHALNWCLANVVSPAGGDTLVLVHARRPRPVYAAMDSAGYMMTSDVLASVERHANAVSAAAVDKAKRVCADHPHVKVETMVESGDPRDVICDAANKMAADLLVMGSHGYGFIQRAFLGSVSNHCAQNCKCPVLIVKRPKE

SEQ ID NO: 545 - protein, 316 aa, Zea mays
MSMGHCSEQRTGFEVTKDWNGADQFAIRSPRGASVRVCLHGGQVVSWRNHRGEELLFSSSKAIFKPPRATRGGIPICFPQFGNCGTLEQHGFARNKIWTIDDEAPPLNYGDNNSNKASVDLLLKPSEDDLKCWPHCFELRLRVSLSMDGDLSLISRVRNVNGKPFSFAFAYHTYLSVSDISEVRIEGLETLDYLDNLSQRERFTEQGDAITFESEVDRVYVGCPGVIAVLDHGKKRTFIVRKEGLPDIVVWNPWEKKSKTMADFGDDEYKQMLCVDAAAVERAITLKPGEEWTGKLELSAVASTNCSDHLDRPGRL

SEQ ID NO: 546 - protein, 354 aa, Zea mays
MAAESENGNCKAWAARDPSGVLSPHSFNRRAVQSGDVSLKIIYCGVCYADVAWTRNKLNDSKYPLVPGHEIAGVVTQVGADVKGFKVGDHVGVGTYVNSCRDCENCNISLDNHCPKAVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFSTSESKRDEAINLLGADNFVISSDTQQMESLKNSLHFIIDTASGDHPFDPYFSLLKVGGVMTLVGFPSEIKMHPASLILGARTLSGSVVGGIKDIQEMVNFCAANNIYPEIEIIKIDYINEALARLVNRDVKYRFVIDIENSFK

SEQ ID NO: 547 - protein, 580 aa, Zea mays
MGKSPAKWIKSVLFGKKSSSRSGSTKAKDLSKGTTNKAAAAAAAGKEPAFSESSPVISEPVLVSAHNNETAREAAKGENSSVQEVPVTDVSQDLEKQGTVGSDTSNDAERLREEQAAVKAQAAFRGYLARRAFRALKGIIRLQALIRGHLVRRQAVSTLRATWLIVKFQALVRGRNVRLSKVSIQATMELSQQNFGGSKPGSWKEKLSSNAFARKLLSSPIVVEALHVQYDEMDPNSAFNWLERWTVSHVWKPISQPKRVGADAKPHTRKASYAMETESAKLKRNARKSPAVPFEPSQTNTTIENEKTRRNPRKLSSTPAESVPDGQLTELEKVKRSLRKVTSSMVETSKVPSPTTEIPDRQEVQCERPLRSAKQAPIHVENQEPQNVNLSDNAKMDILVPDIQPDVEVASDLVTITNEEKVDETPSVVAPAAEIMPLQDINSEENALVNDVEERSKEEHPSTDNLKGSKRRSSFSAKPEYPENGSKNSPALPSYMAATQSAKAKLRGNSSPRLSSDSAEKNGFTRRHSLPSPNNGKIISHSPRTQRPTHAGGKDGAKGDKAMLSSRDASERPLKAEWRR

SEQ ID NO: 548 - protein, 665 aa, Zea mays
MAAEEGAMSPTRMLAEGHLRVATGGGAPADGGIAVRHLPHHHPTKKDNVGGKTEKDNHEGVNSLLSEELEKLANGNSKIPGTLDEYRKLVVPIIEEYFSTGDVELAASELKCLGSDQFHHYFVKKLISMAMDRHDKEKEMASILLSSLYADLLSSYRISEGFMMLLESTEDLTVDIPDATDVLAVFIARAIVDEILPPVFLTRARALLPEFSKGIQVLQVVEKSYLSAPHHAELVERKWGGSTHSTVEEAKSKIKNILREYIENEDIDEAFRCIRELSLPFFHHEVVKRALTFGIENISSQPSILKLLKEAAASCLISPNQISKGFSRLAEGVDDLSLDIPSAKALFDKLVSTAISEGWLDASFGKSAAPDEEIQSTSVVKVKRFKEECGHIIHEYFLSDDVPELIRSLEELSAPEFNPIFLKKLVTLAMDRKSREKEMASVLLSSLRLELFSTDDIIEGFVMLLQSAEDTALDIVDAPSELALFLARAVIDEVLIPLNLDEISIKLRPNSSGSQTVQMARALLSARHSGERILRCWGGGTGWAVEDTKDKITKLLEEYNTGGDLGEACRCIRDLGMPFFNHEVVKKALVMAMEKQNGTSILVLLQECFGEGLITINQMTKGFARVKEGLDDLILDIPNAQEKFGEYVELATERGWLLPTFASVP

SEQ ID NO: 549 - protein, 268 aa, Zea mays
MRRAAAILLSLALAAAATTTAAAAVAKAPVPPPPPPPPPNVTAEMAKGGCKAFAGLIAASPDASSTYQSAVEGGMTVFCPSDDAVRAFLPKYRNLSADGKAELLLFHAVPVHYSLGSLKSNNGPMNTLATDGAARNFNFTVQNRGDVVTIATAASAPARVKSTALDEDPLAIYVISAVVEPVELFKPAPAPVPAPAPAPASVADAPRPGKAAAGRRHPPPAAADAPGPAAEDNAAPVDQKDAKKSAAAGAPCALWWLAAALAAASALA

SEQ ID NO: 550 - protein, 92 aa, Zea mays
MTMTSRFVAAASSSSSSCPLARLISRRGLAGAADGHGPAKVPLWKDPLSPSKWKEEHFVLASLSMWGALFYGGFKFFGGKKEDKIEAASGQT

SEQ ID NO: 551 - protein, 218 aa, Zea mays
MVLWVFGYGSLIWNPGFDFDDKILGFIKGYKRTFNLACIDHRGTPEHPARTCTLETDDEAICWGIAYCVKGGPEKELKAMQYLERRECEYDQKISIDFYKEGDPLKPAVTGVLVFVSTPDPIGNKYYLGPAPLQDMARQIATANGPTGYNRDYLFSMEKALASISHEDDSIIELANEVRKVLNRTKETKITGANASLKSHAPLVHLSALPEGTVVDSR

SEQ ID NO: 552 - protein, 342 aa, Zea mays
MLVRSASTPVLGALHPSGCHSPAVSSPAVHFAESPASAAYHAPPISCHLGGPGSGSDHERSRSRGAGAGMRRTCSEDNLASLAGGRADDHDHHHLLLPPSGKGAPRARPVPLETIQSFRGPHASTDDEEEEDDDDEDAYEVERELRFGQFSFAGGAYSQEHPLFLARGLGIDRLGSGLLSADGGGGFGGSDGSGSGGGGGNLVTSGNGGDRSGIETHYKKMIEEDPCNGLFLRNYAQFLYQVKGDYRRADEYYSRAILADPDDGELLSEYAKLVWEVHRDEDRASSYFERAAKASPQNSHVLAAHAAFLWDTDDEEGGADALSYAAFAQPAHSSLASATATT

SEQ ID NO: 553 - protein, 267 aa, Zea mays
MAAARMALVSCARRLPSLPSPLTLSRPRAGAVSFLAAQPSPATAPRSGRNLALFCSLSPTSPSLTEAAVALPPPKAAVEETKPPVPSGDEKGEPTVEELAGLLDVRVGRVVKAWRHPEADTLYVEEVDVGEAEPRTICSGLVNFLPIEELQDRNVIVLANLKPRNMRGIKSNGMLMAASDASHENVELLIPSEGSFPGERVWFGSEEEKNRQSDPASPNQVQKKKIWEAVQPHLRTTDNCIAVLGDKQMRTSAGLVFCKSLQGARVS

SEQ ID NO: 554 - protein, 99 aa, Unknown
  Sequence found in Organisms: Zea mays, Saccharum officinarum
MASGGPALEPLVDQVISVITNDGRNIVGTLRGFDQATNIILDESHERVYSRKEGVQQLVLGLYIIRGDNISVVGEVDEELDSRLDMSKLRAHPLKPVIH

SEQ ID NO: 555 - protein, 637 aa, Zea mays
MACLAISLQPVNGPDILLQTRSWFPVSRALAAVSAFRLARLHLARGKQQSSSSSASSASLDAIGDDPLAAASGQLVVGVESQYRVVYRLVNSIYVLGVTTAGSDHAAPAVNAFAVADAVNQSVSVVVAACRGVDVTPEKVHRKYPEVYLALDLVLHGVGSVRLSQILATIHGDNLARMVNSSPDAEARARGADPWPVVEHLAQDRHAAREGFSGASFELPQETLAAGDEFSSNIAPATTVATGDEPPPEEAAPVEKDPFAASDLINNKPEEALVGGFKKNKETALVVADPAAALAGLEVTTLPPAEATKPTFIGVEGFEGDYGGIEFGNDETSLAEAFEGLNAPFGGGLDASEFVTTTKKDHKDRTVTGLELLVASGQPPNAAAGTPLENLLLTKRAEMTAPELFIAEEINAEFKESILVRVGLKGTIFLRTLPLNKAAGKETEFSFRLEGTSGMKRAALQSNVLSNLQNGLFHVRTVSKEEPIPLMKYSFLPKHSPLPLRMRLVKRHSGTLLSVMIQYASNPMLPQPLSNVTFVVKLPVDPTLLNVSPKAVLNRAEKELRWHISDIPLKGPAGRLRARMPVDQDSKDGELEVVGMVKFAYQGPFTLSGIKLCPATDGIAQFNEVGHTFSSGSYLCI

SEQ ID NO: 556 - protein, 494 aa, Zea mays
MVGSVGNGLADLGARAVSMNGAGKALRPAEAAAAAAAAETLPMELDPSEALVAAAVEAKGEKAANGRREIVMGRNVHTSCFAVKEPDADDEETGEREATMASVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKGRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVEKRATWYQDGISQPPCIARDVGVESCLCGLHK

SEQ ID NO: 557 - protein, 159 aa, Zea mays
MAAVVRGVLRGIKEKGLTNFIRDVRDEGYFKCLLDGNLLQTKIHNIGATLVGVDKFGNKYYEKLHDTQYGRHRWVEYAEKGRYNASQVPAEWHGWLHHITDSTGDKLLNQKTARYLVEHKQNYSGEGEELIYHSKGHALNPGQRDWTRYQPWEPKKEQA

SEQ ID NO: 558 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAVAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 559 - protein, 1085 aa, Zea mays
MAEIAERAVAGEVPEEPRPPHGEEDDEGEEEGDVCRICRNHGDEDHPLRYPCACSGSIKFVHQDCLLQWLDHSNSRQCEVCKHAFSFSPVYADNAPTRLPFQELMVGVGMKACHVFQFILRLAFVLSVWLMIIPFITYWIWRLTFVRSLSEAQRLFLSHISAQLILSDCLHGFLLSAIIVLIFLGATSLRDYIRHLRELGGHDAERDDGGRERHGARAVRRLAGPNNRVPADGNVDELAEAQGIGAGELLRRNAENVAARLERLEAQVEQMLDGLDDADGAEDVPFDELVGMQGPVFHLVENAITVLASNAIFLIVVIFVPFSLGRIILYYLSWFFSSASTPMLAKVMPFTETAISIANDTLKSALNVVKNFSSDSNNEGVIGHVIEVVTQSLKINATGLSVIQGTGKNSLMKGTTIASSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKVAMRVAPSMFPLDITIFDPFTEIPVDVLLFQICIPFAIEHFKPRATIKALLHHWFSVVGWGLGLTDFLLPKSEENGGQENLNARAERRDRGHGGREMVAPQVEQLMIQHVAAEDNGRGDSNEANDVTEDSDVDDQGDSEYGFVLRIVLLLVLAWMTLLIFNAGMIVFPISLGRLVFEAVPRLPITHGIKCNDLFSFSIGCYILWSVAAGTRYAIDYITSRQLGFLVQQICKWCSIVLKSSVLLSIWIFVIPVLIGLLFELLVIVPMRVPIDESPVFLLYQDWALGLIFLKIWTRLVMLDQMAPLVDESWRSKFERVRDDGFSRLKGLWVLHEIIMPIVTKLLTALCVPYVLARGIFPLLGYPLIVNSAVYRFAWLGSLIFSALFFWGKRFHVWFTNLHNSIRDDRYLIGRRLHNFGEDSHSPERSESGATIGSDDQDRDIVLRDQEEEVGLRMRRNNMHANQQPRLAL

SEQ ID NO: 560 - protein, 83 aa, Zea mays
MSSKKATNRGLVLVLLLVVLPALSVATHAGERELPDEKDHKGHSTVASGKGGTASGDMVKTNDYGRYDPTPAFSKPRSKLIPN

SEQ ID NO: 561 - protein, 316 aa, Zea mays
MSFLFKSSNGGTTEKIPSPEEQREKINELRKELGEHSSAAIKDFLSDASLARFLRARNWNVQKASKMMKAAVKWRLAFKPENICWDDIAEEAETGKIYRADYKDKHGRTVLVLRPGLENTTSAIGQIKYLVYSLEKAIMNLTEDQEKMVWLTDFQCWTLGSTPLKVTRETVNVLQDCYPERLGLAILYNPPRIFESFWKIVKPFLDHETRKKVKFVYSNDKESQKIMAEVFDMEELDSAFGGKNPATFEYNSYAEQMQDDDKKMGSSHGSANSLLGSAGKEANGADSDASSEASFYSGTDSPTHENGEHSIAKKNG

SEQ ID NO: 562 - protein, 245 aa, Zea mays
MVSIVTEVWALAGCGPASKAAAVAVAAQELPAQHPSPAAAGGGKAKKRAVPVSFRGVSSGGGQDHQREAAAVVVGRRRGLASCALAAVAASFSARADRPARALVLEEDDDIELLERVKEDRKKRLQKQGIISSSGAETGYLQDLIYRLSKVGQAIDNDDLPAASSVLGPSSDAQWVQNINAAFSKLSSSPEQRNVVDSFNSSLATLFTSVSKLDPESSKSAFVSSATALEKWIALAGLGGQLKGY

SEQ ID NO: 563 - protein, 278 aa, Zea mays
MSSMELLHAVVPEKQSEEEVAPAATTTSSSATATGGDEGAHVPQGWAKRKRSRRQRSEEENLALCLLMLSRGGHHRVQAPPTPVPSAAPAAAEFRCSVCGKSFSSYQALGGHKTSHRVKLPTPPPPPTAAAVTVSAAVPVPEAPAPITVVVPPLPPVEVGREPATSSTAASSDGAASSRVHRCSVCHKEFPTGQALGGHKRKHYDGGVGSAAASTDVPAAPAETSAEVGSSAARAFDLNLPAVPEFVFRCGKPGKMWEEDEEVQSPLAFKKPRLLMTA

SEQ ID NO: 564 - protein, 558 aa, Zea mays
MALHAPVLVLKDSLKRESGAKVHQANIQAAKAVADIIRTTLGPRSMLKMLLDASGGIVVTNDGNAILREIDIAHPAAKSMIELSRTQDEEVGDGTTSVIVLAGEMLHVAQAFIDKNYHPTVICRAYTKALDDAIAVLDKIAMAVDVNDRGAMLGLVKSSIGTKFTGQFGDLIADLAIDATTTAGVDLGQGMREVDIKKYIKVEKVPGGQLEDSRVLKGVMINKDVVAPGKMRRKIVNPRIILLDCPVEYKKGENQTNAELMKEEDWQVLLEMEEEYIKNLCGQILKFKPDLVITEKGLSDLAIHYLSKAGVSAIRRLRKTDNNRIAKACGAVIVNRPEELQESDVGTRAGLFEVKKIGDEFFSFIVDCKDPKACTVLLRGASKDVLNEVERNLQDAMSVARNILKNPKLLPGGGATELTVSATLKQKSSSVEGVEKWPYEAAALAFEAIPRTLAQNCGLNVIRIMTQLQGKHANGENAWVGIDGRTGDIVDMKERKIWDSYSVKAQTFKTAIEAACMLLRIDDIVSGIKKKQAPGASAPKQPQIETEGDADNEQMIPE

SEQ ID NO: 565 - protein, 374 aa, Zea mays
MPPPSANGATAAAAAARDDMSPAEARLAMMELANMVSVPMALAAVIRLGVPAAVWAGGANAPMSAADLLPPGHPDPSVLERLLRLLASRGVFSESTESTPTTRRRLFALTAVGRTLVPGPASGASYADYVLQHHQDALVAAWPRLHEAVLDPAGPEPFARANAGVTAYAYYGKDQDANRVMLRAMAGVSEPFMGALLDGYGAAGGFRGVATLVDVGGSSGACLEMIMRRVPTITEGINFDLPDVVAAAPPIAGVRHVGGDMFKSIPSGDAIFMKWVLTTWTDDECTAILRNCHAALPDGGKLVACEPVVPEETDSSTRTRALLENDIFVMTTYRTQGRERSEEEFRHLGVDAAGFTAFRAIYLDPFYAVLEYTK

SEQ ID NO: 566 - protein, 527 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTSENTKAVIDHGAVPIFVKLLGSGSDDVREQAVWALGNVAGDSPKCRDLVLANGALMPLLAQLNEHVKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPRLLNLLTQNHKKSIKKEACWTISNITAGNKDQIQAVISAGIIAPLLQLLQTAEFDIKKEAAWAISNATSGGSHEQIKYLVSEGCIKPLCDLLVCPDPRIVTVCLEGLENILKVGQHDKTMGATGDTNVLAQMIDEAEGLEKIENLQSHDNNEIYEKAVKLLETYWMEEEDDAMATAGEAAPAVFDFNQGGNPPAAGGLNFN

SEQ ID NO: 567 - protein, 320 aa, Zea mays
MALRALDNTKPAAVEERPKKVAKVGVPAAAAKAAASPGSGGKKKKGNDENSAPRATAAAAEQAVEYISSEELEAAASPKAKAAGLVADLDSKDWVRTCEALNDARRLAIHHPALLNPILEKVVLAVVKTMKSPRSAVLKTSIMACADIFSSFGNLLASVSDDAFDKLLLQLLLKASQDKRFVCEEAEKATRAMAASMPPLPLLKKLKAYVHHANLRVRAKAAVAISHCAARMDIGAMKEFGMSALLQLAVELLNDRLPEAREAARGVVASTHAAFVKEAAASGQEDDAAASWESLCALSLPPISAQAVAKIAAAAAASSQ

SEQ ID NO: 568 - protein, 560 aa, Zea mays
MKMHRFALRGLGFLVLWMLHCGSELAAAVPPDGWYDYSAYTDCRGQPEPALYNGGILKFGSSGGDPDGYRTTETGVFSPAFVVYNLNKTTMYTFSCWVKLEGAYSALITARLAPDNTGARCIATVVARSDCWAFVKGGFVLDWPTQTSVIFFQNADKTPMKITVASGSLQPFTTDQWAMHQQDTIRKRRKRVATIHVADPQGARVVGASVSVQQTAKDFPIGSAIASTILGNQAYQQWFVDRFNAAVFEDELKWYSTEPMSGQLRFDVPDQMLAFVRSHRVMVRGHNIFWENQDATPRWVKNLTADDLRAAVNTRIQSLMTRYRGEFAHWDVNNEMLHYNFYEQRLGPNASAEFFSVAQDADPLATLFMNEYNVIETCDDPFSTVDTYVSKLKDLRSAGAILEGIGLEGHFSKPNIPLMRAILDKLATLGLPIWFTEIDISNKFDAQTQAAYLEQVLREAYSHPAVSGVMLWTALHPSGCYQMCLTDWNLSNLPTGDVVDRLLNEWRTLQAAGQTDAHGAYSFTGYLGEYVLTVSYNNRTTQSTFSLSPGDETRHINVQM

SEQ ID NO: 569 - protein, 558 aa, Zea mays
MNGAEEEEPPHVSSMPKTQDGVTKPSLGKEPIPGSELWTDGLICAFELVKSHRKPVQHKSWLATEQIQEKGPTMCTRKHSRRNGHQITEPKVDESIVLENPQQTDFSNDPSVLKDRPLYAGEILDHKWVPIGWNRIAELVLRVQSDSSWENELMEMSDSEDDYTVADLAAPYWQRPVGPTWWCHVTAGHPSIDAWLNSAHWMHPAIRIALRDESKLISDRMKYLLYEVPVRVAGGLLFELLGQSIGDPNHEEEDIPIVLRSWQAQNFLVTTMHVKGPSSNINVLGVTEVQELLLAGGSQTPRSVHEVIAHLVSRLSRWDDRLFRKYVFGEADEIELKFVNRRNHEDLNLVSIILNQEIRRLATQVIRVKWSLHAREEILIELLRHLRGNATRAILESIRKCTRDMLEEQEAVRGRLFTIQDVMQSTVRAWLQDRSLRVTHNLAIFGGGGMVLSIITGLFGINVDGIPGAQNTPYAFGLFAGLLFFVGIVLIGMGMLYLGLQNPVNSEKVKVRKLELQHLVSMFQHEAEQHGKVREGVSRHGASPSSSTASDEGYILIS

SEQ ID NO: 570 - protein, 188 aa, Zea mays
MAAQREKSAAVAVAPAHGAAVSGSPSPSSSSGGPAVSASSSGDRWCAAIGNLGELGANVDALQKLLGRKAVFVDDDIFSKASLAADQARTIKVLDQRVQSLERELDAAISAAARARVEKRQAEAAQRAAELRTREVTEELENTARVFELHMEELRLKQEDIAKKDSDIKVLEAIIRTLSSKDDDGSSE

SEQ ID NO: 571 - protein, 249 aa, Zea mays
MSSIGTGYDLSVTTFSPDGRVFQVEYATKAVDNSGTVVGIKCKDGIVLGVEKLVTSKMMLEGSNRRIHSVHRHSGLAVAGLAADGRQIVSRTKSEAASYEKVYGEPIPVKELADRVASYVHLCTLYWWLRPFGCGVILGGYDRDGPQLYMIEPSGVSYKYFGAALGKGRQAAKTEIEKLKLSELTCREGIVEVAKIIYGVHDEAKDKAFELELSWICDESNHQHQKVPNELLEHAKAAAQAALEEMDAD

SEQ ID NO: 572 - protein, 361 aa, Zea mays
MAAATSSRRPAAALLVLAAAVVALAAEGARYPPLAPGLSFDFYKKSCPKAESIVREFLASAVRQNVGLAAALIRLHFHDCFVQGCDASILLDATPTQPSEQQSPPNLTLRPAAFKAVNDIRARLDQACGRVVSCADIVALAARESVALGGGPAYKLPLGRRDGLAPASNAAVLAALPPPTSKVPTLLSFLAKINLDVTDLVALSGGHTVGIAHCSSFDNRLFPTQDPTLNKFFAGQLYRTCPTNATVNTTANDVRTPNAFDNKYYVDLLNREGLFTSDQDLLTNATTRPIVTRFAVDQDAFFHQFVYSYVKMGQVNVLTGSQGQVRANCSARNGAAAGDSDLPWSSVVIETVADAAGSLVL

SEQ ID NO: 573 - protein, 87 aa, Zea mays
MAMRTALTSLPARLRAPAPPAATGGRRLLSDGKGRVLSEEERAKESVYIQKMERERQEKLKKRLEQEKADSDKAKPADADKKAEGST

SEQ ID NO: 574 - protein, 381 aa, Zea mays
MRRVALLLVAAVCALAAPAAAVVTDGLLPNGNFEDGPPKSALVNGTVVSGAHAIPRWETSGFVEYIESGHKQGDMLLVVPQGAHAVRLGNEASIRQRLAVARGAYYAITFSAARTCAQAERQRLNVSVSPEWGVLPMQTIYGSNGWDSYAWAFKAKMDAVTLVIHNPGVEEDPACGPLIDGVAIRALYPPALARRAGGNNLLKNGGFEEGPYFLPGASWGVLVPPNIEDDHSPLPAWMIVSSKAVKYVDAAHFAVPQGARAVELVGGRESALVQEVRTVPGWTYRLAFAVGDSGDGCAGSMAAEAYAARATVKVPYQSRGTGGYKRAVLDFTAIANRTRVVFQSTFYHMKPDGTLCGPLVDDASLVGLRKKKPARRLMQLL

SEQ ID NO: 575 - protein, 386 aa, Zea mays
MSAAPPRRVVICGGGVVGACTAYFLATHAASPTVPTLVERCAPACAASGKAGGFLALDWCDSTPALSRLARASFALHRRLADALGGADAYGFRPVHTLSVLLPPHPAASSSPPHPLLPPWVDPSASAAPPRELGTPDTTAQVHPGLFTKAVLAASGAEVVIGEVERVAVAWDGRVAGVVVKGRDGVLDADAVVLALGPWSGRLEVVSEVFDVSGLKAHSIVLRPREPEKVTPHCLFLSYQPEPGAKMLDPEVYPRPTGEVYICGMSKDENPPDDPATITGEPDSIAMLHKIAGKVSSQLKKEEGAEVVAEQACYLPCTADGLPVIGEIPGVKGCYVATGHSCWGILNGPATGAALAELILDGKAKIVDLEPFSPARFLKRRSRRGV

SEQ ID NO: 576 - protein, 500 aa, Zea mays
MWERGRPPRKPRPSPILVPPPPSSPPPRLNLLLPRSLLALAARAMPSRRPSPVLLLLLALSLALLFLLLSPSFPSTSRFSRSLSSGSAFASSSPASTSAPPAPVKIYLYDLPAKFTYGVVRSYKAARATSGSADAAATLPDEQLRYPGHQHSAEWWLFKDLLRRRPQDRPVARVDDPSDADLFYVPFFSSLSLVVNPIRSPLAANASGAGTAYSDEALQEELLEWLERQLYWQRHRGRDHVFICQDPNALYRVVDRISNAVLLVSDFGRLRSDQASLVKDVILPYSHRINSFKGEVGVDGRPSLLFFMGNRYRKEGGKVRDALFQILENEDDVTIKHGTQSRESRREATQGMHSSKFCLHPAGDTPSACRLFDALVSLCVPVIASDYIELPFEDIIDYNKISIFVGTSKAVQPGYLTSTLRRISSERILEYQREIKKVRHYFEYEDPNGPVNEIWRQVSLKAPLIKLLTNRDKRLLERGTNGTDCSCICSTTPTDITAAS

SEQ ID NO: 577 - protein, 394 aa, Zea mays
MAGGMQAADAAGRLSALLSLLALRRLLAVLQPLALLLLLPFRWRARPAGAVAAAVASDAATASAPGASGRKGKASSSSSVVLRVPAGSPMVAARRQASARREIAVRRAREAGREYELVPTARGETLFTQCWWPHPPSTVKPRALVVVMHGLNEHSGRYDHLARRLNGIGIKVYGMDWTGHGGSDGLHGYVQSLDHAVSDLKMYLKKVLAENPGLPCFCFGHSTGGGIILKAALDPEVETLLRGIVLTSPAVRVQPTHPIIAVMAPIFALIAPRYQFTASHRNGPPVSRDPEALRAKYTDPLVFTGAIRVRTGYEILRLTSYLQQHLHRIAVPLLVLHGADDLVTDPRGSRALYERASSADKSLKLYDGLLHDLLIEPEKDRVMDDIVAWLSPRV

SEQ ID NO: 578 - protein, 518 aa, Zea mays
MDAVATSDAVLLLAAVAISLLITATFWSRHRRQGEAPSPPSLPLLGHLHLLGNGKPLHHSLAALAIARGTGGAPAPLLSLRLGARRALLVSEHAAAEECFTAHDAALGGRPRLLVGDRLNYGYTTVGWSSHGDHWRALRRFMAVELFAASRLAARAADRRAEVAALVGALVRDAPRAGAAVALRPRLFELVLNVMLRALTGAPGHGGGDVRGLQEIIEETFAVTGVMSVGDFYPALRWVDRLRGVDAALLRLQARRDAFVAGLVHDGRRSHNRKAGGGGGPTDTEKRSTIDELLSLQETDPGYYTDTVIKGIVSILLSAGTDTTALTMEWAMAQLLMHRDAMQKARAEIDANVGTSRLVDESDTTHLPYLQCVVKETLRLCPVGPVIPAHEAMEDCAVGGFRVRRGTMVLVNAWLIHRDPRLWEAPEEFRPERFLDATATVAAPLLPFGLGRRRCPGEGMALRLLSLTLAALLQCFDWEVGGCVDMAEGVGLSMPMAKPLAAVCRPREFVQTVLSAST

SEQ ID NO: 579 - protein, 263 aa, Zea mays
MASLLLVPRLTRSPCSNPGPSAGHKPRPVSITCGPRDNRGPLQRGRSLSTEAILAIQSLKRLTSADRSPAAASAAAATALGRLLKADLVAAMAELQRQGHWSLALAALHIARAEPWYRPDPALYATFVSSAPHSPSGGEGDAEAAVDALVEAFLEEKASGGGFVDGEEDVYKLTRLLRALVAKGRGRAAWRVYEAAVRKGGLNVDAYVYRVMARGMKRLGFQEEAAEVEEDFAEWETTVSPPARDVLDEMRARDEIKTTAAAS

SEQ ID NO: 580 - protein, 187 aa, Zea mays
MACINMYNPDGAAGFGGGPQQPAALGPRISFSSDFAVEPTPVQNRATSLRCQEEDLNFEFSVGSHPMMAADQLFSKGRILPLKDNGGGSVCFAAARPPTTLRDELRGGGDDDDERAAFSAAGTKGSNSNRWKEMLGLRKALCVGVGGGGNGSPAKKASSSDKQGVVAAAAPGPDDHMAASNQQEQLS

SEQ ID NO: 581 - protein, 416 aa, Zea mays
MARARGGAAWWVLAAAWVLWAAAAAAEAEARSPSARRVHRHLKRLNKPAVKSIESPDGDIIDCVHISHQPAFDHPLLKNHTIQFRPAYHPEGLYDDTKSSIGSNNAGERPMLQMWHRNGRCPEGTVPIRRTKKDDLLRASSVRRYGRKRHTAPNPLSVDPNMLSEGGHQHAIAYVQGDKYYGAKATINVWEPKIQQANEFSLSQLWILGGSFGEDLNSIEAGWQVSPDLYGDNNTRLFTYWTSDAYQATGCYNMLCSGFIQINSEVAMGASIFPISNYAGSQYDISILIWKDPKEGNWWMQFGKEYVLGYWPSFLFSYLADSASMIEWGGEVVNSEPDGTHTSTQMGSGHFPEEGFSKASYFKNVQVVDSSNQLSAPKGVGTFTEQSNCYDVQNGNNGDWGTYFYYGGPGKNSNCP

SEQ ID NO: 582 - protein, 95 aa, Zea mays
MGVTKEDVEAAITSALSPSNLVVTDTSGGCGASYEIEVVSEKFEGKRLLERHRMVNTALASHMAEIHAVSIKKALTPAQAQPQAQPEPAADKPQA

SEQ ID NO: 583 - protein, 339 aa, Zea mays
MGKLLPRHPSPLLLLAAAICISSSSLAAVRGAPVYRADYLVDGNQLVDMQYHMGPVVSGTPTNLYLIWYGRWEAAAQAVLRDFLASLSAPAPFPAVSDWWARTPRMYADQTGANVTGAFAVAGEHSDAGYSHGASLRRIDVQSVIRSAVYAYPDPLPLDPYSGAYLVLTSPDVQVDEFCRAVCGFHYFTFASVVGVTVPYAWVGNSATQCPGKCAYPFAAAAEYGAGGAQPQAVLRPPNGDAGVDGMVIVLGHELAEMSTNPLVNAWYAGDTPTAPTEIADLCLGVYGDGGGAGGLVGNVSRAPDGSAYNVNGVNGRRFLVQWLWNPVRGACYGPNSSN

SEQ ID NO: 584 - protein, 422 aa, Zea mays
MPRLTPAHATLILDHVLGDPSIPTAVTIALIAGIPSPSDPTPRLRRGVLLRRLATDPVSESSLETLHLLASLPACASPIAAAHIAVAAFLAASAPDFDAVARALFARPDGRARQAVHGGSSPALASDDAIATVDQFEAAVGMSSSQTILRVLWGNRAAVEERVQELLAAEWAAIGPSRLEALAMRIVGDGAVDTWGAADEAMRANLRILAGEAKTREILDKLEKTTCNTNPISTPAVEKVMDALKASCADLHSIVEDPLPAAKAVADELLTARMEKLVSLNAQEVGGQPTTCGVAGPSIHNDKDNGPGIGKPHSLMERNATARTSQWEESLGLDGSEPPSPPRPHLPSPRRLPPSPLSPPGNKNNNRRKARRWSLFEEETLRKGVEEYGVGNWRDILDNNAEAFTGRTPVDLKDKWRNMLFR

SEQ ID NO: 585 - protein, 521 aa, Zea mays
MIWHVQNENFILDSTRIFMKAFHLLLFHGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVAPECFSLCSYLLSGYTKRDLRSNEATMKYLLMGGASSSILVHGFSWLYGSSGGEIELQEIVNGLINTQMYNSLGISIALIFITVGLGFKLSPAPFHQWTPDVYEGKEARNPLFDSDSPTPVVAFLSVTSKVAASALATRILDIPFYFSSNEWHLLLEILAILSMILGNLLAITQTSMKRMLAYSSIGQIGYVIIGIIVGDSNDGYASMITYMLFYISMNLGTFACIVLFGLRTRTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTIPGISMNPILAIAQDTLF

SEQ ID NO: 586 - protein, 311 aa, Zea mays
MAQDDPVVSAQWLHEHLGMPDVKVLDASWYMPVENRDPWKEYQVAHIPGALFFDLDGIVDRTTDLPHMLPSEEAFAAAISELDIKNQDKVIVYDGKGFFSAPRVWWMFRVFGHKKVWVLDGGLPQWQASGFNVEKASPDDDAVLKSIAANRAVKRVYNGEQTNTISFQTEFQPNLFWALEKVAQNVTAKTYQQIDARAKGRFDGVAPEPREGVRSGHIPGSVCVPFPEMFDGAPPSLLLPADELRRKFQHAGISLDRPIVVTCGSGVTACILALGLYRIGKRDVPVYDGSWTEWEGQSDSDYPKVTAPGTA

SEQ ID NO: 587 - protein, 374 aa, Zea mays
MASEEVATTVCADADQEAAAAAAAAMKEEGGRGKRRRRRQPRKGEEEGGRKKYALVSYHELPEYMKENEFILNYYRSEWPVLNAVLSLFSWHNETINVWTHLLGFMLFFGLTLVHLGQYFPQVADLIGHLSWPISKVAENVSSNIGDVLSGAAMFIQTNPSLASHGTAVASQTTRWPFFVFLAGAMFCLLSSSACHLLSCHSHRLNLLLIRLDYTGIAVMIVVSFFPPIYYIFQCEPRWRAAYLSAITAAGAGTVYALMSPRLSAPRYRARRALLFVGMGLSGVVPAAHAAAANWHEPRRNVTLAYEGAMAASYLVGTAFYLARVPERWRPGAFDLAGHSHQIFHALVIAGALAHYGAAIVFLRARDEMGCPAS

SEQ ID NO: 588 - protein, 141 aa, Zea mays
MATLSAISANVGYCKAPTLSWKGSGVPGRIVVSMSTTRRGLVSLRRRSPRFRVYAAKAETVSKVMDIVKQQLALAADVGLTAETKFTDLGADSLDTVEIVMTLEEEFKITVEEDNAQSIATIQDAADLIDKLVDQKPRDSD

SEQ ID NO: 589 - protein, 551 aa, Zea mays
MESLRLAVTHRPALPLPTSHSHLRRRHLHLHLHSYPNPLSLSPPIASHLSPIPRRHLPPLLASASASQASSKPAASAASGGAKPLPLFLSLAAGLAVRFLVPRPAEVTPEAWQLLSIFLSTIAGLVLGPLPVGAWAFLGLTATVATRTLPFTAAFGAFTNEVIWLIVISFFFARGFVKTGLGDRVATYFVKWLGRSTLGLSYGLAISEALISPAMPSTTARAGGVFLPIVKSLSLSSGSKPNDPSAKKLGSYLVQSQLQAAANSSALFLTAAAQNLLCLKLAEEIGVSIGNPWITWFKVSSVPAVLGLLVTPYLIYKIFPPEIKDTPEAPALAAEKLKNMGPVTKNEWVMIGTMLLAVSLWIFGETIGVSSVVAAMIGLSILLVLGVLNWEDCLNEKSAWDTLAWFAILVGLAGQLTNLGIVSWMSNCVAKVLQSFSLSWPAAFVVLQASYFFIHYIFASQTAHVGALYSAFLAMHLAAGVPALMSALALAYNANLFGALTHYSSGQSAVYFGAGYVDLPDVFKLGFITAAINAVIWGVAGALWWKFLGLY

SEQ ID NO: 590 - protein, 252 aa, Zea mays
MRGTAPELQLHIASSRAAPRSPRPASSLAAGAAMDRKSKSAKGAASSAAASMAALAAAAVAGDSSSGPADGAPPPPPHGEEYSVPAKMAAVGDASSSSPVAPRRGVAAALGGGTSSSSPAAARRGAAAAASVVAAGGGGGGPRCQAERCNANLMTEEKPYNRRHKVCEAHSKAPVVLVADLRQRFCQQCSRFHELSEFDDVKRSCRPRLAGHNERRRKSSADAHAGGGNNGFRQHADQNGRGDPAGNHFQIR

SEQ ID NO: 591 - protein, 346 aa, Zea mays
MSNRATHWCYACQRPIRLRGQDIICPNCSDGFIQEISEMGGVLNTYGLTEPDFEERQARRFGMMDAISSLMRQRLSEIGRDSLFDIHGRQGTGTEYGRRSTAIPTLVFGGIPSPAVGSSDVNVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHDPFSFLWPFGPSSSYQYEENVDEPAVYDPNQIAYSAWHYDH

SEQ ID NO: 592 - protein, 91 aa, Zea mays
MAAHLASAFFFAAEPVGEPGVHALDACALCAKPLARDSDIFMYRGDTPFCSEECRYEQMQLDAIRARQPYASGTEARRGHREASKVSAVAT

SEQ ID NO: 593 - protein, 244 aa, Zea mays
MSPQSQQQTAIVGEEYCEGEDRELTVRKTTLFTPGDGLEAYDHRTGALAFRVETYGRGGACGGGAARGDLALLGAQGEPVLTVRRRRPSLHNRWDGFLGDGAAHGQKKPVFSARRSSILGAGTGAAAVLVDLLAPGAAGEFRVDGSFPRRCCRVVASARAWAAPVAKEEEEEEEEDVVVAEVRRKVDEDAHVMMGRDVFVLWVRAGFDAAFAMGIVLVLDRITGDDVDGDLREDLLEAATSPPA

SEQ ID NO: 594 - protein, 141 aa, Zea mays
MASRCFFPRDASAAADGRHQQSKAAAEALEQLRHGGRLLSREDVGGAVRVRIVVSRRELKQMVAALGDDDGAGAAAAAASSERRHRQRGAGAGAGAGPGAEQRLQSLRRRSARRAAEAARRTMQAGGEWEPGLQSIPEEVY

SEQ ID NO: 595 - protein, 213 aa, Zea mays
MGPGASTSAQPLSRLLLSLPKPGAAKHPRSSSSSSSPSQPRPDVAAARSPGLVLRRREAAAALLSTAFLSRFALPAAAADGGECPLEVAPSGLAFCDRVVGTGAAAQEGQLIRAHYTGRLEDGTVFDSSYKRGKPLTFRVGVGEVIKGWDQGIVGGEGIPPMLAGGKRTLKLPPALAYGEKGAGCRGWEPTSCVIPPNSTLLFDVEYVGRATG

SEQ ID NO: 596 - protein, 413 aa, Zea mays
MKLLGWMHRKLRQNSNDVFKEFNNAGGGTCNCITGLAASDPATFLATANEYFTADNDFTNNHPSSPAADLFTFGGSGLLTIGTLGIAAVAVSADADEVDYDVDADADSDFDDNDDTAGDDEDQVDSAVTPTFTYAAPPPIEDATVVEKAAVAVVEAIAEKDDDTTTEDDLMVVSAELEKVLGGRNSGTAGDLVASARVSFAMGVDCPLQGFLFGSPVSDAESRLEQPRDSNGGRRTSLGELFMRTRFAEEKVALVAVEEGEDGGDIGAGGERDDRKAGKGGGGHKTTKKRSAKDEKVPRGDGAQASATVTKSKFHKILQIFHRKVYPESAALARNLTKKSRKRGSGAYHKPEPAASKLRCLKEQRAPGFGCCASRASFGGAASPIDGDDDDELNGSKSGHWIKTDAEYLVLEL

SEQ ID NO: 597 - protein, 189 aa, Zea mays
MASTPHPPPLIGKSGNLTVFFTPSAEHESPGSEFSTPPTSPRAEDSPESPPAQTAPPPAPVYSVSTPQLVKMVSPPLPAEKLSRPSLVQVPSPPVKSVSTPLQAPKVSSCSLPPVQVPPLQFGKASAGSDGSLLAFFWDAVARMQEAHASLDEHISRWFGLDQSKYQWALNDYYERTGQEIDLSNVGTR

SEQ ID NO: 598 - protein, 617 aa, Zea mays
MSGAALCAALTGLGFDGEDPLDADALEWPFQYEEARPLLAWICSCLRPSNVLSPSHLAQYEQLVEEGRLLEGEDLDSAFDSISAFSSKKDNQEAVFGSEETILDIREAKLAYRAEVFELQKQLARQQAQFDLLAGQASTLIQGRRSRVSAMSAVSRELISLDEILSSRNLEMNSVLGRITATTQELAHYHSGDEESIYLAYSDFHSYVVGDLACTKELNRWFSKQFEKGPFRLVAEEGKSKCSWVSLDDITNCLIRGDSEKSHHHQRVAELQRLRSIFATNERQWIEAQVENAKQQAILSILKAQVSSDEAHIHRDIHSLRRKGSELAGELSTLSQKVQALVSETIPCLCSELAQLQGTYILQGDYDLKVMRQEYYINRQKTFINHLVNQLARHQFLKIACQLERKNIASAYSLLRVIESELQSYLSAVNTRLGHYNSLIQAASEVREQGAIDDRDTFLHAVRDLLCIHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 599 - protein, 450 aa, Zea mays
MESLILASSCSASPRLPLLSSAARFRGLPVSVPPPSSASISGAARKGPMRPRLFVAAAAAPRGSGNVFEGLRAKGFASMSSSTGNENMSTGTGTLPPMPPTSSYIGSPVFWIGVGVALSVAFTTVSSMLKRYAMQQAFKSMMTQSAPNSFGSNSPFPFSMPPQASPTAPSTYPYLEPKKDTSPHVSTVDVSANEVEATGTSKEVDVTETPKPSKKFAFVDVSPEELQQKNLQSSPETVDVKHDSTYSESKEDTEEQVPTISTNTESKEDTEEKVPTNGASFKLNEGAAHGPTESNNSASMLSVETIEKMMEDPAVQKMVYPYLPEEMRNPNSFKWMLQNPMYRQQLQDMLNNMGATPDQWDNRMLDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 600 - protein, 636 aa, Zea mays
MAKDYPASPKAQQLQESKKQRLTYILVVSALCIAFYVLGAWQNTTLPKPIGNSAITRVGCDPTAATAQSSGSVPSFGPGSGEVLDFDAHHRLTINNTDGDGELQQFPACPLNFSEYTPCEDRRRGRRFDRNMLVYRERHCPGKDEQVRCLIPAPPGYRTPFKWPRSRDYAYFNNIPHKELSIEKAVQNWIQVEGDKFKFPGGGTMFPRGADAYIDDINKLISLSDGKIRTAVDTGCGVASWGAYLLKRNIIAMSFAPRDTHEAQVQFALERGVPAIIGVMAKQRLPYPSRAFDMAHCSRCLIPWDEHDGLYLAEVDRILRPGGYWILSGPPINWKTHHRGWERTKDDLKREQDKIEDVARSLCWNKVVEKGDLSIWQKPKNHLECANIKKTYKTPHICKSDNPDAAWYTQMEACVTPLPEVSNQGEVAGGAVEKWPERAFLVPPRIKRGMIPGLDAKKFDEDKKLWEKRVAYYKRTIPIAENRYRNVMDMNANMGGFAASLVKYPVWVMNVVPVNSDRDTLGAIYERGFIGTYQDWCEAFSTYPRTYDLLHADNLFSIYQDRCDITGILLEMDRILRPEGTAIIRDTVDVLTKVQAITKRMRWESRIMDHEDGPFNPEKVLMAVKTYWTAEAEEEH

SEQ ID NO: 601 - protein, 174 aa, Zea mays
MAEDAPNAVAEGSQPAASEGSADAALPAAAGAKAAEALLPSLSIWPPSQRTRDAVVRRLVQTLAAPSVLSQRYGAVPEPEAERAAVAVEAEAFAAASKSAAAAAECPASVEEGIEVLQAYSKEVSRRLLELAKTRSAAAAAAPAPAEGSAQAQESAEASSATAPPTEEAAVNEE

SEQ ID NO: 602 - protein, 198 aa, Zea mays
MKCWCVHSPRGAMATPLSSPLAPTALRSPLRHRALLLLLPFPPRAASSGEDTAAAADQEPAPAATKTATADDDFEERVLRIKSRVGPKKRGARKKKAAASASASAVTLPPVPLREPRSALGAPVELGFTAYSERLNGALAALGLAAVLLVELGSGQALVKYHQPATLFLQAYTVAAAAALFVKYEKERISTWPGPPAK

SEQ ID NO: 603 - protein, 923 aa, Zea mays
MAEAISATSSCLEPLCGCLESTGVFEAVGREVAAFLRIKSNCGDLEKARDSLRAVETTVRARVTAEEDKLNVCDPQVQAWLKRVDELRLDTIDEDYSSLSGFSCLCQCTVHARRRASIGKRVVDALEEVNKLTEEGRRFRTFGFKPPPRAVSQLPQTETVGLEPMLARVHDLLEKGESSIIGVWGQGGIGKTTLLHAFNNDLEMKDHHYQVVIFIEVSNSETLNTVEMQQTISDRLNLPWNESETVEKRARFLLKALARKRFLLLLDDVRKRFRLEDVGIPTPDTKSKSKLILTSRFQEVCFQMGAQRSRIEMKVLDDNAAWNLFLSKLSNEAFAAVESPNFNKVVRDQARKIFSSCGGLPLALNVIGTAVAGLEGPREWISAANDINMFSNEDVDEMFYRLKYSYDRLKPTQQQCFLYCTLFPEYGSISKEPLVDYWLAEGLLLNDRQKGDQIIQSLISACLLQTGSSLSSKVKMHHVIRHMGIWLVNKTDQKFLVQAGMALDSAPPAEEWKESTRISIMSNDIKELPFSPECENLTTLLIQNNPNLNKLSSGFFKFMPSLKVLDLSHTAITTLPECETLVALQHLNLSHTRIRLLPERLWLLKELRHLDLSVTAELEDTLNNCSRLLNLRVLNLFRSHYGISDVNDLNLDSLKALMFLGITIYTEKVLKKLNKTSPLAKSTYRLHLKYCREMQSIKISDLDHLVQLEELYVESCYNLNTLVADTELTASDSGLQLLTLSVLPVLENVIVAPTPHHFQHIRKLTISSCPKLKNITWVLKLEMLERLVITHCDGLLKIVEEDSGDEAETTMLGQGHPSEEQEDKRIDGGQSVCKSDDNAHAELLNLRSIVLTDVKSLRSICKPRNFPSLETIRVEDCPNLRSIPLSSTYNCGKLKQVCGSVEWWEKLEWEDKEGKESKFFIPI

SEQ ID NO: 604 - protein, 291 aa, Zea mays
MARKCSHCGNCGHNSRTCGRETMLCEAGDNGGHGGLRLFGVQVRIGGGGAGSASMKKSYSMDCLQLAAPGCSLVSPSTSSSSSSLLLMSIEEGSERGAPNGYLSDGPHGRAVQERKKGVPWSEEEHRQFLSGLEKLGKGDWRGISRSYVPTRTPTQVASHAQKFFLRQSSLGKKKRRSSLFDMVPICENSASISDPLSSEGASTSLSLNVPRHGVTSVSERAALDLNSTEEDDSRADASSASASGAGTRPPFPAAQTEPLQPSSLGRGRGHHCSPLDLELAMSLPAPSIGT

SEQ ID NO: 605 - protein, 611 aa, Zea mays
MDKIQSDCPYPGCFFCVMKEANPSKRRASVLKFFRELPSQDDDGQVLPVSGLWNTAMAHPNDPEFINLGIFECMAALIWKGLKNRRWLAHDQNIYVPYYAAHIIGSYTMNMEEFAECAVRAGVIPPLVELLRGRLTWVEQRVAVRALGHLATYPSTFPAVADNGEVLELATQLASSSLEIVYTHFYQFVDRRLDYHCGLLTRGMGGVEMESRKAEEWASQLQCWSLQLINCFAFKPEFLHDICKPDFLVKLPGMWGGLVNENSPAGVGLLRTICQSKVGRGDAANIPGTIDALCNIARSSDDWQYMAVDCLIWLVQDASTCHKVIDKVAPTLIDLADISTLGDYKKLGDMIVTVLQECMQQSGNSRGAISDQTKAEIDELLRSKQSLKLEKSMPKEDLHIKQAAALVVKLEGNSLFSSGNIAGAAEKYSEALALCPMKSKKERVVLYSNRAQCYLLLQQPSAAISDATRALCLHSPVNRHAKSLWRRAQAYDMLGFAKESLLDTILFINECSQSNDPDLSLKQNKVPDYAERLVKKQMRAAWLFREAALKHGGVRRAGDASDAAFGQEADDSEWETASESDGENGAATGGEADGETGWKNGGRQEDFCEKS

SEQ ID NO: 606 - protein, 396 aa, Zea mays
MESTAGPRKRQKAASASGSVAPYLPQELVRNILLRLPSRSVLRFRAVCKDWLRIVSDREFAADHNRHQPAMPLVSFLRSAAGSKRGQTDCCVDAFDLSADSFRSVVRFADKGTRCSSFDIHGSCDGLLLLSFDARFYVCNPATHQWTRLPAPLRASWLAGFYRHEPTGEYRALFYRGQWPGTDYYIMVADSRKGRGIGLPSEKYGYKFRRQPYSLPVLLRGHLHWMAAIEGYDYEMLAFNTTTEKFTVMCPPVVRWHMSLAEVGNELALLSCGHQVPMLELWILKDYENKSWVCTHWIRLPELKMSTFAFDDFSRMIFVSEKGVLIATPEQKLLRYDLNGTLLESFPCNNGSHLKITPYTFKESLVRHAFFETPDCNADGHEDEDEPEPPPFFLGL

SEQ ID NO: 607 - protein, 229 aa, Zea mays
MGSSGGSSEHFLRQLSSSDGGSAPHHLLQREWECGGVTGSGSRRGSRKKTRARGHRRRGGGFCRAEEAAPGRKRVMVVVDQSSGAKHAMLWALTHVANKGDFLTLLHVLPPESGHSSRGAAEDASALANSLGALCKACKPEVEVEALVIQGPKLPTILSQVKKLEASVLVLSQRSPSPFCCFPRSSSEELVEECIDRAECLTLAVRRQSKGVGGYLVSTRWQKNFWLLA

SEQ ID NO: 608 - protein, 184 aa, Zea mays
MAMATQGQADQQQQQHGRSEPTTSVAANRWGPYSGAGDFASNMAVILAALLAALALGLALNAAVRYLLRRRRRAGSGGGQGNGSGVLPSDDPAEKPSVEVELQAPPPALLVYSAAGTKLAGAAAECAICLAEFADGDAVRVMPACGHGFHARCIERWLAEGRRSSCPTCRAPAVQRSLHASELL

SEQ ID NO: 609 - protein, 137 aa, Zea mays
MAAYAGTLVPPFLTVRLAVSHLRSITPGSYSLSHCLPRLAVARAASRGNGDGDGGPPAEGEKERRRSSLPALSEIRWGELLSPDPTNAVAVVLTGALVWAGASLLLQLALISAAIFAAAVKYSFVAALLLFVLIALL

SEQ ID NO: 610 - protein, 1075 aa, Zea mays
MRHLALLALLLAPVLGSTGTTLSPSPAATDSPANQGQASSPPQSAFALGPVAVPTAPTTPSASPSPEKAAAVSPAAPTEPRIAPGPVTPPKEYSAPPPVEVAPPDPTDEVPPPIAPPQAAVGNPTPILPGTPALLPYVQAPAPSVVLKPNPPVVVSPPPASNQPSMPVGSVPPYPPPASPPPANGIPPYPPSGRFPAIPPDTSVPPPATSPVIAQAPQRRADPPSRDYKNGNAVPPANTYPPANLKKHHVPHASPPKGSTGQTAQGHKSPVTGSVPAASPLPQNTNMPSIPKNASSVPHAQPSPPSVAPELAPTGRSHAQGWKSSNPNNKTNRLPAPSYPPPRAQGPEVSRTPRQTGTKNYTHRAPPPFPQGHPSFPVHSPSPSPASSRGPANAKKRNHISPTLPSIPPLPEPKAPSAHPIWTLPPPPPNSDCNSLSCPEPLTDPPAGAPCACVLPIRVGIRLSVDLYSFFPLVSDFAEEVASGVNMAQRQVRVMGANVAGDQPDKTMVLVDLVPVQVKFDNATAFSAFESLWSKKVSLKPSVFGNYEILYVVYPGLPPSPPSGQGVGDGAFGNNRNARAVKPLGVDVRSPKRKVNGSLIAIVVLSTVIALIICCLAAWSLILRFKGPSHTARGFPHTVLPKFSRSSGTGHTLSAGAGRYSSPSGPSDSLGSSIATYAGQAKTFKFAEIDMATNGFDDSKVLGEGGYGCVYQGTLEDGTTVAVKVLKRYDDQGEREFLAEVEMLGRLHHRNLVKLLGICIEENARCLVYELIPNGSVESHLHGADRETAPLDWNSRMKIALGAARALAYLHEDSSPCVIHRDFKASNILLEHDYTPKVSDFGLARTARGEGNQHISTRVMGTFGYVAPEYAMTGHLLVKSDVYSYGVVLLELLTGRKPVDMSRPAGQENLVAWARPLLTNVLSLRQAVDPLLGPNVPLDNVAKAAAIASMCVQPEVAHRPSMGEVVQALKLVCSEGDDGIASGRFSQELPMQTTAVYDATGMEAERVLISDIFGSTPLFTRGADSDSFRKQSSSGPLMTGKNRKFWQRLRSLSRGSMSEHGISPYYETRSQYSGR

SEQ ID NO: 611 - protein, 81 aa, Zea mays
MASLLSLYGGDGRRRMSRGSGTAPAPVRRLLRRLRSSFIRRSAARPRTRAAARFAYDLRSYSQNFDDGVISSSAPAATARA

SEQ ID NO: 612 - protein, 403 aa, Zea mays
MASSSCVRLHHLPSTSRRSSAPTNLQFLAASCRWRRRVLVPGAAPPPLRLCATGSPQPPLGSDSNAPLSRGTREEGEEVEEQRQPPPPPRLKIAVVGFGNFGQFLARTLVAQGHTVLAHSRSDHSAAAAAMGARFFPDAHDLCECHPDVVILSTSILSAESVVRSLPLHRLRRDTLFVDVLSVKEFPKRLLLGALPEEMDIICTHPMFGPESAPSGWTGLPFVFDRVRVGDSCPARRARAEAFLGVFAREGCRMVEMSCAEHDAHAAETQFLTHTVGRMLAALELRATPVDTRGYETLLRLVDNTCRDSFDLYNALFMYNDNSTELLHRLDWALGAVKRRLFDGLHGVLRRQLFGVEDGEGPAERTELLAVVPGGGPPDTDDQGGDGRDGDGDGDESGEQKND

SEQ ID NO: 613 - protein, 982 aa, Zea mays
MMDMRRHSVSVDAPLSRTLVQLKRVRSLRDPATNSMSKYASPSDHMIWETASSNGVTPELGRSAHHHLVGEDEDVGAEPTTMGSERSFRGPSARTASYRKSSAVRIRGLNPPRSKQVHRVRQDGHRKSLDSNHSNHSSIRQLADNMVSNVDADKEEGEVNSYERPKLAMPDKSDEEVKMPGCSKSRSKSSAAMSRVGSPCMSASEARSVGSRRSTLGHGTEDTRLRSNDVVGSNFSGCGISYCWSGASKYRELYSDSDGPDQPLLSTDGIEAAFQGNVPYTETLRCLSQKFRPRSFSELIGLNVVAQSLLYSTCKGKVAPMYLFHGPRGTGKTSTARIFAAALNCVSLEEQRPCGFCKECVILFSGKSRDVKELDAAKMDRLGRVKALLKSASLVPYSSRFKVFIVDECHLLREDAWSAILKSLDEPYRHTVYIMITSDIESLPRASITHCQKFHFPKIKVADIVYRLERICIEEGLEFDHDGLYFIAAKSNGSLRDSEIMLDQLSLLGKKVTISLVHELVGSVSDDELIELLDLALSSDTTNTVRRARELMGSAIDPLQLVSQLANLIMDILSGRCQSAVTEVSKSFLGRYALSEVGIKKLRHALKILSETEKQLRTSRNQATWVTVALLQFSTNEPNPVAETNDMHAHSVTGYTDDWVSKVHSSANFCQACNSSKSNCSERHCRRLKLENIWRRAIGKCRSRSAKSFLRKEGFLSSVHVTEELAIAEVGFEHPDHLSRAEKMQSLIESSLQHVLGCNVEIRFKLVPCPVSKDARLKRQPFSFLNCSGRKQELSDSVVTDEDEAARGPGARETPLKGYTSSQQESPYTMRRVDSKPTTVHGCEDDARSTLTSSRSTADDLTRTCRSETGYPKGVREQGRSDGTQQEPDLQPNCFSRTLKLQKKLLSSGAAHTICLRVQPHNKMDFLPKKEFDTYFCAYEPYEQCPRSDSRATYSSRDDDLWSKNSRFGSNLLCWRAPKQSM

SEQ ID NO: 614 - protein, 183 aa, Zea mays
MFLRISRLGARLLRESGAETRAGNLLSSPGILYQAHLNQHSTRVRNVLFSTATSGDQDESSQAKDKISVTFVNKDGSEKTIRVPVGMSMLEAAHENDIELEGACEGSLACSTCHVIVMDVNYYNKLEDPADEENDMLDLAFGLTETSRLGCQVIAKPELDGIRLALPVATRNFAVDGYVPKPH

SEQ ID NO: 615 - protein, 172 aa, Zea mays
MDDRTYKGGIKAYWKRRGYYRMDGDAARRRQPLPTVELGNGVSQAQAQAQPPAGDGSGRRRRCRGWRVRRGQLGRRLLRALSPRRWLMRLRDAYVSAMLRLASSPAVGYGAGAPFCATATHGAAAAAAFARPAQLKEYDEKVLVEIYRSILARGGPLAGAPAAATLRLPTAV

SEQ ID NO: 616 - protein, 1075 aa, Zea mays
MLRNGNEGMSTIPGFSQIQFEGFCRFINQGLAEELEKFPTIKDPDHEIAFQLFAKGYQLLEPSIKERNAVYESLTYSSELYVSARLIFGFDVQKETISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLAQVFDQTNPLTQTVHGRKVSCLGPGGLTGRTASFRSRDIHPSHYGRICPIDTSEGINVGLTGSLAIHARIDHWWGSIESPFYEISEKAKEKKERQVVYLSPNRDEYYMIAAGNSLSLNQGIQEEQVVPARYRQEFLTIAWEQIHVRSIFPFQYFSIGGSLIPFIEHNDANRALMSSNMQRQAVPLSRSEKCIVGTGLERQTALDSRVSVIAQREGKIISSDSHKILLSSSGKTISIPLVAHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKQIPHLEEHLLRNLDRNGVVRLGSWVETGDILVGKLTPQIASESSYIAEAGLLRAIFGLEVSTSKETSLKLPIGGRGRVIDVKWIQRDPFDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSEKNFQVNREDV

SEQ ID NO: 617 - protein, 496 aa, Zea mays
MAADAAAAATLRTALSQATGQEQRASLLCTPKHRVAASRRSLRFTTRASSNAGASVSIPKQWYNLIADLPVKPPPPLHPQTHQPLNPSDLSPLFPDELIRQEVTDERFVDIPEEVIDVYKLWRPTPLIRARRLEKLLGTPAKIYYKYEGTSPAGSHKPNTAVPQAWYNAAAGVKNVVTETGAGQWGSALSFASSLFGLNCEVWQVRASFDQKPYRRLMMETWGAKVHPSPSTATEAGKRILEADPSSPGSLGIAISEAVEVAATSADTKYCLGSVLNHVLLHQTVIGEECLEQLAALGETPDVVIGCTGGGSNFGGLAFPFLREKLRGKMSPAFRAVEPAACPTLTKGVYAYDFGDTAGLTPLMKMHTLGHGFVPDPIHAGGLRYHGMAPLISHVYELGFMDAVAIQQTECFQAALQFARTEGIIPAPEPTHAIAAAIREALECKRTGEEKVILMAMCGHGHFDLAAYEKYLRGDMVDLSHPADKLEASLAAVPKV

SEQ ID NO: 618 - protein, 535 aa, Zea mays
MPPLHVPGSSTPRKFYHLVLFHVHPFWIQVLYFLLISVLGFLMLRVLPMKSSSVPRPSALDLLFTSVSATTVSSMIAVEMESFSNAQLLLMTLLMLLGGEVFTSMLGLHFTCTKLRNKRETPHNNLHGNSLEQSRRRHRPMEMEAQAAAVQMELAGFNKDGHGDFASMARLLMFIVLGYILVVHIAGYALILIYLSVVGSARAVLVRKRISLSTFSVFTVVSSFANCGFVPTNEGMVSFKSFPGMLLLVMPHILLGNTLFPIFLRLSITALERVTRWRDLCELLRDRGPGGGPAAAAAAAAIGYDHLLPGPRTWFLALTVAVFLAVQLVLYCAMEWGSGGLGGLNAFQKLVAAVFMSVNSRHSGEMVVDLATVSSAVVVLYVLMMYLPPYTTFLPVAVEDDQQQQNEAQPHDNSTSKSSTSISIWHNLLMSPLSCLTIFIVVICITERRQIARDPINFSVLNIVVEVISAYGNVGFSTGYSCSRQVTPGGGCCKDAWVSLSGKWSVEGKLTLMAIMFYGRLKKFSMLGGQAWRLN

SEQ ID NO: 619 - protein, 374 aa, Zea mays
MAATSSLKSSLLLPSTISDFSGAAAAVSISTQKRRSRGARVQVSAAADSKNILVMGGTRFIGVFLSRLLVKEGHQVTLFTRGKAPITQQLPGESDAEYADFSSKVLHLKGDRQDFEFVKTSLAANGYDVVYDINGREAVQVEPIIEALPNLQQYIYCSSAGVYLKSDILPHCEVDAVDPKSRHKGKLETESLLTSRGVNWTSIRPVYIYGPLNYNPVEEWFFHRLKAGRPIPIPGAGNQITQLGHVKDLARAFNLVLGNPKASKQIFNISGAKYVTFDGLARACAKAGGFPEPELVHYNPKEFDFGKKKAFPFRDQHFFASVEKATSELGWTPEFDLVQGLTNSYNLDFGRGTFRKEADFTTDDMILDKKLATV

SEQ ID NO: 620 - protein, 62 aa, Zea mays
MSKQGGKAKPLKAPKADKKEYDETDLAYLQKKKDEEKALKELKAKAQKGAIGGSGLKKSGKK

SEQ ID NO: 621 - protein, 262 aa, Zea mays
MGADGEEASRIVVPMAVEGTSEQLAFVEESKLQKRKENADWAVRNRERRAVKRQRIRDEHKVTVRRPEDFVAAFRNKERDFLRMRTRLKVRKQPPAEALSSKLVFAIRIPGSVDLHPHIRKVLRKLRLTTVLTGVFLRATELTLKRLLVVEPFVTYGFPNLKNVKELIYKKGRGFFDKEPFPLTSNDLIEKALGDHGIICLEDVVHEIATVGPHFREASRFLMPFRLKCPERRLQMKRKPYKDGGDSGDRGDKINELIEKLN

SEQ ID NO: 622 - protein, 185 aa, Zea mays
MPPAPKSGDALFASVDRVNAELFTLTYGAIVRQLLTDLEEVEEVNKQLDQMGYNIGTRLVDEFLAKSNVSRCVDFKETADVIAKLGFKMFLGVTATVTNWDAEGTSCSLVLEDNPLVDFVELPDTCQGLQYCNLLSGVIRGALEMVSMKAEVTWVRDMLRGDDAYEMRVKLIKQVPEEYPYKDDD

SEQ ID NO: 623 - protein, 166 aa, Zea mays
MNRKPGDWDCRACQHLNFSRRDACQRCSEPRGVGDRSGGGGDLGGRGGSSFGGGFGAGSDVRPGDWYCSCGAHNFASRSNCFRCSAYKEEAAGAFDSDMSRSRGYAGFGSGAAARTNRPGWKSGDWICTRSGCNEHNFASRMECFRCNAPRDSGSAATTTYENYLH

SEQ ID NO: 624 - protein, 206 aa, Zea mays
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKIKVKKDHASVPFDDQCSILEKEAVNLSLENLKTYPFVKEGLANGTLKLVGGHYNFVSGEFLTWDNKQPS

SEQ ID NO: 625 - protein, 272 aa, Zea mays
MAMALASATAAALFRSALSAPHGAGARVRPQRRQPFLAPLHAAKGPGSAPVVLEGKAKGKKKKGPSSGNLPAALDVEIREAQEYLDSDQQEPVPDNFPFELIDEEGMSVVILRRDYKDEKVEVTVSMPNLEGGPEFGDEDGEGDGESAVKDDGEAEEDDESAGDSSISLKVVVSKDSGPKLEFTCTAFREEITIDDMLIVEKTDDDDGEEKFPYEGPEFTELPVNVQKGLFKYLEQRGVTLSATNYMHDYMVTKQAQEYIRWMTKLKDFVAQ

SEQ ID NO: 626 - protein, 98 aa, Zea mays
MAFMRYRALPRGELTAEEFRAWLAQFDADSDGRISREELRHALRSLNVRFAWWKARGGVRAADADRDGGVQLGEDEVARLFAFAQSHLRVKIAQLGYY

SEQ ID NO: 627 - protein, 523 aa, Oryza sativa
MRHRVGPAAAAAAALRRFSHLRPPAPPDPRLAFLRSEFDGREPGRQPPSPETREEPKGGERARSPVAVDIAHPWPEWVALMELLLQRGHLDASVFAGGAAGSPSKDSNVIRTACLRFGRERPELIRHLSRWDIQVALRYGCPSIDRKVVNSGKRLRAHVGLDEGEVCSQCNLRGGCERAYVKARKEEIGRTVDVMRILLTYGLDTVTGNVENRACLNKTVKESIKSLLNEIVGFDSMGPGSSTEKPTHRMPKGQSSIPMKQGDWNCPKCNFLNFAKNIKCLRCNGEFEERYQLLHENQEHLPLKKGDWICKRCNFLNFAKNTRCLQCHEKPTNRQLNPGEWECVSCNYLNFKRNAFCLKCGWKRPKSLNNQDSIESQRDLDDNKHSAISFIQDGIQSRRQILQNKAPLSDEDSDFWSSEEEGAYHSDKNIPPIKKDYKFLESFPIIGGRTAMSQDPLEREKWKDEMSRRNKGLLTEVSEESNRPSCPVRIPRSIEQIESGDDDDDDISSWFSGGTSNINMKKA

SEQ ID NO: 628 - protein, 139 aa, Oryza sativa
MAATALSSQVRLPMSLRVATAPAPARVSVLPASNKLGDRLRMQATYNVKLITPDGEVELQVPDDVYILDQAEEEGIDLPYSCRAGSCSSCAGKVVSGEIDQSDQSFLDDDQVAAGWVLTCHAYPKSDVVIETHKEDDLI

SEQ ID NO: 629 - protein, 1908 aa, Oryza sativa
MDDAWPARWPPPPPPPAPAPATATATPLPSQIDSASLRHILRPFAAQGAAPPEQLAASHPSSQYGQPARAAPSTSLLAQVAGNHPHATHVSDRKALFGMLNAGNAANVIDLTRASPLGGAEPLPKHPRHGLEASSSVEQPSCLGPLFQNTSANVQGSFPGECSVNNGISQGAIQFQDSSTCAVQKLPSQSTPRHHPALLGDQICVSCLNVGGEFFVGEAGIFGVRCFCHRLRMSVAKFCEHSGGPAEKAGEIVIMDNGMTIVQWLKYCMGVGASISDTKWDWPEWAYMRYSSEEYWTKSLLTTNNNMEKTGLFSGHGKSTGHINNPVYSSDIHNEVGRFTSVEKLVNKPDETFYRKSVGLHEAFSKNPAIQQSSKINLANHMIHDMNMNSISRPSERTYSTANMGITYSRNHLAHDYANFLEKNLNNLSRSPGPSSTRVLSNDSRACMPDVPHKIIQDGSGRASNTELKLGQSSYHQSMATLFPSVQSTIIEFQKPQHHLQFTTPNAYPKQTTKANKTIENIEPSFGTGNRKRSLDVSNGTSHSELNEITDDAAKNSFISLFLSHLERNSTSESIDDVLNSNEHYLLKAPDVAYSSDRLKTASTQVETRANDNQLKLAPAIIHTKRISDSRSLPVPVASKGYVHQDVLHANSQEPLINGDCLPHLLPSQPNAGISKICAEVSSPVNCRCCNHVADKSHLAHSETGAPCFYDRTARRYISFECADDLCTHKSLRATNYQCGRAFCSTANEFLPSFGQNDQSPIGKSMHRCCCKAQEDSSKLGFRAGNFCRSHFCNDGTPVPAHRSIVEGLDEVRTRSTFIPRSSLCSRELMLQSCCHACPIDGYYRSSMGHTANSLTKNTLLDAPNNTECSPYRDGKCCCSLAPKCLAGYGFTKHCVARIDQTDHTVQKSKDDGMQAAARCCTLGESEKLICQCSSEIIARKSDSKASFQNEVSTEVLNRPCVPTLQQLKNVTEASAVGGHWPYETVKEKASACRDSGIFKELKSGFSSGFSSDVVTKFSASPELNKYGLEHKNLVFDEGSRIEKCSSSSYLPISTGCEEAQNSFSRFHLEPSLVKHKNNQISEGSTRKEHENEGQCSEMSKKTRTLRCCANKSESDDCTRKIDLSSREGDSQPQHKAGPFSRRVSKTKRKHPPTHLNKHVKRLHSNCKVLNVDNERSDDEGIYVGESNSSDRKKQEDNMTTLDRTKCQQQGSRLLVRKLPKYVSLNCIVNETNSEDACSGSASIDSSLIATGITNDNRKSPKIVPLNLILKKAKRCHAIKPLSKTENIHFSEEKSSDGSADKSSSGDRSFSPQDELWSPKKNRYSSNVSRPHVKTDCQSPCCVLEEDEPLSLADMGTSQLSASRSRGSKNQRACISLNRMERCEEFTNESACSPCGDKHAAVQACVTKFERYIQRPSLDASCCVCGISNLEPSNQLIECSKCFIKVHQACYGVLKVPRGQWFCKPCKINTQDTVCVLCGYGGGAMTRALKAQNILKSLLRGIATAKRSDKYVYSSGNVNSECTSKLHGEYVRHDSFNGHRSRSFNAISSFGIKEASIGSARGDIISKSWTSNRNSSLLGPRTRQWVHVVCGLWTPGTKCPNTITMSAFDISGASPAKRNTECSMCNRTGGSFMGCRDVNCSVLFHPWCAHQRGLLQSEPEGEHNENVGFYGRCLDHAMLDPNHVNPKKECLRSNDWTCARTEVFRGRKGDSFGANRSRKPEEKFGECSVSQEQINAWIRINGSKSCMRGQKEYVHYKQLKGWKHLVVYKSSIHGLGLYTSEFIPRGSMVVQYVGEIVGQCVADKREIEYQSGKRQQYKSACYFFKIGKEHIIDATRKGGIARFINHSCQPNCVAKIISVRNEKKVVFFAERHINPGEEITYDYHFNREDEGQRIPCFCRSRGCRRYLN

SEQ ID NO: 630 - protein, 1105 aa, Oryza sativa
MSSGGRGGKRRGAPPPGPSGAAAKRAHPGGTPQPPPPAATAAAPVAEEEDMMDEDVFLDETILAEDEEALLLLDRDEALASRLSRWRRPALPADLASGCSRNVAFQQLEIDYVIGESHKVLLPNSSGPAAILRIFGVTREGHSVCCQVHGFEPYFYISCPMGMGPDDISRFHQTLEGRMKDSNRNSNVPRFVKRIELVQKQTIMHYQPQQSQPFLKIVVALPTMVASCRGILERGITIEGLGSKSFLTYESNILFALRFMIDCNIVGGNWIEVPAGKYMKAARIMSYCQLELDCLYSDLVSHAAEGEHSKMAPFRILSFDIECAGRKGHFPEPTHDPVIQIANLVTLQGEGQPFVRNVMTLKSCSPIVGVDVMSFDTERDVLLAWRDFIREVDPDIIIGYNICKFDLPYLIERAEVLKIVEFPILGRIRNSRVRVRDTTFSSRQYGMRESKDVAVEGRVQFDLLQAMQRDYKLSSYSLNSVSAHFLGEQKEDVHHSIISDLQNGNSETRRRLAVYCLKDAYLPQRLLDKLMYIYNYVEMARVTGVPISFLLSRGQSIKVLSQLLRKAKQKNLVIPNIKGQASGQDTFEGATVLEARAGFYEKPIATLDFASLYPSIMMAYNLCYCTLVPPEDARKLNLPPESVNKTPSGETFVKPDVQKGILPEILEELLAARKRAKADLKEAKDPFERAVLDGRQLALKISANSVYGFTGATVGQLPCLEISSSVTSYGRQMIEHTKKLVEDKFTTLGGYEHNAEVIYGDTDSVMVQFGVSTVEDAMKLGREAADYISGTFIKPIKLEFEKIYFPYLLISKKRYAGLYWTNPEKFDKMDTKGIETVRRDNCLLVKNLVTECLHKILVDRDVPGAVQYVKNTISDLLMNRVDLSLLVITKGLTKTGEDYAVKAAHVELAERMRKRDAATAPTVGDRVPYVIIKAAKGAKAYERSEDPIYVLDNNIPIDPQYYLENQISKPLLRIFEPILKNASRELLHGSHTRAVSISTPSNSGIMKFAKKQLTCLGCKAVISGSNQTLCFHCKGREAELYCKTVGNVSELEMLFGRLWTQCQECQGSLHQDVLCTSRDCPIFYRRRKAQKDMAEARVQLQRWDF

SEQ ID NO: 631 - protein, 717 aa, Sorghum bicolor
MAMAKKGASSLLLLSLSSYLLCVAHAATSLSFSYNFSDAGVLTGADLTYMSNATAASDRIDLTKDTTWSTGRVAYGQPVPLWDNSSTGNSMVASFTSNFTFAITPHNSTFGQGDGMAFFVAPYPPSLPQDSNGGFLGLFNNPNNTANAYFPPTVAVEFDAFRNTWDPESTVNHVGVDVNSIVSAAYAALPDASFNGTMSAWVRYDASASTLSATLRFDHLPELGLYNVSATVDFKEAGLPQQAAVGFSGATGDFVERHQILSWSFESALVSVAAGDNTTGTKTSNIGLIAGLACTGIFILLIVAAWLSYNKYLKQRGAKQTQEPPQNTETPLHLDGEMDDEFEMGAGPRRFTYNQLSQATRGFSDEEKLGEGGFGSVYRGYLQDQGLHVAIKKVSKTSKQGRREYVSEVTIISRLRHRNLVQLVGWCHDADELLLVYELMSNGSLDKHLYSTDNILTWQVRYDIILGMGSALLYLHQEWEQCVVHRDMKPSNVMLDSSFNAKLGDFGLARLVNHSRAAHTTWLAGTMGYMDPECVVTSRASVQSDVYSFGVVLLEVACGRKPVVLEEEDESRVLLVQWVWDLYGRGELLDAADPRLNDGGGGGGFQPLEMERVLCVGLWCVHPDYASRASIRQAMSVLQFEAPLPELPLEMPVATYGPPVARGHNWSSTTSSSASANTGGHSSTSDRTAEHSLGSSDKSSTHGLLSLPSSNTRSATK

SEQ ID NO: 632 - protein, 214 aa, Sorghum bicolor
MLSSTTLRSLVPAAVASPSPAHVTACSSPAVGRRVPAAVVVRAVRNYDSIPKREPFSSSRSILDEFLRQDKPLVQRTKDQITDYCTTTEGDECCSCWDAYFELNKLEQELPKEEISRMVKDSEGDVRYLIESIHHRSNLRKKMAEKSRNLVPSTSQGQTAKPRPFPVPDGIPKTQEELAEEEEALMPESPYTRLLRRMGRYPDWYTPRPDHETD

SEQ ID NO: 633 - protein, 406 aa, Sorghum bicolor
MGPSSIQEMEEARRTAVQSCHRVLALLSNPHGQLVPSKDLMAATGEAVAKFGSLTAKLTNSNSNSNGNGLQLQGHARVRKIKKPLPIFDSNLFLESSAVAAAAAATVAKTPSPSPITGLQLFPRYHQMEGSSSKDPVRIPTQFPKRLLLENPAAGLEGLPSKAPPVQMVQPVSVAPPAGTPTPALPAAHLHFLQQNQSYQRFQLMHQMKIQNEMMKRSNLGDQGGSLSGGGGGKGVNLKFDSSNCTASSSRSFLSSLSMEGTLASLDGSRASRPFQLVSGSQTSSTPEMGLVHRKRCAGREDGGGRCTTGSRCHCSKKRKLRIRRSIKVPAISNKVADIPADEFSWRKYGQKPIKGSPHPRGYYKCSSVRGCPARKHVERCVDDPSMLIVTYEGDHNHNRVLAQPA

SEQ ID NO: 634 - protein, 521 aa, Sorghum bicolor
MDATQLNRPMDATRLFLGALLLLLPAALLLLLRARGRRRLPPGPPSLPLLGSVVWLTNSPTEIEPLLRRLFERYGPVVALRIGARLFVFVADRRIAHEALVDRGAALADRPALASVRLLGENENSITRASYGPVWRLLRRNLVAETLHPSRVKLFTPARAWVRRVLVEKLGEPGPDAAPPRVVETFQYAMFCLLVLMCFGERLDEPAVRAIASAQREGLIYRSKNMQVFSFLPAVTKHLFRARLDKARELRRRVKELFVPLINARREYKKRGGEPKGETTFEHSYLDTLLDIKLHEDGDRPLTDDEICILCSEFLDAGTDTTSTGLQWIMAELVKNPAIQEKLYNEVKAAADNDKEGVSEEDVHKMPYLKAVILEALRKHPPAHFVLPHKAAEDMEIGGYLIPKGTTVNFMVAEMSRDEQEWKNPMEFSPERFLPGGDGEGVDVTGTKAIRMMPFGVGRRICAGLGIAMLHLEYFVANMVLEYEWKEVPGNEVDFAEKNEFTVVMKKPLRPRLVPRRSHLN

SEQ ID NO: 635 - protein, 974 aa, Sorghum bicolor
MVSGHIFHCRKNSWPAEEYVGRTALQLLDFDGGAPPEQAWRRRLNSHANILKEFSVTFMEAMRMMSLGLRLWSYVREEASHGRKAPIDPFTKERCKPSASQGVPLGGMGSGSISRGFRGEFKNWHIIPGLCESSPVMENQFSIFVSRDGGNKKYSSVLAPGHHEGLKKNSDSGISSWDWNLSGQHSTYHALFPRAWTVYDGEPDPDLKISCRQISPFIPHDYKDSSLPTSVFVYTLVNTGRDRAKVSLLMTWANSIGGFSHNSGGHYNEPFIAEDGVSGVLLHHKTAKDNPPVTFAVAACETQNVNVTVLPVFGLSGENHVSAKEMWNTMQQNGHFDRENFSAGSSMPSSPGQKLCAAVSASTWVEPHGRCTVVFALAWSSPKVKFQKGCTYNRRYTQFYGTSEKSAVNLVHDALTKYKLWEEEIEKWQNPILKDERLPEWYKFTLFNELYFLVAGGTVWTDGQPPAIDEKNSPGSIQQKSSKRGTKDTKQGSVKDNHVNLTVEQVPHGGQMTNSDDHSVSKFAAVHGSQMQEQVNGLKSEEPIPYLISKDGPEHVGKFLYLEGVEYIMWNTYDVHFYASFALLDLFPKIELSIQRDFANAVLYEDRRKVKFLADGTSGIRKVKGAVPHDLGTHDPWHEMNAYNIHDTSKWKDLNPKFVLQIYRDFAATGDMQFGRDVWPAVCAAMDYMDQFDRDGDGLIENDGFPDQTYDAWTVHGISAYCGCLWLAALQAAATMAHRLGDRHFAEKYKLKFIKAKAVYEAKLWNGSYFNYDSGTSSNSRSIQADQLAGQWYTASSGLPPLFDEHKIRTALQKIFEFNVMKVKGGRMGAVNGMTPKGKVDETCMQSREIWTGVTYAVAANMLLHGMEHQGFTTAEGIFIAGWSEEGYGYWFQTPEGWTTDGHYRSLVYMRPLAIWAIQYAVSPPKAILEAPKVNLMDRIHISPHMARAISEISIRKIAPDNRCFPSSAFHCEC

SEQ ID NO: 636 - protein, 416 aa, Sorghum bicolor
MPDVQPLVSDFVLKLKRRKVEGSHAVARQTAELLRSVVSQHRMVSSANQAAALADAVRAVGEQLIAANPVELAVGNIVRRVLHIIKEEDISSTAVGIEGLSVTVDSDDEYDSEHDDRPALSAAVLAAHARNALRAPSLQTLLEDIPVSPAVSRTASSTGDSDGKSKSAGDKSSTRKLKHDVIAAIGDLIDEIDSCYEPISEQAVELIHQNEVILTLGRSRTVKEFLYAAKEKKRSFRVFVAEGAPRYQGHVLAKELVEKGVQTTVITDSAVFAMISRVNMVIVGAHAIMANGGVIAPVGMNMVALAAQRHAVPFVVVAGSHKLCPLYPHNPEVLLNELKSPSDLLDFGEFSDCMNFSTQDGSPLLNVVNPTFDYVPPKLVSLFITDTGGHSPSYMYRLIAEYYSADDLVVRRKATS

SEQ ID NO: 637 - protein, 277 aa, Sorghum bicolor
MALLREHLDLIRAHLLDDHHVAVTVSSDDSASLQSSSPSPSQSPPGRSRPLPALSVSLPPRPPAVDLQQQHLWAPAPPPMQIHRQELQHYCYPPEPEEEEDDFRRYRGVRQRPWGKYAAEIRDPARKGARVWLGTYDTAVEAARAYDRAAFRLRGSKAILNFPNEVAFGAAARWAAAPAAAPQPSVTVAGNKRGRARSPQEQDAGCLLVREVKKERVQEPAAAAAGCGWDGKDTAASGGGADYFWEDESLKGAICSLPPLSPLSPHPHLAVPQLSVS

SEQ ID NO: 638 - protein, 344 aa, Sorghum bicolor
MTPLDCDMPPAASCKKRLSPSRPLPNRCLLILIVALAAAAAVASAQLSSEDYYDASCPAALFTIRTAVSTAVLLDRRMGASLLRLHFHDCFVQGCDASVLLDDTASFTGEKGAGPNAGSLRGFDVIDNIKMLLELLCPQTVSCADILAVAARDSVAQLGGPSWSVPLGRRDATTASASLANSDLPGPTSNLNGLLNAFSNKGLSSTDMVALSGAHTVGRAQCKNIRSRIYNDTDIDATYAASLRASCPAQAGGASDGALEPLDDATPDAFDNAYFGNLLSQRGLLHSDQALFGGGGATDGLVSTYASSADQWGSDFAAAMVKMGNISPLTGTDGEIRVNCRRVN

SEQ ID NO: 639 - protein, 542 aa, Sorghum bicolor
MAGHRNSHGKRHSDYTENGGGKRRNPGDDTYAPGPDDTVYRYLCASRKIGSIIGRGGEIAKQLRTETQAKIRIGESVPGCDERVITIFSSSRKTNTIDDAEDKVCPAQDALFRVHERLATDESIGNEDSEEISPQVTVRLLVPSDQIGCILGKGGHIIQGIRSETGAQIRVLSNDHIPACAISGDELLQISGDTVVVRKALHQVSSRLHDNPSKSQHHLASSLTQPYPGSTTHLGGSSTAPVVGITPVIPPYGGYKGDAAGDWSSLYQPRRDESSAKEFSLRLLCAAANVGGVIGKGGGIIKQIRQESGALIKVASSNSDPDDDCIITVSAKEFFEDPVSPTIDAAVRLQPRCSEKSDSESAEQSYTTRLLVSTSRIGCLIGKGGSIITEIRRTSRANIRILSKENVPKVAAEDEEMVQISGGLDVARHALVQIATRLKANFFEREGSLSAFPSVIPYHPLPSGASDEPKYLSRDTKPVGHYLYSSAFRTSDDMIPSDSYASYGGSQALGGGYGAYSGYSARSSGSGLSGHSSLHYGKRHGY

SEQ ID NO: 640 - protein, 532 aa, Sorghum bicolor
MEVAMTVTVTKVVLSLCCVGACGLAVYLYHILWLVPQRVLAKFKDQRIGGPRPSFPYGNLADMRAAAAAAKAARASACRSGGGGGGGIVHDYRPAVLPYYEKWRKEYGPIFTYSMGNVVFLHVSRPDVVRDINLCVSLDLGKSSYLKATHEPLFGGGILKSNGEDWLHQRKIIAPEFFLDKVKGMVDLMVDSAQPLLKSWEERVDRNGGITDIKIDDDIRAYSADVISRTCFGSSYIKGKEIFMKIRELQQAVSKPNVLAEMTGLRFFPSMRNKQAWELHKQVRKLILEIVKESGEDRNLLSAILHSASTSRVGIAEAENFIVDNCKSIYFAGHESTAVTAAWCLMLLGLHPEWQDRVRAEVHEVCGGQPVDSRSLQKMKNLTMVIQETLRLYPAGAFVSRQALQELKLGGVHIPKGVNIYIPVSTMHLDPELWGPDVKEFNPERFSDVRPQLHSYLPFGAGARTCLGQGFAMAELKILISLIVSKFVLKLSPHYQHSPTLKLIVEPELGVDLTLTKVQSFYTKRGTAIQAR

SEQ ID NO: 641 - protein, 781 aa, Sorghum bicolor
MEAMTGGKFLEKFRLYETRSKFYLIGRDKSRIHWRVLKIDRLESTELGVEEDPTIYTEDECQELLCRIHVGNMLTGGLKFVTKCYGIVGFVKFLGPYYMVIITRRRKIGTICGHEIYSVGKSEMIAIPSVIVWPNVAYSRDENRYKRLLCSVDLSKDFFFSYSYNIMRSLQKNISEKNTGQVVYETMCVWNEFLTRAIRNHLKNTCWTVALVHGFFKQSKLSVSGKDFWLTLIARRSRHFAGTRFLKRGVNEKGRVANDVETEQIVFEDTSDGIPTQIASVVQHRGSIPLVWFQETSRLNIRPDIILKPDVDYKATRLHFENLALRYGNPIIILNLIKTREKKPRESLLRAEFAKAIHYINKSLPDDKRLKFLHMDLSKLSRRKGTNVLALLNKVASDVLDLTEFLHCEISTSTKPDDTSSGEETVGRPLDDRSSRDQTECAAKLAPLLLQKGVLRTNCIDCLDRTNVAQFAYGLVALGRQLHVLGLIEAQKIELHDPLADDLMDFYERMGDTLAIQYGGSAAHNKIFCEQRGQWKAATQSQEFLRTLQRYYNNAYTDHEKQDAINMFLGHFQPQQGKPALWKLDSDQHYNIGRQGTLKEEIGRSFIKRSLSDGNILLENSLPITNCNNETNSTELLPMQQLDDIREPSDSAPEISICEPNPCSSMNYGTVPGRHSMSEERQSYLKRLGYPELHSSNFLDLDLLSSSGNSCDEEVFERSSLINSPMDVISVESSTSYSEQGHIDEGRDDTDLSRSSSQLSDVRDYSDRFAHWVANGGMLCY

SEQ ID NO: 642 - protein, 265 aa, Sorghum bicolor
MDADAGPERYGCVHYRRKCKIRAPCCGEVFDCRHCHNEAKDSLEVSIQDRHVVPRHDIKLVICSLCNKEQDVQQDCSNCGACLGKYFCAKCNFFDDDVSKNQFHCDGCGICRTGGAENFYHCDKCGCCYTSLLKDSHRCVDRAMHNNCPVCIEYLFDSTKAISVLHCGHTIHLECLYEMRAHQQFSCPVCLRSACNMSDIWQKLDQEVAASPMPAIYQKKMIWILCNDCGMTANVQFHILAHKCPGCSSYNTRQTRGDPAACSRV

SEQ ID NO: 643 - protein, 503 aa, Sorghum bicolor
MVPPEGAQTCWRWRPPPYKKVEWRHTWTTPNQTVLGVSLPPAASRAHPKPPRSPCLSPSRPPFAFAHPMATHGGENGSGHAAAEWRFARAAAAKDVAGADKMSIRAARFKISASVDARDPRPVLPLAHGDPSVFPAFRTAAEAEDAVAAALRTGKFNCYPAGVGLPDARRALAEHLSSDLPYKLSTDDIFLTAGGTQAIEVVVSVLAQPGTNILLPRPGYPNYEARAGLHNLEVRRFDLIPERGWEIDIDSLESIADKNTTAMVIINPNNPCGSVYTHEHLAKVAEVARKLGILVIADEVYGNLVFGDTPFVPMGVFGHIAPVLSIGSLSKRWIVPGWRLGWVAVCDPNKILLNTKIIASITNFLNISTDPATFVQGALPHILENTKEDFFKRIIGLLAETSEICYREIKDIKCITCPHKPEGSMFVMVKLNLYLLEGINDDIDFCCKLAKEESVILCPGSVLGMENWIRITFAIDSSSLLDGLERIKSFCRRHKKKNLLNGH

SEQ ID NO: 644 - protein, 665 aa, Sorghum bicolor
MPPAPAARKKRLVRAGLLTAAVGYFAFVLLFELPLLPFLASSSSPAATSSSSSLPFQHPRRRELEAAAAAFTSPYSPARPSKPAFPAAAPGPSSTPRLPIFSSLLLLPRPNATATPFDTTAADAFAAAKPHLAHLQSIPNPASASTSASAPASSPPPPTCPASISVHREQLPYDGVRVVELPCGLAVGSHVTVVARPRPARPEYDPKIAERKDGEAAVMVSQFMVELVGTKAVDGEAPPRILHFNPRIRGDYSRKPVIEMNSCYRMQWGQSQRCEGFASRPAEDTVDGQLKCEKWIHDDDNKSEESKMKWWVKRLIGRPKDVHISWPYPFTEGKLFVMTLTAGLEGYHVNVDGRHVASFPYRTGYSLEDATALSLNGDIDIESIFASSLPNSHPSFAPERYLEMSEQWKAPPLPTEPVELFIGILSAASHFAERMAVRKSWMMYTRKSSNIVARFFVALNGKKEVNAELKKEAEFFQDIVIVPFIDSYDLVVLKTVAIAEYGVRVVPAKYVMKCDDDTFVRIDSVLDQVKKGRNDKSVYVGSINYFHRPLRSGKWAVTYEEWPEEVYPNYANGPGYVISSDIAHYIVSEFDNQTLRLFKMEDVSMGMWVEKFNKTRRPVEIRHDVRFYQSGCYNGYFTAHYQSPQHMICLWRKLQSGSARCCNVR

SEQ ID NO: 645 - protein, 234 aa, Sorghum bicolor
METAAAAMLEAGVGRFSRAPAMATALLAEMWAPLAVALAALATLPSLLRRLQVIVLRLRSRGKEVVQSHIGTYYSPCAEEDGSADEDESSDEEAEDASSSDDDGEGEDLKRIGFYEGASDGVFPWGGAVVRTWQGLPRRFSGCASGIGGGFGGATGGAFPGAVRLWGASTASGGEPWWAAVCSADEGGCRRDGGAAAAAEADQVVVGWRREHASQQQQQRRRRRRAVPLAHTGQ

SEQ ID NO: 646 - protein, 594 aa, Sorghum bicolor
MAVEEAAESCGSHAAAAAASGGRAAGPATSSSSAAAAAALARKQQQQQRHKLEVYTEVLRRLQDAGPPDARAPGFDDELWNHFNRLPARYAMDVNVERAEDVLTHKRLLEQAKDPAQRPAFAVRAVQVSPILDGNQTDADSNTAGEEVASRLNRQQSIHPPAFGSSTNLEALALEASKSHQDHDSTSDNGRSLYRPMHEITFSTIDKPKLLSELTSLLGELGLNIQEAHAFSTNDGYSLDVFVVVGWHDEETEDLVEAVQKEIGRIEETQAWSSSHSWSTPVENIQIAENSAADHVEIPTDGASEWEIDVKLLKFGNKVASGSYGDLYRGTYCSQDVAIKVLKPERINADMQREFAQEVYIMRKVRHKNVVQFIGASTKPPNLCIITEFMSSGSVYDYLHKHKGVFKLPALVGVAMDVSKGMNYLHQNNIIHRDLKTANLLMDENGTVKVADFGVARVKAQSGVMTAETGTYRWMAPEVIEHKPYDHKADVFSFGILLWELLTGKIPYEYLTPLQAAVGVVQKGLRPTIPKHTHARLSELLQKCWQQDPAQRPDFSEILETLQRIAEEVGDEHEGKHKDRTLGGFFSAFRGRSH

SEQ ID NO: 647 - protein, 781 aa, Sorghum bicolor
MDCSQDSQEESHQRRENGEEAEKAADYGNALSRKEATEELLGCVVHSEEEAYRLYCDYGHRIGFSVRKGKQSYFIGTKNIRTKDYYCSKEGLKYDEPVTEANFNRPDTRTNCKAMIRFRVDEKGRWTVIRFVPVHNHQLAKPGERHMLRSAKSLAVGKSGVIDPSASTESHPINGFSNMTGDIAENSGYTIRECYNQVCMQNITIIEAGDSQSLVSYFKRRTNEEGMFYWDVQVDQEGRMTNFFYRDGKSRNDYGCFGDAIIFDTTYRTNKYNLICAPFVGVDHHWQNVVFGCAFLLDESVTSYAWVFKSFLESMGGRSPKSIFTDQDEAIMQAVEQVFPNTQHCFSYWHIVKNAQSHLGSLNTSQAFQSMFTKCMQGSDSEEDFKESWTAMIQEYKLQDNSWLIDLYAFHRKWCSAFNKDTFDGGINSSQWGEVSSNIFNGISDENTSLTRFALLLEKVVKDLRRNESEEDFRCSQTAPVRAIKHSTVLKQAAESYTHRIYKLFEAEFLDGCGATSCHETSSGGNLLRFGITMQGRGSKVWDVVLDTSTMEISCGCRKFERMGLLCSHALKVFTLQNVDTIPEKYVLKRWTKDARRSMYTLAQDDSTQQECTEAELAYRNRAMQYAYNLIIKSQELEESRKIFWDSLETGEKALEVFFEMRNMRTQAAKDANKNEKKKKKTSKGPNPKKAKQAPGVSSTDLELIVQTNEHQFQSSQDAQGNATIGRPYYYQVPQTFPNAPIQPNQMYMHPNMHTVPLCTPQDLSAFAIRPNSTFGGAKNI

SEQ ID NO: 648 - protein, 439 aa, Sorghum bicolor
MPPATGAVASPPAAAGTVLLGRYELGDLLGRGASAKVYLARDLLTGRSVAIKSFPNPRAAAAGDRPVAIEREAGILRRLRHRHVVRLHEILATRKKVHFVLDLAAGGELFSLVDASGRMTEDLARHYFRQLVSAVRYCHARGVYHRDIKPENLLLDESGALMVADFGLGAVAGTADGGGSLLRHTMCGTPAYVAPEILSRKGYEPAKVDIWSCGVVLFVLAAGYLPFNDASLVNMYRKIYAGRFRCPGWFSPALRDLLRRVLDPDPSARIDADGIVAHPWFRHGASDEELGRLMHGGGGEQEEEEEAWFGPVGESKADEEDREPTAFDILSFSPGSDLSALFLGAGKERVFVGEPVAAVVARVEAAGRKGGYRVRRDGKRATAVYVEEEESGVVVAKVSVFRIADAVSVVEVVKGDGPDAVVFWSELLEPAVKPPALSC

SEQ ID NO: 649 - protein, 429 aa, Sorghum bicolor
MATAARDRRLPPALPLATLIGRELRAGGSERPALRYGHAGFAKRGEDYFLVKPDCLRVPGDPASAFSVFAVFDGHNGVSAAVYSKEHLLEHVMSALPPDIGREDWLQALPRALVAGFVKADIDFQRKGEVSGTTATLVVIDGFTVTVASVGDSRCILDTQGGELQLLTVDHRLEENAEERERVTASGGEVGRLNLFGGQEVGPLRCWPGGLCLSRSIGDMDVGEFIVPIPHVKQVKLSNTGGRLIIASDGIWDALSNEAAAQACRGLPAELAAKLVVKQALKTSGLKDDTTCVVVDIIPSDHLTSPQLSPKKNQNKLKSLFRRRSHSSVGKLGGKSASIGSVEELFEEGSAMLEERLGRNLSLKAASPPFRCAICQVDQEPFEDLMTDNGGGYCSSPYAPWGGPHLCLDCRKKKDAMEGKRSSRSTACR

SEQ ID NO: 650 - protein, 342 aa, Sorghum bicolor
MARKCSSCGNNGHNSRTCSGHGRTTVFVGHGGIGGGGVRLFGVQLHVAGSSPMAMKKCFSMECLSSSTLSSAVTPTYYAAALAATTNSNSPSASSSSSLVSVEEAPEKMTNGYLSDGLMGRAQERKKGVPWTEDEHRRFLAGLEKLGKGDWRGISRHFVTTRTPTQVASHAQKYFLRQSSLTHKKRRSSLFDVVENADRAATSSIKDREQEQRLRLKDAAIATTASAAAPGTTTPTELPALSLGIISRPARRPEHVVLPPTSLSLQLPRCSAAMGSLALAAPKHTHPSSTLTPAATASSSQALPDLELKISIARPQSDVHQVQTGSSPPPPRTPFLGTIRVT

SEQ ID NO: 651 - protein, 1075 aa, Sorghum bicolor
MLRNGNEGMSTIPGFSQIQFEGFCRFINQGLAEELEKFPTIKDPDHEIAFQLFAKGYQLLEPSIKERNAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLAQVFDQTNPLTQTVHGRKVSCLGPGGLTGRTASFRSRDIHPSHYGRICPIDTSEGINVGLTGSLAIHARIDHWWGSIESPFYEISEKAKEKKERQVVYLSPNRDEYYMIAAGNSLSLNQGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISSDSHKILLSSSGKTISIPLVAHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKQIPHLEEHLLRNLDRNGVVRLGSWVETGDILVGKLTPQIASESSYIAEAGLLRAIFGLEVSTSKETSLKLPIGGRGRVIDVKWIQRDPFDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSEKNFRVNREDV

SEQ ID NO: 652 - protein, 593 aa, Sorghum bicolor
MAGSGEGGNGGVPAGGEVAMAPGVVTGGEEDAYGEDRATEDQPVTPWAVCIASGHSLLRDPRHNKGLSFTEKEREAHYLRGLLPPVVLSQDLQEKRMLQNVRQFQVPLQRYSALMDLQERNERLFYKLLIDNVEELLPVVYTPTVGEACQKYGSIFRRPQGLYVSLKDKGRILEVLRNWPEKSIQVIVVTDGERILGLGDLGCQGMGIPVGKLALYTALGGVRPSACLPITIDVGTNNEDLLKDEFYIGLKQRRATGQEYSELLDEFMAAVRQNYGQKVLVQFEDFANHNAFTLLEKYRTNHLVFNDDIQGTAAVVLAGLIAALKSVGGTLADHTFLFFGAGEAGTGIAELVALEISRQAKVSVEEARKKIWLVDSKGLIVTSRKETLQPFKKRYAHEHEPVKDLLGAVKAIRPTALIGSAGVGQSFTKEVIEAMSSINERPIILALSNPTSQSECTAEQAYTWSQGRAIFGSGSPFDPVKYNDKLFVPAQANNAYIFPGFGLGVVISGAVRVSDDMVLAAAEGLAEQVTPEHIEKGLIYPPFSIIRKISANIAARVAAKAYDLGMASQLPRPKDLVKYAESCMYSPVYRTYR

SEQ ID NO: 653 - protein, 201 aa, Sorghum bicolor
MGVHAKSMSWYMSPPGSPPAPGSAATEAQHALSSSPGGSSDASFDTNMVIILAALLFALLFALGLNSLARCLIRWARRASEGEDGGAGAGAGGLKKRALRSIPVEVYGACGADGAAVDADVCAICLGEFADGEKVRVLPRCAHGYHVRCVDTWLLSHDSCPTCRGSVLDGAKAAAAAAPAPAAGGSRRQGSEAAAIAVVIG

SEQ ID NO: 654 - protein, 306 aa, Sorghum bicolor
MASPAAGTPPFLTKTYAMVEDPTTDETISWNDTGTAFVVWRPAEFARDLLPKHFKHSNFSSFVRQLNTYGFKKVVADRWEFANDGFRRGEKHLLGGIQRRKGTGAVAAVPTPGIPTGIPISSPPTSSGGEPAVSSSPPRGSTAGVSGAVAELEEENARLRRENARLARELARARRLCDGVRHLVARYDQGRGGDEDLADGDEGHGGGGERPSGPGVKPMLFGVPIGAKRLRGADGDGDDVDDGEDGAAEENGEGNDEEQDEDEERHAARERGVKAARRNETSDLDVLTLSVRAAAAARTGGGSRDR

SEQ ID NO: 655 - protein, 295 aa, Sorghum bicolor
MDGGRKRGKADGAKGASAGAKRSRESESFQSGVGSKSKPCTNFFSTSGCPFGEGCHFLHYFPGGYQAVSKMTNLGGTTIASPGRMTMDGPPTPTVKTRLCNKYNTAEGCKWGDKCHFAHGEKELGKPKLMGSYMPPPMGPRPTGHFAPPPMASPGLATPASFGASATAKISVDASLAGGIIGRGGVNTKQISRVTGAKLAIRDHESDTSLKNIELEGTFDQIRNASAMVSELIVSISGNAPPQAKNPAGGTHRGGRTGSNFKTKMCENFAKGSCSFGDKCHFAHGDNELRKPAAA

SEQ ID NO: 656 - protein, 1037 aa, Sorghum bicolor
MERLESYLKEHFEVPAKNPSEEAQRRWRSAVGLVKNRRRRFRMVPDLDRRSQDEAQRQSVQEKIRLALVVQKAAITFIDGAKHKEYRITEDIIKAGFSINPDELASITSKHDVKALKMHGGADGISKKIRSSFDHGISANDLDTRQNIYGVNRYAEKPSRSFWMFVWDALQDMTLIILMVCALVSAVVGLASEGWPKGMYDGLGIILSILLVVMVTAISDYRQSLQFKELDNEKKKIFIHVTRDGSRQKISIYDLAVGDIVHLSIGDQVPADGLYIHGYSLLIDESSLSGESDPVYISQDKPFILAGTKVQDGSAKMMVTAVGMRTEWGRLMSTLSEGGEDETPLQVKLNGVATIIGKIGLMFATLTFVVLMVRFLIEKGLTVGLSKWYSTDALTIVNYFATAVTIIVVAVPEGLPLAVTLSLAFAMKQLMNDKALVRHLSACETMGSAGTICTDKTGTLTTNHMVVEKIWISEVSKSVTSNNSLEDLTSAISPATLSLLLQGIFENTSAELVTEKDGKQTVLGTPTERAIFEFGLKLEGLDAEDRTCTKVKVEPFNSVKKKMAVLVSLQNGMYRWFTKGASEIIVQMCDMMIDGDGNSVPLSEAQRKNILDTINSFASDALRTLCLAYKEVDDFEDDADSPTSGFTLVSIFGIKDPLRPGVKDAVKACMSAGIIVRMVTGDNINTAKAIAKECGILTDGDVAIEGPEFRSKSPEEMRDIIPKIRVMARSLPLDKHTLVTNLRGMFREVVAVTGDGTNDAPALHEADIGLAMGIAGTEVAKESADVIVLDDNFTTIINVARWGRAVYINIQKFVQFQLTVNIVALVINFVSACITGSAPLTAVQLLWVNMIMDTLGALALATEPPNDDMMKRPPVGRGESFITKVMWRNIIGQSLYQLVVLGVLMFAGEQFLSIKGADSKSVINTLIFNSFVFCQVFNEINSREMEKINVFRGMVTNWIFIAIIAVTVVFQVVIIEFLGTFASTVPLNWQHWLLSIGLGSVSLIIGAILKCIPVTKSNEVPASPNGYAPLPSGPDDI

SEQ ID NO: 657 - protein, 810 aa, Sorghum bicolor
MALTRLLMMASRPPCSLSLSLPSPSYKTSRCCCCHCHRGRRLLRSAMRVGACHDLSTVTPTPRQQSMAAQLERGSLLVGGRELLVRAPPNVTLRPAGEAAAAADSGAAFLGATAAAASSRHVFSVGNLASGWRWLSLFRFKIWWMIPATGAGAAAMPAETQMLLLEYRSEARTERGSLYALMLPVLDGGFRASLQGSPEDELQFCFESGDPDVQTMEAVDAVFINSGDNPFKLLKESIKMVSKIKGTFSHIEDKEIPSNLDWFGWCTWDAFYKAVNPSGIEEGLQSLREGGVPPRFLIIDDGWQETVDEFKEGDEAIREQAVFAHRLSDLKENHKFRGETCKNLEDLIKKIKEKHGVKYIYMWHALLGYWGGVLATSDAMKKYNPKLLYPVQSPGNVANLRDIAMDSLEKFGVGIVDPDKIYEFYNDQHSYLSSVGVDGVKVDVQNVLETLGRGLGGRVAVTQKYQQALEESIAQNFKTNNLICCMSHNSDSIFSALKSAVARASEDFMPREPTLQTLHIASVAFNSLLLGEIFIPDWDMFHSKHESAEFHGAARALSGGGVYVSDKPGVHDFNVLKKLVLPDGSILRARYAGRPTRDCLFTDPVMDGKSLLKIWNLNNFTGVIGVFNCQGAGQWVWPVKETAYVPINVNIIGQLSPSDVESLEEIAGDDWDGETAVYAFGSCSLSRLQKHKSLEVSLSTMACEIYNISPIKIFSEAVWFAPLGLIDMFNSGGALHNVSSVADSSATTVHIRCRGPGWFGAYSATRPELCRVDEHEVEFTHAEDGLLTFYLPLSSSQDNLRHIEIVYRAL

SEQ ID NO: 658 - protein, 476 aa, Sorghum bicolor
MATPTVVLLPVWGAGHLMPMVEAGKRLLASGSRRALSVTVLVMRPPTEQHASELEGDIRRAEEAAAGLDVRFHRLPAVKPPTDHAGPVEFISRVVQLHAPHVRAAVSSLSCPVAALVLDLFCTPFVDVARELAVPAYVYFTCNAAALSFFLRLPALCEEVAGEFGEMDGAADIPGLPPVPALSLPTPIMERKKPDCAWYACHGRRFMDADGIIVNTAAELEQGVLSAIAKGRCTRGTGSRPAPTLYPIGPVISFPPPAAEPPHECLRWLESQPPASVVFLCFGSGGFFTAPRAHEAAHGLERSGHRFLWVLRGAPAPDTRSPTDADLAELLPEGFVERTRNRGLVWPTAVPQKEILAHAAVGGFVTHCGWNSVLESLWFGVPMAPWPLYAEQHLNAFALVAAMGVAVAMEVDRKRDNFVEAAELERAVKALMGDGEEGRKAREKAAVVQAACRNAVDDGGSSTATLSKLCNDICRQ

SEQ ID NO: 659 - protein, 160 aa, Sorghum bicolor
MMMAEVANHSKRNHTDSYFSGKAAAVAVAATGPEEFASMSSKKPRNTSPRIAPVSPKEKKDKIGERVAALQQLVSPFGKTDTASVLQEASGYIKFLHQQLEVLSSPYMRAPPAPGAVPEDPEHYSLRNRGLCLVPVDLTLQLTQSNGADLWAPANTTRRR

SEQ ID NO: 660 - protein, 396 aa, Sorghum bicolor
MGIYERQRHLVAAGVSVWGEPFRPDADALPLSAVVPTVTLATPPAPPLDVVEAEEVKFGKHQLLQAQQYDFPPQVEEEAPPPSSDSFGHDHDDDAARPRDKIQRRLAQNREAARKSRLRKKAYIQNLETSRMKLAQLEQELTMARRQQQQQQHGAYGVGGGGGGVAAAAGADPRVAAFELEYARWVEEQGRQATELRAALQSHAPEVQLRVLVDAGLAHYGALFQAKAQAARSDAFFVLSGVWRAPAERFFLWIGGFRPSELLKVLAPRLNPLMDHQAAEVRKLQNTARQLEDALSQGMSKLQQTLVDALMTVDVASPLGAGGGYAAQQMASAVGKLADLVDFVDKADHLRQQTLRNMHKILTPRQAARGLLALADYGQRLRALSSLWAARPREPA

SEQ ID NO: 661 - protein, 314 aa, Sorghum bicolor
MDGSSKRIDGGGADKPSPDNDQNQNASPNVPAASAAGDDGASVAAAAAAAAAPPADGRRPFTSLSQEEADLALARVLQEQERAYMMLTGGEYAISDAGSYDYDEEEGEDDDDGSDYEEEGEALDEDEQVGDAEAEGAEGDQDLDLDPAQYEDDEAFARALQDAEERDVADRLMALVGIGDWRAMEQDDAGDHEEDEDDGVHTQDAWEDVDPDEYSYEELIALGEVVGTESKGLAADTIASLPSVTYHAQDKQDGNMEQCVICRVEFDEGESLVALPCKHPYHSECINQWLQLNKVCPMCSAEVSTSANNVNKQA

SEQ ID NO: 662 - protein, 596 aa, Sorghum bicolor
MDSDVEMNAASDEEVMDDEDYYDYCDSDMGDDGDGGSEEEEELVAGDYDEGIEAEGTDEVVSRREQTFVVLNEEVISERQAEDVSKVSAVLLITREEACALLHHYKWNISKLSDEWFADEEKVRHTVGLLLNGNHDPCSRKLTCGICFEGYSSDMMSSAGCAHFYCHECWEGYISAAIGGGPGCLSLRCPDPSCSAMVLQGMINKLAKDEDKEKYARFLLRAYVEGSKKTKWCPAPDCTCAVEFLGDENYDVSCNCKFSFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETEARRERAKNSLERYMHYYERWASNQTSRQKAQADLLKAEKDQLANLTDIFGIPETQLKFIIEAWSQIIECRRVLKWTYAYGYYLDDKVKSEFFEYLQGEAESGLERLHQCAEKDLQKFLPSVKSDSTETTAPTPDEFSEFRVKLAGLTSVTRNYFENLVQALEAGLEDVRATAQAAGTSSAATSSKKGGTKSKKKQPTKPSSDHTDDGWPCERCTFLNPPSVDACSVCEKSRY

SEQ ID NO: 663 - protein, 461 aa, Sorghum bicolor
MARWAEMVEDDDDDEYAKLVRRMNPPRVVIDNDACDNATVIRVDRVKKHGILLEAVQVLVDLNLVITKAYISSDGNWFMDVFNVTDQDGSKLQNREVIDHIQKCLESDGYLPPPANGGFVPPEDQFTSIELTGADRPGLLSEVCAVLAALSCNIVKAEVWTHDRRAAAVIQITDEATGLAIHDVGRLSRAQELLSNLMQSDGRCNRGATGVSVGTARTERRLHKMMLDDRVGGGEEAVGGGEERGGCGKARHKAAKVVVMDCTERQYTVVILRCRDRPKLLFDTLCALNDLQYVVFHGTVDAEGASKEAYQEYYIRHVDGHPVRADAERTRLVRCLEAAVERRASNGLELELEVRTEDRVGLLSEITRVFRENSLSIIRAAITTKDGKAEDTFYVSDTYGNPVDGRTIDAVGEQLGHAVLRVKRRGHDASVKHEAEGGAVSVLGSLLKGSFQGLRLIRSYS

SEQ ID NO: 664 - protein, 173 aa, Sorghum bicolor
MTKDETLLVFTLVVSSVSIFLFGILLFRVLISATRDFRERTKSKLVKIMIWAGIVVITFAIAVRIYPIFIFLLKERIKPLVEALYDKLPWIWEVSLSRYWDRLIDFLDRYLWACAQRIQTGIRKQKGEFVVTFSCRVKKRLYARAIEVGIHLSLLSNLFWILKTTLAVGYRLL

SEQ ID NO: 665 - protein, 615 aa, Sorghum bicolor
MGLFSSPPKVYKPAADVDLGAGSDEFYISPNVKAPRVAGLLVKIFVWILEMPIVGPIVLYILKKDNLINKLVSDADIPEPPLFTATHSWEDIPEQNVRLTKPDLSAAERVQEAVGCLPARLEATLAADAPSVGLRRWTVRDFHDAYRSGETTPVQVATRFLAAVRESSSSAGPAGMNMAFFISCDHDDVMRQAEESTLRYQRGAPLSALDGVLVGVKDEIDCVPYPTTGGTRWLGAARRCEADAACVAQLRACGAVLAGKANMHELGAGTSGINPHHGSTRNPYNASKVAGGSSSGSAAVVCAGLCPVALGVDGGGSVRMPAALCGVVGFKPTAGRLSNAGVLPLNWTVGMPGILAGTVEDALIAYSAIVDQSQPSYLRPELNLPQLSSTPSIGNIKLAKYGKWFNDSAEDIRSCCDKALQALHAHYGWQTVDVTIPEIEEMRLAHYVTIGSECTTSLAKYLDNLKRSEIGWDARVALSVYGSFSSRAYLNSQRLRNRQMYFHKQIFKTADVIVSPMTGVTAYTLQDDALNTGELDYINGAALVRYSIAGNFLGLPAITVKVGYDRGGLPIGLQFIGRPWSEATLLHVAFATQQACADGYKKPAVFYDLLTKQHQ

SEQ ID NO: 666 - protein, 655 aa, Sorghum bicolor
MVKIEDHAEDGGIDADVRGLGEAAVDPLPGSVHATFKEEEGEPSSSSGKLRSEFIGMGFSSKLVDKVLQRHGDDDSNTILESLLSYSDLKQSGSESSGSLGSLFDSDNEENNSSLESRKVINQDIKPELDSFSEKWSFLLRTMNFSQQEVDLAFKQLGDEAPLEQLVDFIVNAQSGVSSGGPENGDATNEGKTELLYGVMEKTLSLLQMGFTEEEVSSVLENSDQRATIQELADSILARRIANSIEQKEVKIESDFLGEAEPDYSSYQPSYSAASYYDDDNNNIRVKRAKHVFIDDTGASSSHLGNPWSMGTSDMPVKVELEAMTPGRRANVQGDLAKPPFFLYGNMVDIPKDTWYQLTQFLYNVEPEFVNSQSFSALTRKEGYIHNLPVEKRRVVVPKSPMTIEEALPFTRQWWPSWDTRKHISVVTIEVGEIEQTCERLGSMVRESRGVLSEARQMQIIHQCRVSNLIWVGQNKLGPLEPRQVERILGYPHNHTNLFELNQSDRFGAMKFAFQTDTLSYFLSVLKGMYPDGIRVLSIYSGIGGAEVTLHRLGIPLKCVISVEESEVNRKILRRWWSKTEQTGVLRQHPGIWKLKTHVIEDLVKEFGGFDLIIGGNYTSCKGGNTVNTTMGLDSNRFYEYARVVKRVRTAVGLS

SEQ ID NO: 667 - protein, 556 aa, Sorghum bicolor
MQHDQKKKAPSEMDFFTEYGEGSRYKIEEVIGKGSYGVVCSAMDTHTGEKVAIKKINDIFEHVSDATRILREIKLLRLLRHPDIVEIKHILLPPSRREFRDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKARRYLSSMRRKKPIPFTQKFPNADPLALSLLERMLAFEPKDRPSAEEALADPYFKNIANVDREPSAQAVTKLEFEFERRRVTKEDIRELIYREILEYHPKMLREFLEGTESSGFMYPSAVDHFKKQFAYLEEHYAKGSTGTPPERQHNSLPRPSVVYSDNRSQTTANITEDLSKCIIRENTQKPHQHSAYVASKFPPHVPQGVVARPGKAVGSVMQYNPYPASAAEQYEQRRIARHPAVAPNNIPSGSSYPRRSQTCKSETGDAERMDVNQAGQPKPYAANKLPATVDGRGGHW

SEQ ID NO: 668 - protein, 453 aa, Sorghum bicolor
MARRRPPPFHARVAAAVFLLLLLTPAPTSQLGLGAAIAAWIHGSPPAPPSPSTDDDTATASSSGAPASSPRSQEYAALQALKAAVTEDPNGALSSWQGANVCAYKGVYCSAPPDGAAAAAAGALSTVVAGIDLNRANLRGTLPDAMSLLAHLTFLHLNSNRLGGAVPDTLRDLQYLTELDLSNNLFSGPFPSSTLLIPSLVYLDLRFNAFSGEVPPEVFAKELDAVFLNDNQFEGQIPDTLWGSPATVITLANNHFTGAVPAAYEFGAGGGGRVREVLFLNNNLTGCVPEALGFLPSIEVLDLSYNALSGHVPGTLSCLSGIEVLNLAHNQLTGELPDLLCDLRRITNLSVSFNFFSGISQRCDRQLGSRGVFDFVGNCVPGRDMQRPQPECDEFPGEGGLSCLHIPGARPAGCDGGGGGGVTIGVGVGVGVGGLPFGLPGAAAGGVVTVTVP

SEQ ID NO: 669 - protein, 679 aa, Sorghum bicolor
MASGATSDAWPSSPYSSSAPDGEVLRSLHRLARDLSAAEAPAPFLRAVFAAVARRARLLAAVFDDLLLCGAAAGPLLLLPRSASLCLRELLLVLQRFKALVADCAARSRTRLLLQSDEVAARARELQHDLATLLDLLPVADLGLADDVSDLLALASRQCRRAVAAPELELKAGVLALIQEVEREIVPGRERLEGVLEDVGINDPASCSDEIETLEREIGDRVAERWTSSMIALVGLLRYAKCVLFSAATPRPVDSNKVDLDDGDGDDGAEPPSPPLDFRCPISLELMADPVVASSGQTYDRDSITRWFGSGKSTCPKTGQVLPNLELVPNKALKNLISRWCRENGIPMESSESGKSEPAPVVVGANKAAQKAARMTASFLVKKLSASFSPEATKRVVQEIRQLAKSGSDNRAFIGEAGAAGLLVPLLRSEDSALQLNAVTALLNLSILEANKKRIMHAEGAVDALCHVMCSGATWRAKENAAATVLSLAAVHAYRRRLGRNPRVVDSVVQLARTGPASTKKDALAALLCLSAERENVPRIVEAGAAEAALSAIGDAEAAAAVLASLAKRGGAEAIVALDGAVARLVAEMRRGTEWSRECAAAALVLLCRRAGAAAASQVMAVPGVEWAIWELLGTGTERARRKAASLGRACRRWAAAANAEQGTECPTSGDASGLTVAS

SEQ ID NO: 670 - protein, 479 aa, Sorghum bicolor
MKKTVVLYPGLAVSHFVPMLQLADVLLEEGYAVVVPFIDPTEKGDIALAAVIDRVAASKPSVVFHVLPRTEDSPCTFVHDSEFIVRYLEIVGRYSQHLHDFLLSMPPGSVHALIVDMLSIEVLDVTTKLGIPAYAFFPPNASALAVSVQAASLHSEGQQPSFGELGDAPLNIHGVPPMPASHLNAEMLDDPGSATLKATVNMFRRIQEANGILVNTFASIEPRAVSALSDPRSFPKMPPVYCIGPLVTGKGSQGTEKKHECLAWLDEQPEQSVVFLCFGSTGAGNHSEEQLKEIATGLERSGHRFLWVVRAPPHDDPEKPFDSRADPDLDALLPAGFLERTGGRGRVVKLWAPQVEVLHHAATGAFVTHCGWNSVLEGIIAGVPMLCWPLYAEQKMNKVFMVEEYGVGVELVGWQQGLVKAEEVEAKVTLVMESEEGKLLRARVSKHKEGAAMAWKDGGSSRAAFAQFLSHAGNATGRG

SEQ ID NO: 671 - protein, 416 aa, Sorghum bicolor
MRGSADAVAVARDVASSSPSKPPSALDMMRYPRPSSDGLPLPNGIGSGVSKKPAAAAAPAPPAPRSSKDDVAPPTVATDSSRLAAFLATTSLESKPRPRVPQVQPQPQPPAQAAPTSAPTAAAAVTKSPARDQGHGGSGQHPSSDHSDPASPSSTGAGELLLQWGQNKRMRCRRDSASASASPQRRQAGGNKIQRRSSSPLPAADKLMPPPSTAPYTRASNLRSASPLPPRSGSGSSGGASDAHHPRPHPFRSAEDRAAGKFSAAAARAEKQRAVSPHKVGPGSVMGLGVPDPKQHQQYNQGGSGSGQHQQQQAGAVAAAASTKPAPKLEVPRIYTTLSRKEKEDDFMAMKGTKLPQRPKRRPKNVEKTINLICPGMWLTDVTRSRYEVREKKCPKKQQKNRGLKGIEMESSSDSD

SEQ ID NO: 672 - protein, 307 aa, Sorghum bicolor
MEERIPQRPREAQAPTVAQPAPTTGKPCDDGDALAPAIQLLSSSSSGEESSDDEGELEFEFPFVSRDSPAGTAAPADELFADGRIRTFYPVFGRGASSHGGCTTRPAAPAAAPPRVRGQLGKLFLEETRERNSSTSSTSSSSSSSGAATDDDGLEGVAPESYCVWRPGSSASPSPPTPPRKSGSTGSMARWLRISDLAVGRSHSDGREKFLFLAAAPAHDAPRRSKKPAPVPARPAGARKPAPSAAVAAADADTAAAHRIAHLARGGLGVPVPPGGTPRRTFLPYREELVGFFANVNGISRSHHHPF

SEQ ID NO: 673 - protein, 285 aa, Sorghum bicolor
MAAAGAALRLRLLYRMLRVGELLALVAFLSWSSSRVPSAAAAALRLAGSLLLNARFVFVLGNAIVLLLLALSRHDLSASSSSSGQQTSTAAATSTSAAPPPQDAAPAAASDSFPSSFAGTPITPPPPATSLEAFSALPAAPATEPAAAALNTGTAFDDRPLQAASAAVARVSKQARAPRRSRSEKMGPRVLQLRRAASPPPTPELRRSESENGRRRSSVSARDARACGWGADDADEFRRTVEAFIDKHKRFHRQESMTMAVVAGSGSSGHCEAAPAFTGALAVVE

SEQ ID NO: 674 - protein, 395 aa, Sorghum bicolor
MGVGKLMNDVKPYLAMVLLQVGFSGMYIVSVASLKRGMNHFVLVVYRNLVATVVMAPFALIFERGVRPKMTPLIFLKIMGLAVLEPVLDQNMYYLGAKLTSATFGSALVNILPAITFLLALVMRMEKLRLRSLHSQAKVVGTVCTVAGAVLMILYHGPVVPFPWSAAGHHHASAAAAAAASQSSASWLYGTVMIIGSCLCWSGFFILQSNTLQSYPAELTLATLICFLGSVLTGGVALVAERHDMSAWVIGFDTRLFTAVYSGIVCSGVAFYVQGIVTQARGPVFVTAFQPLCMIITTVLGSTILKEETTLGSVIGAVIIVVGLYCLIWGKSKDHLGSNGKPGAAAVAGELPLTSAPTANNGSYGKHAALGGGHHVVTGVETTPPPPPCVPKCVH

SEQ ID NO: 675 - protein, 419 aa, Sorghum bicolor
MATVSMDIPKPSALTAAGHEAATAKTRGGGEGLGKYYNQHIQDLLLAVQQRISDLSRLEAQRNDLNSQVKMCREELHLLQEPGSHVGEVVKVMSKSKVLVKVHPEGKYIVDVDKSIDIAKLTPSTRVALRSGSYMLHVILPSKVDPLVNLMKVEKVPNSTYDMIGGLDQQIKEIKEVIELPIKHPELFESLGIAQPKGVILYGPPGTGKTLLARAVAHHTDCTFIRVSGSELVQKYIGEGSRMVRELFVMAREHAPSIIFMDEIDSIGSARMESSGSGDSEVQRTMLELLNQLDGFEATNKIKVLMATNRIDILDQALLRPGRIDRKIEFPNPSETSRFDILKIHSRRMNLMRGIDLKKIATKMNGASGAELKAICTEAGMFALRERRVHVTQEDFEMAVAKVMKKDTEKNMSLRKLWK

SEQ ID NO: 676 - protein, 220 aa, Sorghum bicolor
MSVVAAVGPGAAAAAAAAAGAYGHGQPLCGGGGGGARKRKDVGVVQDQEAGLRGSHVGAAAPRRGAGLFVLETVEEEAEAERLSSIGAVSEDEEEDGEEVNSGGTSSSTTKGAALASMDMDALDDALPIKRGLSNFFSGKSRSFANLQDAASAVTSARDLAKPENPFNKRRRVLRCCSIRRVASTSLTELPPFFLPPTTDPGSTGDDDDGCGAGGRRHSG

SEQ ID NO: 677 - protein, 371 aa, Sorghum bicolor
MAMAFHFHPLAATRVHLSPLPFAAAAAAGAPSPSSSSVAIAAPHHHHGRRRFSAVVATAAASAAATTEFDFKAYMGERAVAVNRALDAAIPAGEPPAALHDAMRYALLAGGKRVRPALCLAACAVVGGPEAWAMPAAAAVEMVHTMSLVHDDLPCMDDDDLRRGKPTCHVVYGEPIAVLAGDALLSLSFHHMASVGSYPPDVDPEKHPARVVRAIGELARCIGSEGLVAGQVVDLEMTGTSEPVPLERLEYIHLHKTAALLEASVVIGAIIGGGTDEQIERLRKYARSIGLLFQVVDDILDVTKSSEELGKTAGKDLASDKTTYPKLLGLEKSREFAEKLLSDAIEQLDCFDKEKAAPLLHLANYIAHRQN

SEQ ID NO: 678 - protein, 124 aa, Triticum aestivum
DLKPYLGEEDELPSRTTSFQEGEDDEDINTIVTPTAPAAIHTGPITRARARQLNYQVLSFLGNDSNVHENMMLPKLDTFVLLTNEGPSLEKDEHWSKNKHGDDGMRKGNKNGVTSDDFRTLKPP

SEQ ID NO: 679 - protein, 143 aa, Unknown
  Sequence found in Organisms: Pseudoroegneria spicata, Secale cereale, Triticum aestivum
MAAALSLRAPFSLRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 680 - protein, 525 aa, Triticum aestivum
MGDDHGAKLVKSLRGAAQKYVGVGFFLGFFLVLLTYFTLSEQFAIAAPNAIRRTSAAHPTPTTPAVAEKTVQQQQLPVKKEEAPLPEHEQVQEKPPPVDEEPHRETEEPNSETEEDPKPIDEASKIVTTAEESAPAKKPACDIQGPWASDVCDLAGGSGGVRIHGSTHTVLVPPTIESGGSNPNPQEWRVLPYSRKHMSGIKEITVRELPTAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPTKEPTGHSMPEFTKFLRNVFALPRAAPMRVTAGLISDKKPRMMIISRRHPRKLVNVAEVVALAKRIGFEVVIGDPPFNVDVGDFAREVNAADVLMGVHGAGLTNSLFLPTGAVFIQVNPFGKMEHIGEVDFGTPAVDMGLKYMAYSCGMEESTLVDTLGRDHPAVKDPESIHRSGWSKVAEYYLGKQDVKLDLQRFEPVLLKAMAMLRE

SEQ ID NO: 681 - protein, 131 aa, Triticum aestivum
MASTGVKDFYRQKKKGGVGKTSASSKKKTQNYTGGASVGASNKAQTAALISHGSLDLKDDFSEQEEQLRQFDMDMKFGPCIGVNRLQRWERASAMGLQPPPHLRDLLARASSGNNRNNGGPSPECLWEGKI

SEQ ID NO: 682 - protein, 441 aa, Triticum aestivum
MSQVRIVDASYVDVPETAVRPPGPIKLTAMEALWIVIPVLQHVLLYEGDDDTPPFDAIVQSLRSSLAATLRSFAPLAGKLVHLEETGDVGISCSASDSVRFVVAECDADIGRLAGDEEHDLRVLEGLVPEVDMSLLPTPVLAVQATRFQGGVAVGVTVHHGVADGRALWTFVEAWAAACRGETPATTPCFDRSLVKLPGGEELARSVVRKVAPNLPSVALASSVFEDRKRLIRRTFTLDEGDIQRLKQHIVHLNESGGTPLPRPPSAFATVVALAWTCFARCKSFSLEDDVWLFFFADIRERLDPPVGAGYIGSCLTKCLARLPARELHGERALAAAAAAVQGEINKMKEDPIAGWNFFSFDPMPSMDRLMNISGSSGFSAYQIADFGWGKPRRTEPIRMNSDGQVALMGSRDGRGVQVSVALLQAAQMDEFKSNFLALLE

SEQ ID NO: 683 - protein, 347 aa, Triticum aestivum
MGSNDPSTPSKASKPPEQEQPPATTSGTTAPVYPEWPGFQGYPAMPPHGFFPPPVAAGQAHPYMWGPQHMVPPYGTPPPPYMMYPPGTVYAHPTAPGVHPFHYPMQTNGNLEPAGAQGAAPGAAETNGKNEPGKTSGPSANGVTSNSESGSDSESEGSDANSQNDSHSKENDVNENGSAQNGVSHSSSHGTFNKPMPLVPVQSGAVIGVAGPATNLNIGMDYWGATGSSPVPAMRGKVPSGSARGEQWDERELKKQKRKLSNRESARRSRLRKQAECEELGQRAEALKSENSSLRIELDRIKKEYEELLSKNTSLKAKLGETGGGGDAVPDMNERGDTNGGSHQKEP

SEQ ID NO: 684 - protein, 317 aa, Hordeum vulgare
MSSKKIELDHKDMVHDSAIDYYGKRLATASSDSTVKITNIGGASAPSQLVATLTGHYGPVWRVGWAHPKYGSILASCGYDGRVIVWKEAATGQWSQLYVFDNHKASVNSIAWAPYELGLCLACGSSDGTISVISMRLDAGGYDAATIERAHPVGVTAVSWAPAAPLGSMVGSGQLVHKLVSGGFDCVVKVWEFVNGGWKLESAMVSDMHKECVRDVSWAPVLGLAKSTIASASQDGKVVIWTSGKAGGKWEGKLMRDFEAPVWRVSWSLTGNILSVAAGEGDITLWKESSDGQWESLWTKASEEPPQEQAAIEEAMQ

SEQ ID NO: 685 - protein, 259 aa, Brachypodium distachyon
MDATTAASLPRLSVPPAPRPTITPSRFRPNDAPVPSRRRLSLRFHRSPVAAAAAASSPSATSSSPEPGSGIGDALGGVSIFSAATGEPVLIRDLWDQNEGMAVVALLRHFGCPCCWELASVLKDARERFDSAGVKLIAVGVGTPDKARILAERLPFPLDCLYADPERKAYDLLGLYFGVGRTFFNPASVKVFSRFESLKEATKNYTIKATPDDRLSVLQQGGMFVFKGKELLYARKDEGTGDHAPLDDVLDICCKVPVA

SEQ ID NO: 686 - protein, 511 aa, Zea mays
METTEMAAAAAAALCCALALYLYHALWLAPGRVRAALRAQGVAGPRPSFPYGNRADMRRATAAHRGGGGGVVHDYRQALFPHYERWRKEYGPIFTYSIGSMVFLHASRSDVVRDLCLSVSSLDLGKSSYMKVTHRPLFGDGILKSSGEAWAHQRRLIAPEFFPDKVKGMVDLMVGSATALVASWGDRTGGGGVELKIDDDIRAYSADVISRTCFGSSYVKGKRIFAAIRELQKAVSKPNLLAEMTGLSFLPTRTNREAWRLNRVVRDLVLDVVREGGDDDRNLLNAMLRSASSSGGCSGDRVAVEEFVVDNCKNIYFAGYETTAVTAAWCMMLLALHPEWQDLVRDEVRQACGGGDFASLHKMKKLTMVIQETLRLYPAGAVVSRQALRDVTLGGVRVPAGVNIYVPVSTMHLDPELWGADAREFDPGRFADDHQRQRQPHAYLPFGAGARTCLGQAFAMAELKVLLALVLSRFRLALSPAYVHSPALRLIVEPEHGVRLLLTNVEPRGAS

SEQ ID NO: 687 - protein, 273 aa, Zea mays
TAKHLYKTPIPSTRKGTVDRQVKSNPRNKLIHGRHRCGKGRNARGIITARHRGGGHKRLYRKIDFRRNQKDISGRIITIEYDPNRNAYICLIHYGDGEKRYILHPRGAIIGDTIVSGTKVPISMGNALPLTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRK

SEQ ID NO: 688 - protein, 246 aa, Sorghum bicolor
MPKIKNLSNACKVSFSPQGPISEEALERVRALLDEIRPLDVGLDNEAQIARNWTSTTRPSNGRRGRNGANQFAAPIKYLHIHESESFSMGIFCMPPSSVIPLHNHPGMTVLSKLLYGRLHAESYDWVDVPDHPIDQLQSRPAKLVKDCEMTAPETTILYPNAGGNIHTFRAITPCALFDVLSPPYSAEDGRHCSYFRKSLMNQPPVVLPAEIDSSQVIWLEELEDHQPPEGFVVARGLYKGPVIRR

SEQ ID NO: 689 - protein, 369 aa, Sorghum bicolor
MPSLGGQGEEEHGEKGNEDNSGESEVINPPEEASGEATSPMEGRKPRLGLSKGNQSHGPKAIKSKSPRSGDEGQARRKGVNSSLPKAPIVQVSHGDAGVGSNKAGKNESRSSPMDATLLDDSKEKRKTQKPSAQLSSIKRDEEQSNGESAKPRKVGSTPSYGFTFKCDERSEKRREFYSKLEEKIQARELEISNLQEKSKETEEAELKMLRKSLNFKATPMPSFYKEPTPAKVELKKTPPTRAKSPKLGRSKNKSTPETEENTTMDQSARLSLEEKVSQNGVKKSTPLNSAKKPQRKSLPRLPSEETGPLDATSRQLKNTKLNAVNTQETGSATEQVQGSETKTDSVQGPIEAGANPDEQDVAEQSVVY

SEQ ID NO: 690 - protein, 531 aa, Sorghum bicolor
MATGTDRPWWAPPPPPPAAVPSAPRFPSPPSPSSSFTADPPAEFLCPISGTLMADPVVAPPGQTFERACIQACAALAFSPPAVAADLSQSHHSSSSSSPLVLVPNVALRTAILNWCDRLALPHPAPLSPDTAHDIVRRLMPPQQRSSLAQPQRPQTQVASSVRVRRPSVFDGFAQVQEPSSRQRGDALEEEIMAALGADGATPAEQASAMALLRQATRENQEVRRQLCTPRLLAALRPMLLSPDADVQVNAAAAVVNLSLEPENKVRIVRSGAVSPLVDVLRGGHPEARDHAAGAMYSLAVEDENRAAIGVLGAIPPLLDLFAGAGATGHRARREAGMALYHVSLSGMNRSKIARAPGAVRTLLSAAEARDRASETDAAALRRLAVMVLANLAGCPDGRAALMDGGAVAAVVRLMRNGSVAPGSAEQEYCISTLYGMSRGSMRFRGLARAAGVEAALQPVAEGEGGVGRDLARRTLRAMRGEDDDAPVTATGLLGRQWDDGSVVSEGLVSIRRPPHRSNYAGPSGSNTTQF

SEQ ID NO: 691 - protein, 405 aa, Setaria italica
MADDGEPSITRWTFEDFEVYYEVRLGIRREPAEGDGDDRDDGRPPLRGSDQLSGRPAVSRANGGADLAVFEQFERMERKVEMRNGAIEDGPPQKPLLPSFESAETRNLAETLLRDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARHAMFEELLPSTTGTMEIPYDVLVEKTEGYSGSDIRLVCKEAAMQPLRRLMTVLERNQEVPEDELPEVGPVTTEDIELALRNTRPSAHLHAHRYEKFNQDYGSHVHG

SEQ ID NO: 692 - protein, 69 aa, Zea mays
MGFWATTLIFVLAGVAASLFTLLCCNRGPSTNLFHLTLVTTAVICCWMMYAIVYLAQMKPLINPILSGE

SEQ ID NO: 693 - protein, 808 aa, Zea mays
MDLVASPSRSKSKPRSSPAKPVAAPAESRMDLCTPSKPTPRRKSKTTASPAPMSPATPSTVRRSRRLLETPTKASPEVQVKATPISRAKRTAPSPKTPVQRETKRQRRHPRKRAYYRKVVYDGGEFEVGDDVYVKRRETAESDAEDPEEEECRVCFRTGGGVMVECDACLGGFHLRCVRPPLRRVPEGDWACPYCEAERAGKVVERPRPPEGKRVVRTAKEKLLSSDLWAARIESLWREPDGTFWAKVRWYIIPEETAAGRQLHNLRRELYRTNDLADIEMETILRHCSIMCPKDFRDANNGGDDVFYCEYEYDIHWHNFKRLADIDDEPETKEDLSDEPYNAGDDYNSDTDEDSDYDEEEESTSSFSVRRNQSHESAANSRKGRIYGLQKIGIQKIPEHARCHQKTELEKAKATLLLATLPKSLPCRDKEMDEISIFVKDAICNNQCLGRCLYIHGVPGTGKTMSVLAVMRRLRSEFDSGTLRPYCFIEINGLKLASPENIYKVVYEQLSGHRVGWKKALHYLTEHFSGGTKIGKQANQPIVLLIDELDLLMTRNQSVLYNILDWPTKPNSNLVVIGIANTMDLPEKLLPRISSRMGIQRLCFGPYNYRQLQEIITSRLKGIDAFEEQAIEFASRKVAAMSGDARRALEICRRAAEFADYRVKQSRQSAQTTVSAKKGDAVVSMGDIEAAIQEVFQAPHIQVMKNCPKFGKVILVAMVHELYKSGLGEIMFDKLATTVFSWCHANRELLPGYDTLLKICCKLGESKIILCEEGSKHKLQKVQLNYPSDDVTFALKESPDLPWLSKYL

SEQ ID NO: 694 - protein, 216 aa, Brachypodium distachyon
MVLWVFGYGSLIWNPGFDFDEKILGFIKGHKRTFNLACIDHRGTPKNPARTCTLESEDEAICWGIAYCVKGGLEKEREAMQYLERRECEYDQKISVDFYKDGDSLKPAVTGVLVFVSTPDPVGNKYYLGPAPLEDMARQIATANGPNGNNRDYLFSMEKALSNISHEDDSIIELANEVRKVLSRSEKITGSDISLKSHTPLVHLSALPEGTVVDSR

SEQ ID NO: 695 - protein, 661 aa, Zea mays
MPTPPPRKKRLVRAGLLAAAAGYFAFVLLFELPLLPFLASSSPAATTSSSSSSLPFQHPRRRELEAAAAAFTSPFSPARPSKRAFPAAAAPAPGSTPRLPIFSSLLLLPRPNATATPFDNTAADAFAAAKPHLAHLQATANPTAASAPASSPPPTCPASVAVHREQLPYDGVRVVELPCGLAVGSHVTVVARPRPARPEYDPKIAERKDGEAAVMVSQFMVELVGTKAVDGEAPPRILHLNPRIRGDYSRKPVVEMNSCYRMQWGQSQRCEGFASRPVEDTVDGQLKCEKWIRDDDSKSEESKMKWWVKRLIGRPKDVRIIWPYPFTEGKLFVMTLTAGLEGYHVNVDGRHVASFPYRTGYSLEDATALSLNGDIDIESIFASSLPNSHPSFAPERYLEMSEQWRAPPLPTEPVELFIGILSAASHFAERMAVRKSWMMYTRKSSNVVARFFVALNGKKEVNAELKKEAEFFQDIVIVPFIDTYDLVVLKTVAIAEYGVRVVPAKYVMKCDDDTFVRIDSVLDQVKNVGNDKSVYVGSINYFHRPLRSGKWAVTYEEWPEALYPNYANGPGYVISSDIARYIVSEFDNQTLRLFKMEDVSMGMWVEKFNRTRRAVEIRHDVRFYQSGCYNGYFTAHYQSPQHMICLWRKLQSGSARCCNVR

SEQ ID NO: 696 - protein, 618 aa, Hordeum vulgare
KFWFQNKRTQMKNQHERHENSQLRADNDKLRAENMRYKEALSSASCPNCGGPAALGEMSFDEHHLRVENARLRDEIDRISAIAAKYVGKPMVPFPVLSSPLAAAPGASAYDVFAGAASVLQAPPDDKQQGVVVELAVAAMEELLRMARLDDPLWATTVDQTLALDEEEYARMFIDPRGGLGPKQYGLVSEASRDATVVIMTPASLVEILMDVNQYAAVFSSIVSRAATLEVLSTGVAGCYDGALQVMSVEFQVPSPLVPTRESYFVRYCKRNADGAWAVVDVSLDGLQGVKCRRRPSGCLIQEAPNGYSKVTWVEHVEVDDRSVHNIYKPLVGSGLAFGARRWVGVLGRQCERLASAMASNIPTSDIGVITSSEGRKSMLKLAERMVASFCGGVTASVAHQWTTLSGSGAEDVRVMTRKSVDDPGRPPGIVLNAATSFWLPVPPKRVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHAAAGATGTGGSLLTVAFQILVDSVPTAKLSLGSVATVNSLIACTVERIKTAVISNGGASPPQ

SEQ ID NO: 697 - protein, 282 aa, Hordeum vulgare
MAAAAARSGSRRLFSISALVPPKPPTPPPKADPFASLFIPGLSKRTTTDGLREAFAKSGEVVHASSVKSSRWYMISANRSGPLTVRKEYRKVLPSFIRPSASYSTKASEKRPKQERTDLTTVEDPFNAPTYNIPEKPVTFAEGASYSVVILAGLGVAALAGYAVFKELIFEPKEYKIFGKALARVQSDSQVTAKIGYPITGYGTESRNRAARQRIQNRVWTDEDGVEHVEVAFHIRGPHGAGKVFAEMFKDNADRTWKFMYLLVEFTAPQQGQVMLESYIPA

SEQ ID NO: 698 - protein, 244 aa, Hordeum vulgare
TSTLSWPMRLKVALDAARGLKYLHEEMDFQVIFRDLKTSNILLDENWNAKLSDFGLARHGPQEGLSHVSTAVVGTLGYAAPEYMQTGRLTAKSDIWGYGVLLYELITGRRPIDRNRPKSEQKLLDWVKPYISDVKRFPIIVDPRLEGHYNLKSMTKLAGVANRCLLRMPKSRPKMSEVYEMVQKIVDSVEIGPPEPPLHYHGSVSGPGAKRTKKGSLKRRLQEFKFGCRQIVWRGWKPEIIKTC

SEQ ID NO: 699 - protein, 115 aa, Hordeum vulgare
MLKPELLEERIFNSITWAPRIWRPWDNLFDCRVLFRSKDIRGGRFVRPILIFRTKRYWILFRIGPERRRKAEMPTDLCLFSNSPDPIVPVFGTSSAKVTEWVSHQSNPFDKSEKT

SEQ ID NO: 700 - protein, 463 aa, Hordeum vulgare
SGDTDVDSEYDEEDEPAARCSARKNQSNEKILPANSWKGRIYGLQKIGIRKIPEHVRCHQKTALEKAKATLLLATLPKSLPCRDKEMEEISTFVKDAICNDHCLGRCLYIHGVPGTGKTMSVLAVMRRLRSEFDSGALRPYCFIEINGLKLASPENIYKVIYEQLSGHRVGWKKALHYLTQHFSDGKKIGKQANQPIVLLIDELDLLLTRNQSVLYNILDWPTKPNSNLVIIGIANTMDLPEKLLPRISSRMGIQRLCFGPYNYRQLQEIITSRLKGINAFEDQAIEFASRKVAAMSGDARRALEICRRAAEFADYRVKQFQQVEQTPSSANIGNGFVCMGDIEDAIQEVFQAPHIQVMKNCPKFGKVILAAMVHELYRSGLGEVLFDKLAATVFSWCHVNREILPGYDTLLKICCKLGESKIVLCEEGTKHKLQKLQLNYPSDDVTFALKESPDLPWLSKYL

SEQ ID NO: 701 - protein, 111 aa, Setaria italica
LGSCSIQELQELELQLEKSLSSIRQRKQKKLMDQILELREKEQKLSKENAMLRDQCKALPLLELNDKGRVDAAAGGGEEEEDDVRMEDVETELAIGIGRRRPSNTSVGDDA

SEQ ID NO: 702 - protein, 144 aa, Setaria italica
MYPAKPSVAAASAPVTGVPMGGPPVAAGNATSQWSSGLFDCFDDCGLCCLTCWCPCITFGRVAEIVDRGATSCGMSGAMYTLLALVAYLTGFRCQWIYSCTYRSKMRAQFGLPETPCCDCCVHFFCERCALCQQYKELKARGFD

SEQ ID NO: 703 - protein, 311 aa, Setaria italica
MASASCLSLLVLVALASSASAQLSSTFYERSCPRALATIKSAVNAAVSQEARMGASLLRLHFHDCFVQGCDASVLLAGNEQNDPPNLTLRGFNVIANIKAQVEAICKQTVSCADILAVAARDSVVALGGPSWTVPLGRRDSLKAASTSMVLQNLIPPTSSLTQLIQGYGNLGLNPTDLVALSGAHTIGQAHCPSYQDHIYNDTNINQAFAASLKANCPATGGSNVMAPLDTTTPNAFDNAYFKNLQSQKGLLHSDQELFNGGSTDNTVRNFASNPSAFSSAFVTAMIKMGNISPLTGTQGQIRTTCSAANP

SEQ ID NO: 704 - protein, 1675 aa, Setaria italica
MSVAKFCEHAGGTPEKAGEIVHVENGMTIAQWFKFCIGVAGSIANTRWDWPDWACMKSSPEEYMLKSLASRNSGTGKVRLLGGYGKINGLINNPAYSSDLYIEGGGCTNVDKQMNGSVGTNYKKSVDVHEGLTKDSALLQNSTTMNVGLARNHTVHALNLNPLSTPSGSLHSEASMGRHYKGNHLAHNYGICLEKNLDASFRNPEPRSSRVVNHDSRACRPDFPHKILQDTLCNTSNTELKLGQSSYHQSMTTLFPLVQSAVIEFQKPQSHRPLINQNPCPKQATKVNNNLAEPEHNGPSISTGNKQPLLVTNGTKHSEVGELTDDTSKNSFISLFLSHLERNSTPEPIDDILNSNEHYHPKALDVACGSDHPKNASRHIETRVNDNHPKLAPTIIHMKRRSEGISLSASYSGYNPQDASHGNSQEHLIHGDCPSHLLPNQPNAGISNCARVSCPANCMCCTHMGNKSHQVAHGEIGVPCFYDKMARGHGTFERVDDLCTHRSLRAFAKISCENGKSCCSSQEFLPSFCQNDPSTLGKSICGCCCKIQEGVSKLGFIPGHLCRTRFSSDLGPVVSSKPTLEGQDELCACSSFMQRSSLCSREHILQSCYACPIDGLHYRNSMGHATDSLTKHSLFDGRSTKEQGPCCNGRCCYSVVPKCLSSCAFTKHCDVRVDQIGHTAPISKHQMQMPTRCCTLEENEKLTCQCLSNRIAGRSLSQASRCKDVSDKVMNQPSIAITERLKNISEASVADDSSSKAVTERKGPSKDSVVSKGQPKFGFSSGSSSIVVTKFQMSPEVHKVSSTAKHRKHKNVCDEGSRIEKCSASSYVPASSTGCEEALNSFTRSQLAPSRVKRKGNQISVGSRLEEKDNEELCFGLPKRMRTLRCSSKNSESEDCTRTSSQSSQKGGCQPQNEVNSFSCRVLRTKRKHPTMQLNKPVKQLHSQNKVFKGDGKLPDTKGNFFGGLDSFDRKKQVEDTTPGRTKHHQEGSRAFVRKLPKYVSLNCIVNEPNSEDACSGSAGIDSSLIATGMANDNRKSPKIVPLSLVLKKAKRCHSVKLCKTESTHLYEKKGSDCSVNSSSDCSVDKCPIDDEGCSPQAEYEMQGSKRSRYSSNGLRSHFMAHCKRPSGVLGEDDPLGLKDMETNRLSITSSRSNGTKNRRASVSLTRIKRHKKFANKSACYSSSGKENAVLTHEENVRRDSGRLSLDAPCCVCGISDPEPCNQFIECCKCYIKVHQACYGVLKVPRGQWFCRPCKTNTLNTACVLCGYGGGAMTRALKTKNILKSLLKSLMTTARSEKNVDSLRNGRSECTSLRNPVDSARGDSIANGENITSNSWTSINHNSSLLGPRTMQWVHMVCGLWTPGTKCPNATTMSAFDVSGASPAKRNTACSICGRTGGSFIKCRDVNCLVLFHPWCAHQRGLLQSEPEGERNENVGFYGRCIDHANDFSSRINPKECLRSSSWTCARTEGFKGRKGEGFHGSSHKKSEEYSGEFSVSQEQINAWLRINGSKPSGRGQKEYIHYKQLKGWKHLVVYKSGIHGLGLYTSVFIPRGSMVVEYVGEIVGQRVADKREIEYQSGKRLQYKSACYFFKIDREHIIDATRKGGIARFVNHSCQPNCVAKIISVRNEKKVMFFAERHINPGEEITYDYHFNREDEGQRIPCFCRSRYCRRYLN

SEQ ID NO: 705 - protein, 124 aa, Setaria italica
MILTGYDLLKKVKESSSLRDIPVLIMSSENIPSRINRCLEEGADEFYLKPVRLSDMSKLKPHILKSRCKEHYQEQHQQSDSNSNECSNPTNDSSSSSSDNSNSRKREAEDNEEILPQRNRSRHS

SEQ ID NO: 706 - protein, 748 aa, Zea mays
MDAEAGVAGADQLPRRQYYLNLLLLAYQSFGVVYGDLSTSPLYVYKSTFSGKLRHYQDEETVFGVLSLIFWTFTLIPLLKYVIIVLSADDNGEGGPFALYSLLCRHAKLSLLPNQQAADEELSSYYRNGFAPRNGSSPWSRRFLEKHKKMRTLFLLIVLCGASMVIGDGVLTPAISVLSSMSGLHVRATGLHHSSVVLLSCIVLVGLFALQHRGTQKVAFMFAPIVIIWLLSIGGIGLYNILHWNPNVYQALSPYYMVKFFRKTGKDGWIALGGILLSMTGSEAMFADLGHFTSASVRVAFITVIYPCLMLQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMLVTTFLMALIVIFVWQRNIIFSLVFLVFFGSIEAVYLSSSLMKVPQGGWVPLVLAFIFMSVMYIWHYGSRRKYQFDLQNKVSMRSILSLGPSLGIVRVPGVGLIYTELVTGVPSIFSHFVTNLPAFHEVLVFLCVKSVPVPYVSPDERYLVGRIGPKEYRMYRCIVRYGYKDVQRDDDNFENMLVMSIAKFIMMEAEDASSASYDIANEGRMAVITTTDASGSPLAMRDFDGLADSMSTRSSKSESLRSLQSSYEQESPSVNRRRRVRFEVPEEDGMGQQVKEELTALVEAKHAGIAYIMGAFLYQSQEELKFPEEVCY

SEQ ID NO: 707 - protein, 215 aa, Zea mays
MVLWVFGYGSLIWNPGFDFDDKILGFIKGYKRTFNLACIDHRGTPEHPARTCTLETDDEAICWGIAYCVKGGPEKELKAMQYLERRECEYDQKISIDFYKEGDPLKPAVTGVLVFVSTPDPIGNKYYLGPAPLQDMARQIATANGPTGYNRDYLFSMEKALASISHEDDSIIELANEVRKVLNRTKETKITGANASLKSHAHYVFYYDLVSSSCL

SEQ ID NO: 708 - protein, 99 aa, Zea mays
MTEEKPYNRRHKVCEAHSKAPVVLVAGLRQRFCQQCSRFHELSEFDDVKRSCRLRLAGHNERRRKSSADAHAGGGNNGFRQHADQNGRGDPAGNHFQIR

SEQ ID NO: 709 - protein, 86 aa, Zea mays
MAAHLASAFFFAAEPVGEPGVHALCAKPLARDSDIFMYRGDTPFCSEECRYEQMQLDAIRARQPYASGTEARRGHREASKVSAVAT

SEQ ID NO: 710 - protein, 168 aa, Zea mays
MASTPHPPPLIGKSGNLTVFFTPSAEHESPGSEFSTPPTSPRAEDSPESPPAQTAPPPAPVYSVSTPQLVKMVSPPLPAEKLSRPSLVQVPPLQFGKASAGSDGSLLAFFWDAVARMQEAHASLDEHISRWFGLDQSKYQWALNDYYERTGQVKHSIPARLARHSYIY

SEQ ID NO: 711 - protein, 247 aa, Zea mays
MRQEYYINRQKTFINHLVNQLARHQFLKIACQLERKNIASAYSLLRVIESELQSYLSAVNTRLGHYNSLIQAASEVREQGAIDDRDTFLHAVRDLLCIHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 712 - protein, 191 aa, Zea mays
MAMATQGQADHQQQQHGRSEPTTSVAANRWGPYSGAGDFASNMAVILAALLAALALGLALNAAVRYLLRRRRRRRRAGSGGGQGNGSGVLPSDEPAEKPSVEVELQAPARRRPPCWCTPPPGRSWRAPRRSAPSASPSSRTGTPCASCRPAATASTRAASSAGSRRAAAPPARPAARRPCSAACTQVNYSK

SEQ ID NO: 713 - protein, 858 aa, Zea mays
MMDMRRHSVSVDAPLSRTLVQLKRVRSLRDPATNSMSKYASPSDHMIWETASSNGVTPELGRSKSSAAMSRVGSPCMSASEARSVGSRRSTLGHGTEDTRLRSNDVVGSNFSGCGISYCWSGASKYRELYSDSDGPDQPLLSTDGIEAAFQGNVPYTETLRCLSQKFRPRSFSELIGLNVVAQSLLYSTCKGKVAPMYLFHGPRGTGKTSTARIFAAALNCVSLEEQRPCGFCKECVILFSGKSRDVKELDAAKMDRLGRVKALLKSASLVPYSSRFKVFIVDECHLLREDAWSAILKSLDEPYRHTVYIMITSDIESLPRASITHCQKFHFPKIKVADIVYRLERICIEEGLEFDHDGLYFIAAKSNGSLRDSEIMLDQLSLLGKKVTISLVHELVGSVSDDELIELLDLALSSDTTNTVRRARELMGSAIDPLQLVSQLANLIMDILSGRCQSAVTEVSKSFLGRYALSEVGIKKLRHALKILSETEKQLRTSRNQATWVTVALLQFSTNEPNPVAETNDMHAHSVTGYTDDWVSKVHSSANFCQACNSSKSNCSERHCRRLKLENIWRRAIGKCRSRSAKSFLRKEGFLSSVHVTEELAIAEVGFEHPDHLSRAEKMQSLIESSLQHVLGCNVEIRFKLVPCPVSKDARLKRQPFSFLNCSGRKQELSDSVVTDEDEAARGPGARETPLKGYTSSQQESPYTMRRVDSKPTTVHGCEDDARSTLTSSRSTADDLTRTCRSETGYPKGVREQGRSDGTQQEPDLQPNCFSRTLKLQKKLLSSGAAHTICLRVQPHNKMDFLPKKEFDTYFCAYEPYEQCPRSDSRATYSSRDDDLWSKNSRFGSNLLCWRAPKQSM

SEQ ID NO: 714 - protein, 130 aa, Zea mays
MPLNNSLISFTELISVTFVNKDGSEKTIRVPVGMSMLEAAHENDIELEGACEGSLACSTCHVIVMDVNYYNKLEDPADEENDMLDLAFGLTETSRLGCQVIAKPELDGIRLALPVATRNFAVDGYVPKPH

SEQ ID NO: 715 - protein, 107 aa, Zea mays
MLRNGNEGMSTIPGFSQIQFEGFCRFINQGLADELEKFPTIKDPDHEIAFQLFAKGYQLLEPSIKERNAVYESLTYSSELYVSARGKAQSQSQGTVKLHRVFLSRCR

SEQ ID NO: 716 - protein, 767 aa, Zea mays
MASSMLSSATMVASPAQATMVAPFNGLKSSAAFPATRKANNDITSITSNGGRVNCLRNGNEGMSTIPGFSQIQFEGFCRFINQGLAEELEKFPTIKDPDHEIAFQLFAKGYQLLEPSIKERNAVYESLTYSSELYVSARLIFGFDVQKETISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLAQVFDQTNPLTQTVHGRKVSCLGPGGLTGRTASFRSRDIHPSHYGRICPIDTSEGINVGLTGSLAIHARIDHWWGSIESPFYEISEKAKEKKERQVVYLSPNRDEYYMIAAGNSLSLNQGIQEEQVVPARYRQEFLTIAWEQIHVRSIFPFQYFSIGGSLIPFIEHNDANRALMSSNMQRQAVPLSRSEKCIVGTGLERQTALDSRVSVIAQREGKIISSDSHKILLSSSGKTISIPLVAHRRSNKNTCMHQKPRVPRGKSIKKGQILAEGAATVGGELALGKNVLVAYMPWEGYNFEDAVLISERLVYEDIYTSFHIRKYEIQTDTTSQGSAEK

SEQ ID NO: 717 - protein, 157 aa, Zea mays
MQVFISSRALLLPPRLLCCLFFSSSSSSLIEALRFAGGLRYHGMAPLISHVYELGFMDAVAIQQTECFQGICGAAALQFARTEGIIPAPEPTHAIAAAIREALECKRTGEEKVILMAMCGHGHFDLAAYEKYLRGDMVDLSHPADKLEASLAAVPKV

SEQ ID NO: 718 - protein, 509 aa, Zea mays
MPPLHVPGSSTPRKFYHLVLFHVHPFWIQVLYFLLISVLGFLMLRVLPMKSSSVPRPSALDLLFTSVSATTVSSMIAVEMESFSNAQLLLMTLLMLLGGEVFTSMLGLHFTCTKLRNKRETPHNNLHGNSLEQSRRRHRPMEMEAQAAAVQMELAGFNKDGHGDFASMASVVGSARAVLVRKRISLSTFSVFTVVSSFANCGFVPTNEGMVSFKSFPGMLLLVMPHILLGNTLFPIFLRLSITALERVTRWRDLCELLRDRGPGGGPAAAAAAAAIGYDHLLPGPRTWFLALTVAVFLAVQLVLYCAMEWGSGGLGGLNAFQKLVAAVFMSVNSRHSGEMVVDLATVSSAVVVLYVLMMYLPPYTTFLPVAVEDDQQQQNEAQPHDNSTSKSSTSISIWHNLLMSPLSCLTIFIVVICITERRQIARDPINFSVLNIVVEVISAYGNVGFSTGYSCSRQVTPGGGCCKDAWVSLSGKWSVEGKLTLMAIMFYGRLKKFSMLGGQAWRLN

SEQ ID NO: 719 - protein, 274 aa, Zea mays
MAMAMALASATAAALFRSALSAPHGAGARVRPQRRQPFLAPLHAAKGPGSAPVVLEGKAKGKKKKGPSSGNLPAALDVEIREAQEYLDSDQQEPVPDNFPFELIDEEGMSVVILRRDYKDEKVEVTVSMPNLEGGPEFGDEDGEGDGESAVKDDGEAEEDDESAGDSSISLKVVVSKDSGPKLEFTCTAFREEITIDDMLIVEKTDDDDGEEKFPYEGPEFTELPVNVQKGLFKYLEQRGVTLSATNYMHDYMVTKQAQEYIRWMTKLKDFVAQ

SEQ ID NO: 720 - protein, 710 aa, Oryza sativa
MTTLDRTKCQQQGSRLLVRKLPKYVSLNCIVNETNSEDACSGSASIDSSLIATGITNDNRKSPKIVPLNLILKKAKRCHAIKPLSKTENIHFSEEKSSDGSADKSSSGDRSFSPQDELWSPKKNRYSSNVSRPHVKTDCQSPCCVLEEDEPLSLADMGTSQLSASRSRGSKNQRACISLNRMERCEEFTNESACSPCGDKHAAVQACVTKFERYIQRPSLDASCCVCGISNLEPSNQLIECSKCFIKVHQACYGVLKVPRGQWFCKPCKINTQDTVCVLCGYGGGAMTRALKAQNILKSLLRGIATAKRSDKYVYSSGNVNSECTSKLHGEYVRHDSFNGHRSRSFNAISSFGIKEASIGSARGDIISKSWTSNRNSSLLGPRTRQWVHVVCGLWTPGTKCPNTITMSAFDISGASPAKRNTECSMCNRTGGSFMGCRDVNCSVLFHPWCAHQRGLLQSEPEGEHNENVGFYGRCLDHAMLDPNHVNPKKECLRSNDWTCARTEVFRGRKGDSFGANRSRKPEEKFGECSVSQEQINAWIRINGSKSCMRGQKEYVHYKQLKGWKHLVVYKSSIHGLGLYTSEFIPRGSMVVQYVGEIVGQCVADKREIEYQSGKRQQYKSACYFFKIGKEHIIDATRKGGIARFINHSCQPNCVAKIISVRNEKKVVFFAERHINPGEEITYDYHFNREDEGQRIPCFCRSRGCRRYLN

SEQ ID NO: 721 - protein, 395 aa, Sorghum bicolor
DGEMDDEFEMGAGPRRFTYNQLSQATRGFSDEEKLGEGGFGSVYRGYLQDQGLHVAIKKVSKTSKQGRREYVSEVTIISRLRHRNLVQLVGWCHDADELLLVYELMSNGSLDKHLYSTDNILTWQVSFHFWAWMIGSIGYDIILGMGSALLYLHQEWEQCVVHRDMKPSNVMLDSSFNAKLGDFGLARLVNHSRAAHTTWLAGTMGYMDPECVVTSRASVQSDVYSFGVVLLEVACGRKPVVLEEEDESRVLLVQWVWDLYGRGELLDAADPRLNDGGGGGGFQPLEMERVLCVGLWCVHPDYASRASIRQAMSVLQFEAPLPELPLEMPVATYGPPVARGHNWSSTTSSSASANTGGHSSTSDRTAEHSLGSSDKSSTHGLLSLPSSNTRSATK

SEQ ID NO: 722 - protein, 398 aa, Sorghum bicolor
MEEARRTAVQSCHRVLALLSNPHGQLVPSKDLMAATGEAVAKFGSLTAKLTNSNSNSNGNGLQLQGHARVRKIKKPLPIFDSNLFLESSAVAAAAAATVAKTPSPSPITGLQLFPRYHQMEGSSSKDPVRIPTQFPKRLLLENPAAGLEGLPSKAPPVQMVQPVSVAPPAGTPTPALPAAHLHFLQQNQSYQRFQLMHQMKIQNEMMKRSNLGDQGGSLSGGGGGKGVNLKFDSSNCTASSSRSFLSSLSMEGTLASLDGSRASRPFQLVSGSQTSSTPEMGLVHRKRCAGREDGGGRCTTGSRCHCSKKRKLRIRRSIKVPAISNKVADIPADEFSWRKYGQKPIKGSPHPRGYYKCSSVRGCPARKHVERCVDDPSMLIVTYEGDHNHNRVLAQPA

SEQ ID NO: 723 - protein, 277 aa, Sorghum bicolor
MALLREHLDLIRAHLLDDHHVAVTVSSDDSASLQSSSPSPSQSPPGRSRPLPALSVSLPPRPPAVDLQQQHLWAPAPPPMQIHRQEQQHYCYPPEPEEEEDDFRRYRGVRQRPWGKYAAEIRDPARKGARVWLGTYDTAVEAARAYDRAAFRLRGSKAILNFPNEVAFGAAARWAAAPAAAPQPSVTVAGNKRGRARSPQEQDAGCLLVREVKKERVQEPAAAAAGCGWDGKDTAASGGGADYFWEDESLKGAICSLPPLSPLSPHPHLAVPQLSVS

SEQ ID NO: 724 - protein, 435 aa, Sorghum bicolor
MATHGGENGSGHAAAEWRFARAAAAKDVAGADKMSIRAARFKISASVDARDPRPVLPLAHGDPSVFPAFRTAAEAEDAVAAALRTGKFNCYPAGVGLPDARRALAEHLSSDLPYKLSTDDIFLTAGGTQAIEVVVSVLAQPGTNILLPRPGYPNYEARAGLHNLEVRRFDLIPERGWEIDIDSLESIADKNTTAMVIINPNNPCGSVYTHEHLAKVAEVARKLGILVIADEVYGNLVFGDTPFVPMGVFGHIAPVLSIGSLSKRWIVPGWRLGWVAVCDPNKILLNTKIIASITNFLNISTDPATFVQGALPHILENTKEDFFKRIIGLLAETSEICYREIKDIKCITCPHKPEGSMFVMVKLNLYLLEGINDDIDFCCKLAKEESVILCPGSVLGMENWIRITFAIDSSSLLDGLERIKSFCRRHKKKNLLNGH

SEQ ID NO: 725 - protein, 154 aa, Sorghum bicolor
MAPPTEDESSDEEAEDASSSDDDGEGEDLKRIGFYEGASDGVFPWGGAVVRTWQGLPRRFSGCASGIGGGFGGATGGAFPGAVRLWGASTASGGEPWWAAVCSADEGGCRRDGGAAAAAEADQVVVGWRREHASQQQQQRRRRRRAVPLAHTGQ

SEQ ID NO: 726 - protein, 288 aa, Sorghum bicolor
LSARRIPSPNLTRGLARWSLFPPSSRSISATPDGWSPRLAQPVPRRLSACATRPRANRSLSSHAPTRTRRECRPRGAAAAAHAPDPGLVLVVAEARTDLVDPALGLLDESSAFAVGLLEAPLQLGGARPRPLQLRQSLRQARPAELQGSVSTSRFLRCGRRPRRRVRHLVARYDQGRGGDEDLADSDEGHGGGGERPSGPGAKPMLFGVPIGAKRLHGADGDGDDVDDGEDRAAEENGEGNDEDEERHAARERGVKAARRNETSDLDVLTLSVRAAAAARTSTSLTLP

SEQ ID NO: 727 - protein, 491 aa, Sorghum bicolor
MASCVGKWCALWRRILEHIYIWGAALSFLLDWCICLTLPAHPYKKVDQVKHEMELYPGYLQDHFNIHKLSRLATSGAAPGRYVTSGPAVGGGATAMGIYERQRHLVAAGVSVWGEPFRPDADALPLSAVVPTVTLATPPAPPLDVVEAEEVKFGKHQLLQAQQYDFPPQVEEEAPPPSSDSFGHDHDDDAARPRDKIQRRLAQNREAARKSRLRKKAYIQNLETSRMKLAQLEQELTMARRQQQQQQHGAYGVGGGGGGVAAAAGADPRVAAFELEYARWVEEQGRQATELRAALQSHAPEVQLRVLVDAGLAHYGALFQAKAQAARSDAFFVLSGVWRAPAERFFLWIGGFRPSELLKVLAPRLNPLMDHQAAEVRKLQNTARQLEDALSQGMSKLQQTLVDALMTVDVASPLGAGGGYAAQQMASAVGKLADLVDFVDKADHLRQQTLRNMHKILTPRQAARGLLALADYGQRLRALSSLWAARPREPA

SEQ ID NO: 728 - protein, 55 aa, Sorghum bicolor
VKKEQRMTKDETLLVFTLVVSSVSIFLFGILLFRVLISATRDFRERTKSKLVKIL

SEQ ID NO: 729 - protein, 662 aa, Sorghum bicolor
MASGATSDAWPSSPYSSSAPDGEVLRSLHRLARDLSAAEAPAPFLRAVFAAVARRARLLAAVFDDLLLCGAAAGPLLLLPRSASLCLRELLLVLQRFKALVADCAARSRTRLLLQSDEVAARARELQHDLATLLDLLPVADLGLADDVSDLLALASRQCRRAVAAPELELKAGVLALIQEVEREIVPGRERLEGVLEDVGINDPASCSDEIETLEREIGDRVAERWTSSMIALVGLLRYAKCVLFSAATPRPVDSNKVDLDDGDGDDGAEPPSPPLDFRCPISLELMADPVVASSGQTYDRDSITRWFGSGKSTCPKTGQVLPNLELVPNKALKNLISRWCRENGIPMESSESGKSEPAPVVVGANKAAQKAARMTASFLVKKLSASFSPEATKRVVQEIRQLAKSGSDNRAFIGEAGAAGLLVPLLRSEDSALQLNAVTALLNLSILEANKKRIMHAEGAVDALCHVMCSGATWRAKENAAATVLSLAAVHAYRRRLGRNPRVVDSVVQLARTGPASTKKDALAALLCLSAERENVPRIAAAAVLASLAKRGGAEAIVALDGAVARLVAEMRRGTEWSRECAAAALVLLCRRAGAAAASQVMAVPGVEWAIWELLGTGTERARRKAASLGRACRRWAAAANAEQGTECPTSGDASGLTVAS

SEQ ID NO: 730 - protein, 288 aa, Sorghum bicolor
MAMAFHFHPLAATRVHLSPLPFAAAAAAGAPSPSSSSVAIAAPHHHHGRRRFSAVVATAAATEFDFKAYMGERAVAVNRALDAAIPAGEPPAALHDAMRYALLAGGKRVRPALCLAACAVVGGPEAWAMPAAAAVEMVHTMSLVHDDLPCMDDDDLRRGKPTCHVVYGEPIAVLAGDALLSLSFHHMASVGSYPPDVDPEKHPARVVRAIGELARCIGSEGLVAGQVSSFLRLHIAFPPFTKYTYIQSSKTGQLLILKFTSSPTKNATSKCLNKLLKMLHLPSTGCRS

SEQ ID NO: 731 - protein, 203 aa, Triticum aestivum
DEGDIQRLKQHIVHLNESGGTPLPRPPSAFATVVALAWTCFARCKSFSLEDDVWLFFFADIRERLDPPVGAGYIGSCLTKCLARLPARELHGERALAAAAAAVQDEINKMKEDPIAGWNFFSFDPMPAMDRLMNISGSSGFSAYKIADFGWGKPRRTEPIRMNTDGQVALMGSRDDRGVQVSVALLQAAQMDEFKSNFLALLE

SEQ ID NO: 732 - protein, 411 aa, Zea mays
MVFLHASRSDVVRDLCLSVSSLDLGKSSYMKVTHRPLFGDGILKSSGEAWAHQRRLIAPEFFPDKVKGMVDLMVGSATALVASWGDRTGGGGVELKIDDDIRAYSADVISRTCFGSSYVKGKRIFAAIRELQKAVSKPNLLAEMTGLSFLPTRTNREAWRLNRVVRDLVLDVVREGGDDDRNLLNAMLRSASSSGGCSGDRVAVEEFVVDNCKNIYFAGYETTAVTAAWCMMLLALHPEWQDLVRDEVRQACGGGDFASLHKMKKLTMVIQETLRLYPAGAVVSRQALRDVTLGGVRVPAGVNIYVPVSTMHLDPELWGADAREFDPGRFADDHQRQRQPHAYLPFGAGARTCLGQAFAMAELKVLLALVLSRFRLALSPAYVHSPALRLIVEPEHGVRLLLTNVEPRGAS

SEQ ID NO: 733 - protein, 183 aa, Zea mays
MLWKKLVQFGKGFFEKKEESTSTDMPLGTAIHNIEITRGRGGQLARAAGAVAKLIAKEGKLATLRLPSGEVRLVSQNCLATVGQVGNVGVNQKSLGRAGSKCWLGKRPVVRGVVMNPVDHPHGGGEGKAPIGRKKPTTPWGYPALGRRTRKRKKYSDSFILRRRKVSKYVLGIWKIAYLGNLQ

SEQ ID NO: 734 - protein, 777 aa, Hordeum vulgare
MMIPARHMPSSMIGRSSGGAPYGSSSALSLGQPNLLDGSNQHLLQHHLLEQIPVRAAESGDNNIGSGGGGVGMIRGRESMDPLGDEFESRSGSENVDGDAVDNAEQDQDPNQRPRKKRYHRHTQHQIQEMEAFFKECPHPDDKQRKELSRELGLEPLQVKFWFQNKRTQMKNQHERHENSQLRADNDKLRAENMRYKEALSSASCPNCGGPAALGEMSFDEHHLRVENARLRDEIDRISAIAAKYVGKPMVPFPVLSSPLAAAPGASAYDVFAGAASVLQAPPDDKQQGVVVELAVAAMEELLRMARLDDPLWATTVDQTLALDEEEYARMFIDPRGGLGPKQYGLVSEASRDATVVIMTPASLVEILMDVNQYAAVFSSIVSRAATLEVLSTGVAGCYDGALQVMSVEFQVPSPLVPTRESYFVRYCKRNADGAWAVVDVSLDGLQGVKCRRRPSGCLIQEAPNGYSKVTWVEHVEVDDRSVHNIYKPLVGSGLAFGARRWVGVLGRQCERLASAMASNIPTSDIGVITSSEGRKSMLKLAERMVASFCGGVTASVAHQWTTLSGSGAEDVRVMTRKSVDDPGRPPGIVLNAATSFWLPVPPKRVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHAAAGATGTGGSLLTVAFQILVDSVPTAKLSLGSVATVNSLIACTVERIKTAVISNGSASPPQ

SEQ ID NO: 735 - protein, 317 aa, Hordeum vulgare
MKSSSNLEAFLQAATPRLPWRSATMERFQGAPSSVWQHPEGKNKDAVEYFALSDLWEHYAESSAYGLAVPVRDAGDRAVVTTQHFVPYLSAVQLYTATKPTSHTLGATSRSTGSETDSWSDDSVGGDRFAGSGSSSWDAASDEDDASSTYDGSGSTGVSAKQSGYLNFQYREWDSPYERVPLAHKVEELARDYPCLMSLSSAELSPSSWMSVAWYPIYHIPAHVNLKGTSACFLTYHAISSVFQDNIDSGPEHDDGEIAALSPFGLATYKMQGDLWRRPGSSDPRRLSELHWAASSWLKQVGAHHPDFTFFTTSHRR

SEQ ID NO: 736 - protein, 282 aa, Hordeum vulgare
MAAAAARSGSRRLFSISALVPPKPPTPPPKADPFASLFIPGLSKRTTTDGLREAFAKSGEVVHASSVKSSRWYMISANRSGPLTVRKEYRKVLPSFIRPSASYSTKASEKRPKQERTDLTTVEDPFNAPTYNIPEKPVTFVEGASYSVVILAGLGVAALAGYAVLKELIFEPKEYKIFGKALARVQSDSQVTAKIGYPITGYGTESRNRAARQRIQNRVWTDEDGVEHVEVAFHIRGPHGAGKVFAEMFKDNADRTWKFTFLLVEITSPRPAQIMLESYLPA

SEQ ID NO: 737 - protein, 216 aa, Setaria italica
MSKLQTEVLKDAISQVVSEAREKNRKFTETVELQIGLKNYDPQKDKRFSGSVKLPHIPRPKMKVCMLGDAQHVEEAEKISLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 738 - protein, 173 aa, Setaria italica
MYPAKPSVAAASAPVTGVPMGGPPVAAGNATSQWSSGLFDCFDDCGLCCLTCWCPCITFGRVAEIVDRGATSCGMSGAMYTLLALVAYLTGFRCQWIYSCTYRSKMRAQFGLPETPCCDCCVHFFCERCALCQQYKELKARGFDPDIGWDLNAQRGAGAGQAMYAPAAQGMGR

SEQ ID NO: 739 - protein, 307 aa, Setaria italica
MARKCSSCGNNGHNSRTCGGNGRVMMENGGGGVRLFGVQLHVGSSSPMKKCFSMECLSSAAPAAYYAAALAASSSSPSVSSSSSLVSVEETAEKVTNGYLSDGLMGRAQERKKGVPWTEDEHRRFLAGLEKLGKGDWRGISRHFVTTRTPTQVASHAQKYFLRQSSLTHKKRRSSLFDVVENADRAATSANERLRQRRGGGLGAGHGAPGSVSRHHQPAGEARAHPASEPFVPAATVLIGDEQQQREHVAERAAPRQKHPSSLTLSKPHHASLQQAAPDLELKISTTADYQAGSSPRTPFFGTIRVT

SEQ ID NO: 740 - protein, 514 aa, Setaria italica
MAAAMASLPLHLLLLLPLLAVVSFLWLHRAVSRRRGRGGGARLPPSPWALPVIGHLHHLAGALPHRAMRNLAARHGELMLLRLGGLPVVVASSADAAREVMRARDLDFATRPVTRMVRLVIPDGAEGIIFAPYGGGWRQTRRICTVELLSARRVQSFRPVREEEAGRLLRAVASAAPPAWAVNLSELLSVYAADSSVRAIIGSRFKDRDTFLAMLERGLKLFAKLSLPDLFPSSRLAMLVSRMPGRMKQHRQETVVFMDALVRDHEESRAADDGDGKEDLLDVLLRIQTEGDLPVPLTTDNIKSVVGDMFAGGSETAATALQWIMAELMRNPRVMQKAQDEVRRALAGRQTVTEDDLGDLHYMRLVIKEALRLHPPLPLLLPRECRNSCQVLGFDVPAGTIVFVNAWAIARDPKYWDKPEEFVPERFEDGKIDFKGTDFEFIPFGAGRRMCPGMAFGLVHLELALAGLLYHFDWELPLGMEAADLDMTEEMGVTARRLQDLRLVPVVRVPVPVE

SEQ ID NO: 741 - protein, 1243 aa, Setaria italica
MYGICAQRSDGKVLNCANATKAVKPDTLFSSRIQSLCPTITGNVCCTADQFDTLHQQVQQAVPFLVGCPACLRNFLNLFCEMSCSPNQSLFINVTSVKQINSTMTVDGIDYYVTTNYGEELYNSCKDVKFGTLNTRAMDFLGGGAKTYKEWLAFIGRQANPNEPGSPYLITFRSDFSDSSGVKPLNSTIYSCGDPSLGCSCGDCPSSSVCTGSLLPQLNTDTSCSVKMGSLKAKCLDFSLVVIYLALLCAFLLWGLLHRARGRTASSLQTKPLKNSDDKSDSNQNGKSPHNSVQVSEAASSTVKPSYPSIVQTYMSIFFRKHGIFVARHPLLVLCVSLLIPLLLCIGLLRFKVETQPEKLWVSPGSRAADEKNYFDSHLAPFYRIEQLVLATSASSGSAAPSIVNDNNMKLLFQIQKKVDDLRASYSGSTVALADICLKPLSTDCATQSVLQYFQLDPKKYDDSGIDHAKFCFQHYTSEETCLSTFQSPIDPSTILGGFSGNNFTEASAFVITYPVNNKVETTGQENGKAVAWERAFINLVKEEILPMVLAQNLTLSFSSESSIQDELNRESTADAITIVISYIVMFAYISFTLGDRPSRWLSLFVSSKVLLGLSGVVLVMLSVLGSMGFFSAIGVKSTLIIMEVIPFLVLAVGVDNMCILVHAVKRQPDQSNLEERISEALVEVGPSITLASFAEVLAFAVSAINPMPATRVFSMFAALAVFMDFLLQVTAFVALIVFDFRRAQDGRIDCVPCARIASSPAAGDGGDGQRLHLLARYMRDIHGPILSYRAVKFVVITVFVGLAFSSIALSTRLQPGLEQQIVLPRNSYLQDYFDDLAKYMKVGPPLYFVVKDFNYSSASVHTNQICSINQCNSNSLLNEIARQSLSPETSYIAKPAASWLDDFLIWMSPEAFGCCRKFVNGSYCPPDDQPPCCQLDQDSGTCSASRTCSNCTTCFLHSDLDNGRPSTTQFKDKLPWFLDALPSSDCSKGGKGAYSTSLDLNGYESGIIQASAFRTYHTPLNKQTDYVNSMRAARDFSSKMSKDLQMEIFPYSVFYIFFEQYLGVWKTAIMNICVCLGTIFVVCFLVTSSLWASAIILIVLAMIVLDLMGVMAILGIQLNAISVVNLVMSIGIAVEFCVHITHAFMIGTGDRETRARQALSTMGASVFSGITLTKLVGVIVLRFAKSEVFVVYYFQMYLALVLIGFLHGLIFLPVVLSLCGPPPKSVKPVEQNQPPSASTERT

SEQ ID NO: 742 - protein, 205 aa, Setaria italica
MDLPNGRDDAPIPNGGVGAEETVGRRKKVEMVREAIHGLLEEKRMDGQGEKEMPARQRQEDEHLLSSLLTKPDALERDPDSDTLETHSLHPSHQPGRSETSKEVELADIAKDLNKIKRQNTVTHILLGAVIVLTAVWQVNEVSFLLWVQRKLSNPFKSLGDMIKGSLMLKGRKPVIESSPLPPVGVPDVSRPDLPSFVIGSTEGR

SEQ ID NO: 743 - protein, 382 aa, Zea mays
MAPLFAAASHASLLPLSSLDRPAAGHLVRGTLRPHTSSLRLRRPPGATGRGRGRGRGGIPDEWGERSPPDNPEPPAQPDPPIDKDEWGRDDSADGNSRPIVVDEWGEPGVPEPEPPSAADPPSPSADDDWGKEPEAPAPAPAPAAEEDEQEVKREELKRCLVDTVYGSDLGFRASTEVRGEVVELVTQLEAVNPTTAPVESPDLLDGNWILIYTAYSELLPILAAGATPLVKVKQISQEIDSKIMTIVNASTLTTPFASFSFSATASFEVQSPSRIEVQFKEGSFQPPTISSSVDLPQQVDIFGQKISLGPVQQALNPLQQAFASIAGSISGQPPLKVPIPGNNRARSWLLTTYLDKDLRISRGDGGLFILAKEGSPLLDQL

SEQ ID NO: 744 - protein, 312 aa, Zea mays
MENPASVLVLPAQFTKLTFRNLYIRRAGPGSREITEEGRCDLDKRYVSDFPVYDGRGPDASLVARVQGITSEIGNAHQLFVVVFDTDRLKGSTLVTNGVITAGSDEWAIYGGTGVFAMARGVIRRRYLADRAGGNTDELNMDVFCRPFGSQSELQDKMQVQGQGSSVTKIGLWGGPGGSAQDITAERPPQRLHSVTVRAGVAVDSIEFTYTDSAWQRRAAGRWGGLGGNVRTIDLGDAEDVREVSGTYGAFEGATTLTSLRLVTSSRTWGPWGVENGTRFSVTAPIGSSIVGFYARAGTRLVDAIGVYLRQI

SEQ ID NO: 745 - protein, 782 aa, Zea mays
MDAEAGVAGADQLPRRQYYLNLLLLAYQSFGVVYGDLSTSPLYVYKSTFSGKLRHYQDEETVFGVLSLIFWTFTLIPLLKYVIIVLSADDNGEGGPFALYSLLCRHAKLSLLPNQQAADEELSSYYRNGFAPRNGSSPWSRRFLEKHKKMRTLFLLIVLCGASMVIGDGVLTPAISVLSSMSGLHVRATGLHHSSVVLLSCIVLVGLFALQHRGTQKVAFMFAPIVIIWLLSIGGIGLYNILHWNPNVYQALSPYYMVKFFRKTGKDGWIALGGILLSMTGSEAMFADLGHFTSASVRVAFITVIYPCLMLQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMLVTTFLMALIVIFVWQRNIIFSLVFLVFFGSIEAVYLSSSLMKVPQGGWVPLVLAFIFMSVMYIWHYGSRRKYQFDLQNKVSMRSILSLGPSLGIVRVPGVGLIYTELVTGVPSIFSHFVTNLPAFHEVLVFLCVKSVPVPYVSPDERYLVGRIGPKEYRMYRCIVRYGYKDVQRDDDNFENMLVMSIAKFIMMEAEDASSASYDIANEGRMAVITTTDASGSPLAMRDFDGLADSMSTRSSKSESLRSLQSSYEQESPSVNRRRRVRFEVPEEDGMGQQVKEELTALVEAKHAGIAYIMGHSYIKARRNSNFLKKFAIDVGYSFLRKNCRGPSVTLHIPHISLIEVGMIYYV

SEQ ID NO: 746 - protein, 912 aa, Zea mays
MAPSSPSPAAPTRVSGRKRAAKAEEIHQNKEEEEEVAAASSAKRSRKAASSGKKPKSPPKQAKPGRKKKGDAEMKEPVEDDVCAEEPDEEELAMGEEEAEEQAMQEEVVAVAAGSPGKKRVGRRNAAAAAGDHEPEFIGSPVAADEARSNWPKRYGRSTAAKKPDEEEELKARCHYRSAKVDNVVYCLGDDVYVKAGENEADYIGRITEFFEGTDQCHYFTCRWFFRAEDTVINSLVSISVDGHKHDPRRVFLSEEKNDNVLDCIISKIKIVHVDPNMDPKAKAQLIETCDLYYDMSYSVAYSTFANISSENGQSGSDTASGISSDDVDLETSSSMPARTATLLDLYSGCGGMSTGLCLGAALSGLKLETRWAVDFNSFACQSLKYNHPQTEVRNEKADEFLALLKEWAVLCKKYVQDVDSNLASSEDQADEDSPLDKDEFVVEKLVGICYGGSDRENGIYFKVQWEGYGPEEDTWEPIDNLSDCPQKIREFVQEGHKRKILPLPGDVDVICGGPPCQGISGFNRYRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCMVAYDETQKPSLKKALLLGDAISDLPKVQNHQPNDVMEYGGSPKTEFQRYIRLSRKDMLDWSFGEGAGPDEGKLLDHQPLRLNNDDYERVQQIPVKKGANFRDLKGVRVGANNIVEWDPEIERVKLSSGKPLVPDYAMSFIKGKSLKPFGRLWWDETVPTVVTRAEPHNQVIIHPTQARVLTIRENARLQGFPDYYRLFGPIKEKYIQVGNAVAVPVARALGYCLGQAYLGESEGSDPLYQLPPSFTSVGGRTAGQARASPVGTPAGEVVEQ

SEQ ID NO: 747 - protein, 356 aa, Zea mays
MNMGGRSPAATTIRCKYCSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLVQGCSSGDSLVFHFSGLGAQVADADCDEQDGYDEAICPVDSFQKGPILDDEINETIVRPLVPGAKLHAVVDACHSDSVLDLPFLCNMSRTGNWQWEDHRPPSGVCKGTSGGQAVLISGYSDGKSKFSMTPEACATVGAMTHSFIKAVECEPQGVTYGRLLTSMKAIMTNAGGCNQQLQGACAPARKVVNFSGVQEPNLSCSEMFDVYRKPFAL

SEQ ID NO: 748 - protein, 844 aa, Zea mays
MEAALGALCRAGGWSYAAVWRFHPQDPRLLTLGDCYCEDEAKAMVQEMLNLVEVVGEGILGQALVSGECQWIYDDTCHALNQTSHADNGDLHLGYTWWQHQFLSGIKTIALLPLQLHGLVQFGSTRKVPRSSVFLNQVRDIFDRMKNASSDGPMEYTQNNSLACGQQPILTSSRPVNDMLVHSKVNPLQTEKLLEDIERTESIRSSICSPSNSQRSLNDLTSHGTGNSSMDTNILAMPVNSKSIYDLKRFDNVTELFHRSSNDRIGFQVNSSKEPGSTIAGVMSGYKSLNNIHMTENDSCDQNIEYTPYLYTTTNSSNSGLDELSYSGVALSSSFTAVSGKVKDCLQTESDKFLCKSVSFGSNPCASKFQENRLSPYHALMHEQSLIPDPGESVRLLSQEESFIVQGDSSQFKDTADFTSQGNSTFPELPNRSPEEATAETLENNMKDCSGNNSLLETMMLDLSTNSFVQDWWDNSVLLAENLPNSSEKDPEPAMELANRHSLPTGERGSPFIPVIEQMLGDVAHPPTPTGHSSLEAEATALAGRISDYQLPQFAFRDCLTVDNAQIPALACSNYTCRSRSAQNGSSEVPSANVSVDDTCSLNTANSNGSQSSNPEGTKVAKRRARAGESTRPRPKDRQLIQDRVKELREIVPNGAKCSIDALLERTIKHMLFLQSVNKYAEKIKQADEPKIIDKGSGVILKDNPVAGTNGGATWAYEVAGQTMVCPIIIEDLSPPGQMLVEMLCEEQGLFLEIADNIRGIGLTVLKGRMELCDGKIWSRFLVEANREVTRMDIFLSLVQLLEQNSLVRSTDQMAKVMNNGVPSFANHQRSPLLVPVGIPERLQ

SEQ ID NO: 749 - protein, 792 aa, Zea mays
MAFGRGGKMDGRRPSSSSSSSSFCTTTTVVLFVALCLVGAWMMTSSTVFPLEISSNKKPVVKQQPAPVNFGASQEASPGIAGEGSEKFEDTDNNDATVPEEPNKQDASEQENFNEKPEEKELEVPVEKAETKDMFDDANGKSEGLSDETKNDDGEKSVEKKDNEITNESGDEKTDGESKDGQEEKPDGDAAQEEQPKIEENVEENGEKDQSSNSNEVFPDGAQSELLKESNTQNGSFPTQAAESKNEKEVQALPKSSGDATSYTWKLCNSSASTDYIPCLDNEKAIKKLRTTKHYEHRERHCPEEPPTCLVPLPEGYKRPIEWPKSRDKVWYSNVPHTRLAEYKGHQNWVKVSGDYLLFPGGGTQFKNGALHYIDTIQQALPDIAWGKRSRVILDVGCGVASFGGYMFDRDALTMSFAPKDEHEAQVQFALERGIPAISAVMGTKRLPYPSRVFDVIHCARCRVPWHIEGGMLLLELNRLLRPGGYFVWSATPVYQKLPEDVEIWNAMSTLTKSMCWKMVNKTKDKLNQVGMVIYQKPMDNICYEKRSENSPPLCKESDDADAAWNVPLEACMHKLPGGSKVRGSKWPELWPQRLEKTPFWIDGSKVGVYGKPANEDFEADNAHWKRVVSKSYVNGMGIDWSKVRNVMDMRAVYGGFAAALRDQKVWVMNIVPIDSPDTLPIIYERGLFGMYHDWCESFSTYPRTYDLLHADHLFSKLRKRCKLAAVFAEVDRVLRPQGKLIVRDTADTINELESMAKSVQWEVRMTYTKGSEGLLCVEKSMWRPKELDAST

SEQ ID NO: 750 - protein, 165 aa, Zea mays
METAAVAASGAGRRIMVAVDEGEESLHALNWCLANVVSPAGGDTLVLVHARRPRPVYAAMDSAGYMMTSDVLASVERHANAVSAAAVDKAKRVCADHPHVKVETMVESGDPRDVICDAANKMAADLLVMGSHGYGFIQRAFLGSVSNHCAQNCKCPVLIVKRPKE

SEQ ID NO: 751 - protein, 354 aa, Zea mays
MAAESENGNCKAWAAKDPSGVLSPHSFNRRAVQSGDVSLKIIYCGVCYADVAWTRNKLNDSKYPLVPGHEIAGVVTQVGADVKGFKVGDHVGVGTYVNSCRDCENCNISLDNHCPKAVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFSTSESKRDEAINLLGADNFVISSDTQQMESLKNSLHFIIDTASGDHPFDPYFSLLKVGGVMTLVGFPSEIKMHPASLILGARTLSGSVVGGIKDIQEMVNFCAANNIYPEIEIIKIDYINEALARLVNRDVKYRFVIDIESSFK

SEQ ID NO: 752 - protein, 581 aa, Zea mays
MGKSPAKWIKSVLFGKRSSSRSGSTKAKDLSKGTTNKAAAAAAAAGKEPAFSESSPVISEPVLVSAHNNETAREAAKGENSSVQEVPETDVSQDLEKQGTVGSDTSNDAERLREEQAAVKAQAAFRGYLARRAFRALKGIIRLQALIRGHLVRRQAVSTLRATWLIVKFQALVRGRNVRLSNVSIQATTELSQQNFGGSKPGSWKEKLSSNAFARKLLSSPIVVEALHVQYDEMDPNSAFNWLERWTVSHVWKPISQPKRVGADTKPHTRKASYAMETESAKLKRNARKSPAVPFEPSQTNTTIENEKTRRNPRKLSSTPAESVPDGQLTELEKVKRSLRKVTSSMVETSKVPSPTTEIPDRQEVQCERPLRSAKQAPIHVENQEPQNVNLSENAKMDILVPDIQPDVEVASDLVTITNEEKVDETPSVVAPAAEIMPLQDINSEENALVNDVEERSKEEHSSTDNLKGSKRRSSFSAKPEYPENGSKNSPALPSYMAATQSAKAKLRGNCSPRLSSDSAEKNGFTRRHSLPSPNNGKIISHSPRTQRPTHAGGKDGAKGDKAMLSSRDASERPLKAEWRR

SEQ ID NO: 753 - protein, 665 aa, Zea mays
MAAEEGAMSPTRMLAEGHLRVATGGGAPADGGIAVRHLPHHHPTKKDNVGGKTEKDDHEGVNSLLSEELKKLANGNSKIPGTLDEYRKLVIPIIEEYFSTGDVELAASELKCLGSDQFHHYFVKKLISMAMDRHDKEKEMASILLSSLYADLLSSYRISEGFMMLLESTEDLTVDIPDATDVLAVFIARAIVDEILPPVFLTRARALLPEFSKGIQVLQVVEKSYLSAPHHAELVERKWGGSTHSTVEEAKSKIKNILREYIENEDIDEAFRCIRELSLPFFHHEVVKRALTFGIENISSQPSILKLLKEAAASCLISPNQISKGFSRLAEGVDDLSLDIPSAKALFDKLVSTAISEGWLDASFGKSAAPDEEIQSTSVVKVKRFKEECGHIIHEYFLSDDVPELIRSLEELSAPEFNPIFLKKLVTLAMDRKSREKEMASVLLSSLRLELFSTDDIIEGFVMLLQSAEDTALDIVDAPSELALFLARAVIDEVLIPLNLDEISIKLRPNSSGSQTVQMARALLSARHSGERILRCWGGGTGWAVEDTKDKITKLLEEYNTGGDLGEACRCIRDLGMPFFNHEVVKKALVMAMEKQNDTSILVLLQECFGEGLITINQMTKGFARVKEGLDDLILDIPNAQEKFGEYVELATERGWLLPTFASVP

SEQ ID NO: 754 - protein, 272 aa, Zea mays
MRRAAALLLSLALAAAATTTAAASVAKAPVAAAAPPPAPPNVTAEMAKGGCKAFAGLIAASPDASSTYQSAVEGGMTVFCPSDDAVRAFLPKYRNLSADAKAELLLFHAVPVHYSLGSLKSNNGPMNTLATDGAARNFNFTVQNRGDVVTISTAASGAAGPARVKSTALDEDPLAIYVISAVVEPVELFTPAPAPVPAPAPAPASVADAPRPGKAAAGRRHPPPAAADAPGPAAEDNAAPVDQKDAKKSAAAGAPCALWWLAAALAAASALA

SEQ ID NO: 755 - protein, 494 aa, Zea mays
MVGSVGNGLADLGARAVSMNGARKALRPTEAAAAAAAAETLPMELDPSEALVAAAVEAKGEEAANGRREFVMGRNVHTSCFAVKEPDADDEETGEREATMASVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVDKRATWYQDGISQPPCIARDVGVENCLCGLHK

SEQ ID NO: 756 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMSIAAVAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 757 - protein, 1085 aa, Zea mays
MAEIAERAVAGEVPEEPRPPHGEEDDEGEEEGDVCRICRNHGDEDHPLRYPCACSGSIKFVHQDCLLQWLDHSNSRQCEVCKHAFSFSPVYADNAPTRLPFQELMVGVGMKACHVFQFILRLAFVLSVWLMIIPFITYWIWRLTFVRSLSEAQRLFLSHISAQLILSDCLHGFLLSAIIVLIFLGATSLRDYIRHLRELGGHDAERDDGGRERHGARAVRRLAGPNNRVPADGNVDELAEAQGIGAGELLRRNAENVAARLERLEAQVEQMLDGLDDADGAEDVPFDELVGMQGPVFHLVENAITVLASNAIFLIVVIFVPFSLGRIILYYLSWFFSSASTPMLAKVMPFTETAISIANDTLKSALNVVKNFSSDSNNEGVIGHVIEVVTQSLKINATGLSVIQGTGKNSLMKGTTIASSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKVAMRVAPSMFPLDITIFDPFTEIPVDVLLFQICIPFAIEHFKPRATIKALLHHWFSVVGWGLGLTDFLLPKSEENGGQENLNARAERRDRGHGGREMVAPQVEQLMIQHVAAEDNGRGDSNEANDVTEDSDVDDQGDSEYGFVLRIVLLLVLAWMTLLIFNAGMIVFPISLGRLVFEAVPRLPITHGIKCNDLFSFSIGCYILWSVAAGTRYAIDYITSRQLGFLVQQICKWCSIVLKSSVLLSIWIFVIPVLIGLLFELLVIVPMRVPIDESPVFLLYQDWALGLIFLKIWTRLVMLDQMAPLVDESWRSKFERVRDDGFSRLKGLWVLHEIIMPIVTKLLTALCVPYVLARGIFPLLGYPLIVNSAVYRFAWLGSLIFSALFFWGKRFHVWFTNLHNSIRDDRYLIGRRLHNFGEDSHSPERSESGASIGSDDQDRDIVLRDQEEEVGLRMRRNNMHANQQPRFAL

SEQ ID NO: 758 - protein, 316 aa, Zea mays
MSFLFKSSNGGTTEKIPSPEEQREKINELRKELGEHSSAAIKDFLSDASLARFLRARNWNVQKASKMMKAAVKWRLAFKPENICWDDIAEEAETGKIYRADYKDKHGRTVLVLRPGLENTTSAIGQIKYLVYSLEKAIMNLTEDQEKMVWLTDFQCWTLGSTPLKVTRETVNVLQDCYPERLGLAILYNPPRIFESFWKIVKPFLDHETRKKVKFVYSNDKESQKIMAEVFDIEELDSAFGGKNPATFEYNSYAEQMQDDDKKMGSSHGSANSLLGSAGKEANGADSDASSEASFYSGTDSPTHENGEHSIAKKNG

SEQ ID NO: 759 - protein, 276 aa, Zea mays
MSSMELLHAVVPEKQSEEEVAPAATTTSSSATATGGDEGAHVLQGWAKRKRSRRQRSEEENLALCLLMLSRGGHHRVQAPPTPVPSAAPAAAEFRCSVCGKSFSSYQALGGHKTSHRVKLPTPPPPPPAVTVPAAVPVPEAPAPTTVVVPPLPPVEVGREPATSSTAASSDGAASSRVHRCSICHKEFPTGQALGGHKRKHYDGGVGSAAASTDVPAAPAETSAEVGSSAARAFDLNLPAVPEFVFRCGKPGKMWEEDEEVQSPLAFKKPRLLMTA

SEQ ID NO: 760 - protein, 527 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTSENTKVVIDHGAVPIFVKLLGSGSDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQSVIEAGVCPRLVELLLHPSPSVLIPALRTVGNIVTGDDLQTQCIIDHQALPRLMNLLTQNHKKSIKKEACWTISNITAGNKDQIQAVISAGIIAPLLQLLQTAEFDIKKEAAWAISNATSGGSHEQIKYLVSEGCIKPLCDLLVCPDPRIVTVCLEGLENILKVGQHDKTMGATGDTNVLAQMIDEAEGLEKIENLQSHDNNEIYEKAVKLLETYWMEEEDDAMATAGEAAPAVFDFNQGGNPPAAGGLNFN

SEQ ID NO: 761 - protein, 186 aa, Zea mays
MAAQREKSADVAVAPAHGAAVSGSPSSSSGGPAVSASSSGDRWSAAIGNLGELGANVDALQKLLGRKAVFVDDDIFSKASLAADQARTIKVLDQRVQSLERELDAAISAAARARVEKRQAEAAQRAAELRTREVTEELENTARLFELHMEELRLKQEDIAKKDSDIKVLEAIIRTLSSKDDDGSSE

SEQ ID NO: 762 - protein, 500 aa, Zea mays
MWERGRPPRKPRPSPILVPPPPSSPPPRLNLLLPRSLLALAARAMPSRRPSPVLLLLLALSLALLFLLLSPSFPSTSRFSRSLSSGSAFASSSPASTSASPAPVKIYLYDLPAKFTYGVVRSYKAARATSGSANAAATLPDEQLRYPGHQHSAEWWLFKDLLRRRPQDRPVARVDDPSDADLFYVPFFSSLSLVVNPIRSPLAANASGAGTAYSDEALQEELLEWLERQLYWQRHRGRDHVFICQDPNALYRVVDRISNAVLLVSDFGRLRSDQASLVKDVILPYSHRINSFKGEVGVDGRPSLLFFMGNRYRKEGGKVRDALFQILENEDDVTIKHGTQSRESRRAATQGMHSSKFCLHPAGDTPSACRLFDALVSLCVPVIASDYIELPFEDIIDYNKISIFVGTSKAVQPGYLTSTLRRISSERILEYQREIKKVRHYFEYEDPNGPVNEIWRQVSLKAPLIKLLTNRYKRLLERGTNGTDCSCICSTTPTDITAAS

SEQ ID NO: 763 - protein, 519 aa, Zea mays
MDAVAASDAVLLLATVAISLLITATFWSRHRRQGEAPSPPSLPLLGHLHLLGNGKPLHHTLAALAIARGTGGAPAPLLSLRLGARRALLVSEHAAAEECFTAHDAALGGRPRLLVGDRLNYGYTTVGWSSHGDHWRALRRFMAVELFAASRLAARAADRRAEVAALVGALVRDAPRAGAAVALRPRLFELVLNVMLRALTGAPGHGGGDVRGLQEIIEETFAVTGVMSVGDFYPALRWVDRLRGVDAALLRLQARRDAFVAGLVHDGRRSRNRKAGGGGGPTDTEKRSTIDELLSLQETDPGYYTDTVIKGIVSILLSAGTDTTALTMEWAMAQLLTHRDAMQKARAEIDANVGTSRLVDESDTAHLPYLQCVVKETLRLCPVGPVIPAHEAMEDCAVGGFRVRRGTMVLVNAWLIHRDPRLWEAPEEFRPERFLDATATVAAPLLPFGLGRRRCPGEGMALRLLSLTLAALLQCFDWEVGGAAVDMAEGVGLSMPMAKPLEVVCRPREFVQTVLSAST

SEQ ID NO: 764 - protein, 263 aa, Zea mays
MASLLLVPRLTRSPCSNPGPSAGHKPRPVSITCGPRDNRGPLQRGRSLSTEAILAIQSLKRLTSADRSPAAASAAAATALGRLLKADLVAAMAELQRQGHWSLALAALHIARAEPWYRPDPALYATFVSSAPHSPSGGEGDAEAAVDALVEAFLEEKARGGGFVDGEEDVYKLTRLLRALVAKGRGRAAWRVYEAAVRKGGLDVDEYVYRVMVRGMKRLGFQDEAAEVEADFAEWETTVSPPARDVLDEMRARDEIKTTAAAS

SEQ ID NO: 765 - protein, 186 aa, Zea mays
MACINMYNPDGAAGFGGGPQQPAALGPRISFSSDFAMEPTPVQNRATSLRCQEEDLNFEFSVGSHPMMAADQLFSKGRILPLKDNGGDSVCFAAARPPTTLRDELRGGGDDDERAAFSAAGTKGSNSNRWKEMLGLRKALCVGVGGGGNGSPAKKVSSSDKQGVVAAAAPGPDDHMAASNQQEQLS

SEQ ID NO: 766 - protein, 422 aa, Zea mays
MPRLTPAHATLILDHVLGDPSIPTAVTIALIAGIPSPSDPTPRLRRGVLLRRLATDPVSESSLETLHLLASLPACASPIAAAHIAVAAFLAASAPDFDAVARALFARPDGRARQAVHGGSSPALASDDAIATVDQFEAAVGMSSSQTILRVLWGNRAAVEERVQELLAAEWAAIGPSRLEALAMRIVGDGAVETWGAADEAMRANLRILAGEAKTREILDKLEKTTCNTNPISTPAVEKVMDALKASCADLHSIVEDPLPAAKAVADELLTARMEKLVSLNAQEVGGQPTTCGVAGPSIHNDKDNGPGIGKPHSLMERNATARTSQWEESLGLDGSEPPSPPRPHLPSPRRLPPSPLSPPGNKNNNRRKARRWSLFEEETLRKGVEEYGVGNWRDILDNNAEAFTGRTPVDLKDKWRNMLFR

SEQ ID NO: 767 - protein, 510 aa, Zea mays
MIWHVQNENFILDSTRIFMKAFHLLLFHGSFIFPECILIFGLILLLMIDLTSDQKDRPWFYFISSTSLVISITALLFRWREEPIISFSGNFQTNNFNEIFQFLILLCSTLCIPLSVEYIECTEMAITEFLLFVLTATLGGMFLCGANDLITIFVALECFSLCSYLLSGYTKRDLRSNEATMKYLLMGGASSSILVHGFSWLYGSSGGEIELQEIVNGLINTQMYNSPGISIALIFITVGLGFKLSLAPFHQWTPDVYEGSSTPVVAFLSVTSKVAALALATRILDIPFYFSSNEWHLLLEILAILSMILGNLLAITQTSMKRMLAYSSIGQIGYVIIGIIVGDSNDGYASMITYMLFYISMNLGTFACIVLFGLRTGTDNIRDYAGLYTKDPFLALSLALCLLSLGGLPPLAGFFGKLYLFWCGWQAGLYFLVSIGLLTSVLSIYYYLKIIKLLMTGRNQEITPYVRNYRRSPLRSNNSIELSMTVCVIASTILGISMNPILAIAQDTLF

SEQ ID NO: 768 - protein, 312 aa, Zea mays
MAQDDPVVSAQWLHEHLGMPDVKVLDASWYMPVENRDPWKEYQVAHIPGALFFDLDGIVDRTTDLPHMLPSEEAFAAAISELDIKNQDKVIVYDGKGFFSAPRVWWMFRVFGHKKVWVLDGGLPQWQASGFNVEKASPDDDAVLKSIAANRAVERVYNGEQTNTISFQTEFQPNLFWALEKVAQNVTAKTYQQIDARAKGRFDGVAPEPREGVRSGHIPGSVCVPFPEMFDGAPPSLLLPADELRRKFQHAGISLDRPIVVTCGSGVTACILALGLYRIGKRDVPVYDGSWTEWEAQPSDSDYPKVTAPGTA

SEQ ID NO: 769 - protein, 374 aa, Zea mays
MASEEVATVCADADQEAAAAAAAAAMKEEGGRGKRRRRRQPRKGEEEGGRKKYALVSYHELPEYMKENEFILNYYRSEWPVLNAVLSLFSWHNETINVWTHLLGFMLFFGLTLVHLGQYFPQVADLIGHLSWPISKVAENVSSNIGDVLSGAAMFIQTNPSLASHGTAVASQTTRWPFFVFLAGAMFCLLSSSACHLLSCHSHRLNLLLIRLDYTGIAVMIVVSFFPPIYYIFQCEPRWRAAYLSAITAAGAGTVYALMSPRLSAPRYRARRALLFVGMGLSGVVPAAHAAAANWHEPRRNVTLAYEGAMAASYLVGTAFYLARVPERWRPGAFDLAGHSHQIFHALVIAGALAHYGAAIVFLRARDEMGCPAS

SEQ ID NO: 770 - protein, 252 aa, Zea mays
MRGTAPELQLHIASSRAAPRSPRPASSLAAGAAMDRKSKSAKGAASSAAASMAALAAAAAAGDSSSGPADGAPPPPPHGEEYSVPAKMAAVGDASSSSPVAPRRGVAAALGGGTSSSSPAAARRGAAAAASVVAAGGGGGGPRCQAERCNANLMTEEKPYNRRHKVCEAHSKAPVVLVAGLRQRFCQQCSRFHELSEFDDVKRSCRLRLAGHNERRRKSSADAHAGGGNNGFRQHADQNGRGDPAGNHFQIR

SEQ ID NO: 771 - protein, 346 aa, Zea mays
MSNRATHWCYACQRPIRLRGQDIICPNCSDGFIQEISEMGGVLNTYGLTEPDFEERQARRFGMMDAISSLMRQRLSEIGRDSLFDIHGRQGTGTEYGRRSTAIPTLVFGGIPSPAVGSSDINVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHVPFSFLWPFGPSSSYQYEENVDEPAVYDPNQIAYSAWHYDH

SEQ ID NO: 772 - protein, 243 aa, Zea mays
MSPQSQQQTAIVGEEYCEGEDRELTVRKTTLFTPGDGLEAYDHRTGALAFRVETYGRGGACGGGAARGDLALLGAQGEPVLTVRRRRPSLHNRWDGFLGDGAAHGQKKPVFSARRSSILGAGTGAAAVLVDLLAPGAAGEFRVDGSFPRRCCRVVASARAWAAPVAKEEEEEEEDVVVAEVRRKVDEDAHVMMGRDVFVLWVRAGFDAAFAMGIVLVLDRITGDDVDGDLREDLLEAATSPPA

SEQ ID NO: 773 - protein, 141 aa, Zea mays
MASRCFFPRDASAAADGRHQQSKGAAEALEQLRHGGRLLSREDVGGAVRVRIVVSRRELKQMVAALGDDDGASAAAAAASSERRHRQRGAGAGPGAGPGAEQRLQSLRRRSARRAADAARRTMQAGGEWEPGLQSIPEEVY

SEQ ID NO: 774 - protein, 413 aa, Zea mays
MKLLGWMHRKLRQNSNDVFKEFNNAAGGTCNCITGLAASDPATFLATANEYFTADNDFTNNHPSSPAADLFTFGGSGLLTIGTLGIAAVAVSADADEVDYDVDADADSDFDDNDDTAGDDEDQVDSAVTPTFTYAAPPPIEDATVVEKAAVAVVEAIAEKNDDTTTEDDLMVVSAELEKVLGGRNSGTAGDLVASARVSFAMGVDCPLQGFLFGSPVSDAESRLEQPRDSNGGRRTSLGELFMRTRFAEEKVALVAVEEGEDGGDIGAGGERDDRKAGKGGGGHKTTKKRSAKDEKVPRGDGAQASATVTKSKFHKILQIFHRKVYPESAALARNLTKKSRKRGSGAYHKPEPAASRLRCLKEQRAPGFGCCASRASFGGAASPIDGDDDDELNGSKSGHWIKTDAEYLVLEL

SEQ ID NO: 775 - protein, 617 aa, Zea mays
MSGAALCAALTELGFDGEDPLDADALEWPFQYEEARPLLAWICSCLRPSNVLSPSHLAQYEQLVEEGRLLEGEDLDSAFDSISAFSSKKDNQEAVFGSEETILDIREAKLAYRAEVFELQKQLARQQAQFDLLAGQASTLIQGRRSRVSAMSAVSGELISLDEILSSRNLEMNSVLGRITATTQELAHYHSGDEESIYLAYSDFHSYVVGDLACTKELNRWFSKQFEKGPFRLVAEEGKSKCSWVSLDDITNCLIRGDSEKSHHHQRVAELQRLRSIFATSERQWIEAQVENAKQQAILSILKAQVSSDEAHIHRDIHSLRRKGSELAGELSTLSQKVQALVSETIPCLCSELAQLQGTYILQGDYDLKVMRQEYYINRQKTFINHLVNQLARHQFLKIACQLERKNIASAYSLLRVIESELQSYLSAVNTRLGHYNSLIQAASEVREQGAIDDRDTFLHAVRDLLCIHSNVQATVPTYMSAHALVQQISALQSDLLSLQSELENTLPADRKRCINELCTLIQTVEQLLFASSTTAEPILTPWPLMRALDDMENANAQVEVSVEEVTKARTQKIKIFENRAHEVGRERQIFVDFFCNPERLKNQVRELTSRVKALQD

SEQ ID NO: 776 - protein, 636 aa, Zea mays
MAKDYPASPKAQQLQESKKQRLTYILVVSALCIAFYVLGAWQNTTLPKPIGNSAITRVGCDPTAATTQSSGSVPSFGPGSGEVLDFDAHHRLTINNTDGDGELQQFPACPLNFSEYTPCEDRRRGRRFDRNMLVYRERHCPGKDEQVRCLIPAPPGYRTPFKWPRSRDYAYFNNIPHKELSIEKAVQNWIQVEGDKFKFPGGGTMFPRGADAYIDDINKLISLSDGKIRTAVDTGCGVASWGAYLLKRNIIAMSFAPRDTHEAQVQFALERGVPAIIGVMAKQRLPYPSRAFDMAHCSRCLIPWDEHDGLYLAEVDRILRPGGYWILSGPPINWKTHHRGWERTKDDLKREQDKIEDVAKSLCWNKVVEKGDLSIWQKPKNHLECANIKKTYKTPHICKSDNPDAAWYTQMEACVTPLPEVSNQGEVAGGAVEKWPERAFLVPPRIKRGMIPGLDAKKFDEDKKLWEKRVAYYKRTIPIAENRYRNVMDMNANMGGFAASLVKYPVWVMNVVPVNSDRDTLGAIYERGFIGTYQDWCEAFSTYPRTYDLLHADNLFSIYQDRCDITGILLEMDRILRPEGTAIIRDTVDVLTKVQAITKRMRWESRIMDHEDGPFNPEKVLMAVKTYWTAEAEEEH

SEQ ID NO: 777 - protein, 198 aa, Zea mays
MKCWCVHSPRGAMATPLSSPLAPTALRSPLRHRALLLLLPFPPRAASSGEDAAAAADQEPAPAATKTATADDDFEERVLRIKSRVGPKKRGARKKKAAASASASAVTLPPVPLREPRSALGAPVELGFTAYSERLNGALAALGLAAVLLVELGSGQALVKYHQPATLFLQAYTVAAAAALFVKYEKERISTWPGPPAK

SEQ ID NO: 778 - protein, 923 aa, Zea mays
MAEAISATSSCLEPLCGCLESTGVFEAVGREVAAFLRIKSNCGDLEKARDSLRAVETTVRARVTAEEDKLNVCDPQVQAWLKRVDELRLDTIEEDYSSLSRFSCLCQCTVHARRRASIGKRVVDALEEVNKLTEEGRRFRTFGFKPPPRAVSQLPQTETVGLEPMLARVHDLLEKGESSIIGVWGQGGIGKTTLLHAFNNDLEMKDHHYQVVIFIEVSNSETLNTVEMQQTISDRLNLPWNESETVEKRARFLLKALARKRFLLLLDDVRKRFRLEDVGIPTPDTKSQSKLILTSRFQEVCFQMGAQRSRIEMKVLDDNAAWNLFLSKLSNEAFAAVESPNFNKVVRDQARKIFSSCGGLPLALNVIGTAVAGLEGPREWISAANDINMFSNEDVDEMFYRLKYSYDRLKPTQQQCFLYCTLFPEYGSISKEPLVDYWLAEGLLLNDRQKGDQIIQSLISACLLQTSSSLSSKVKMHHVIRHMGIWLVNKTDQKFLVQAGMALDSAPPAEEWKESTRISIMSNDIKELPFSPECENLTTLLIQNNPNLNKLSSGFFKFMPSLKVLDLSHTAITTLPECETLVALQHLNLSHTRIRLLPERLWLLKELRHLDLSVTAELEDTLNNCSRLLNLRVLNLFRSHYGISDVNDLNLDSLKALMFLGITIYTEKVLKKLNKTSPLAKSTYRLHLKYCREMQSIKISDLDHLVQLEELYVESCYNLNTLVADTELTASDSGLQLLTLSVLPVLENVIVAPTPHHFQHIRKLTISSCPKLKNITWVLKLEMLERLVVTHCDGLLKIVEEDSGDEAETTMLGQGHPSEEQEDKRIDGGQSVCKSDDNAHAELLNLRSIVLTDVKSLRSICKPRNFTSLETIRVEDCPNLRSIPLSSTYNCGKLKQVCGSVEWWEKLEWEDKEGKESKFFIPI

SEQ ID NO: 779 - protein, 291 aa, Zea mays
MARKCSHCGNCGHNSRTCGRETMLCEAGDNGGYGGLRLFGVQVRIGGGGAGSASMKKSYSMDCLQLAAPGCSLVSPSTSSSSSSLLLMSIEEGSERGAPNGYLSDGPHGRAVQERKKGVPWSEEEHRQFLSGLEKLGKGDWRGISRSYVPTRTPTQVASHAQKFFLRQSSLGKKKRRSSLFDMVPICENSASISDPLSSEGASTSLSLNVPRHGVTSVSERAALDLNSTEEDDSGADASSASASGAGTRPPFPAAQTEPLQPSSLGRGRGHHCSPLDLELGMSLPAPSIGT

SEQ ID NO: 780 - protein, 611 aa, Zea mays
MDKIQSDCPYPGCFFCVMKEANPSKRRASVLKFFRELPSQDDDGQVLPVSGLWNTAMAHPNDPEFINLGIFECMAALIWKGLKNRRWLAHDQNIYVPYYAAHIIGSYTMNMEEFAECAVRAGVIPPLVELLRGRLTWVEQRVAVRALGHLATYPSTFPAVADNGEVLELATQLASSTLEIVYTHFYQFVDRRLDYHCGLLTRGIGGVEMESRKAEEWASQLQCWSLQLINCFAFKPEFLHDICKPDFLVKLPGMWGGLVNENSPAGVGLLRTICQSKVGRGDAANIPGTIDALCNIARSSDDWQYMAVDCLIWLVQDASTCHKVIDKVAPILIDLADISTLGDYKKLGDMIVTVLQECMQQSGNSRGAISAQTKAEIDELLRSKQSLKLEKSMPKEDLHIKQAAALVVKLEGNSLFSSGNIAGAAEKYSEALALCPMKSKKERVVLYSNRAQCYLLLQQPSAAISDATRALCLHSPVNRHAKSLWRRAQAYDMLGFAKESLLDTILFINECSQSNDPDLSLKQNKVPDYAERLVKKQMRAAWLFREAALKHGGVRRAGDASDAAFGQEADDSEWETASESDGENGAATGGEADGETGWKNGGRQEDFCEKS

SEQ ID NO: 781 - protein, 84 aa, Zea mays
MASLLSLYGGDAAGGRRRMSRGSGTAPAPVRRLLRRLRSSFIRRSAARPRTRAAARFAYDLRSYSQNFDDGVISSSAPAATARA

SEQ ID NO: 782 - protein, 406 aa, Zea mays
MASSSCVRLHHLPSTSRRSSAPGAPTNLQFRAASCRWRRRVLVPGAASPPLRLCATGSPQPPLGSDSNAPLSRGTREEGEEVEEQRQPPPPLRLKIAVVGFGNFGQFLARTLVAQGHTVLAHSRSDHSAAAAAMGARFFPDAHDLCECHPDVVVLATSILSAESVVRSLPLHRLRRDTLFVDVLSVKEFPKRLLLGALPEEMDIICTHPMFGPESAPSGWTGLPFVFDRVRVGDSCPARRARAEAFLGVFAREGCRMVEMSCAEHDAHAAETQFLTHTVGRMLAALELRATPVDTRGYETLLRLVDNTCRDSFDLYNALFMYNDNSTELLHRLDWALGAVKRRLFDGLHGVLRRQLFGVEDGEGPAERTELLAVVPGGGPPDTDDQGGDGRDGDGDGDESGEQKND

SEQ ID NO: 783 - protein, 172 aa, Zea mays
MDDRTYKGGIKAYWKRRGYYRMDGDAARRRQPLPTVELGNGVSQAQAQAQPPVGDGSGRRRRCRGWRVRRGQLGRRLLRALSPRRWLMRLRDAYVSAMLRLASSPAVGYGAGAPFCATATHGAAAAAAFARPAQLKEYDEKVLVEIYRSILARGGPLAGAPAAATLRLPTAV

SEQ ID NO: 784 - protein, 496 aa, Zea mays
MAADAAAAATLRTALSQATGQEQRASLLCTPKHRVAASRRSLRFTTRASSNAGASVSIPKQWYNLIADLPVKPPPPLHPQTHQPLNPSDLSPLFPDELIRQEVTDERFVDIPEEVIDVYKLWRPTPLIRARRLEKLLGTPAKIYYKYEGTSPAGSHKPNTAVPQAWYNAAAGVKNVVTETGAGQWGSALSFASSLFGLNCEVWQVRASFDQKPYRRLMMETWGAKVHPSPSTATEAGKRILEADPSSPGSLGIAISEAVEVAATSADTKYCLGSVLNHVLLHQTVIGEECLEQLAALGETPDVVIGCTGGGSNFGGLAFPFLREKLRGRMSPAFRAVEPAACPTLTKGVYAYDFGDTAGLTPLMKMHTLGHGFVPDPIHAGGLRYHGMAPLISHVYELGFMDAVAIQQTECFQSALQFARTEGIIPAPEPTHAIAAAIREALECKRTGEEKVILMAMCGHGHFDLAAYEKYLRGDMVDLSHPAEKLEASLAAVPKV

SEQ ID NO: 785 - protein, 530 aa, Zea mays
MPPLHVPGSSTPRKFYHLVLFHVHPFWIQVLYFLLISVLGFLMLRVLPMKSSSVPRPSALDLLFTSVSATTVSSMIAVEMESFSNAQLLLMTLLMLLGGEVFTSMLGLHFTCTKLRNKRETPHNNLHGNSLEQSRRRHRPMEIEAHAAAVQMELAGFNKDGHGDFASMARLLMFIVLGYILVVHIAGYALILIYLSVVGSARAVLVRKRISLSTFSVFTIVSSFANCGFVPTNEGMVSFKSFPGMLLLVMPHILLGNTLFPIFLRLSITALERVTRWRDLCELLRDRGPGGGPAAAAAAAAIGYDHLLPGPRTWFLALTVAVFLAVQLVLYCAMEWGSGGLGGLNAFQKLVAAVFMSVNSRHSGEMVVDLGTVSSAVVVMYVLMMYLPPYTTFLPVAVEDDQQLQNEAQPHDNSSRSISIWHKLLMSPLSCLTIFIVVICITERRQIARDPINFSVLNIVVEVISAYGNVGFSTGYSCSRQVTPDGSCKDAWVSLSGKWSVEGKLTLMAIMFYGRLKKFSMLGGQAWRLN

SEQ ID NO: 786 - protein, 374 aa, Zea mays
MAATSSLKSSLLLPSTISDFSGAAAAVSISTQKRRSRGARVQVSAAADSKNILVMGGTRFIGVFLSRLLVKEGHQVTLFTRGKAPITQQLPGESDAEYADFSSKVLHLKGDRQDFEFVKTSLAANGYDVVYDINGREAVQVEPIIEALPNLQQYIYCSSAGVYLKSDILPHCEVDAVDPKSRHKGKLETESLLTSRGVNWTSIRPVYIYGPLNYNPVEEWFFHRLKAGRPIPIPGAGNQITQLGHVKDLARAFNLVLGNPQASKQIFNISGAKYVTFDGLARACAKAGGFPEPELVHYNPKEFDFGKKKAFPFRDQHFFASVEKATSELGWTPEFDLVQGLTNSYNLDFGRGTFRKEADFTTDDMILDKKLATV

SEQ ID NO: 787 - protein, 273 aa, Zea mays
MAMALASATAAALFRSALSAPHGAGARVRPQRRQPFLAPLHAAKGPGSAPVVLEGKAKGKKKKGPSSGNLPAALDVEIREAQEYLDSDQQEPVPENFPFELIDEEGMSVVILRRDYKDEKVEVTVSMPNLEGGPEFGDEDGEGDGESAAKDDGEAEEDDESAGESSISLKVVVSKDSGPELEFTCTAFREEITIDDMLIVEKTDDDDDGEEKFPYEGPEFTELPVNVQKGLFKYLEQRGVTLSATNYMHDYMVTKQAQEYIRWMTKLKDFVAQ

SEQ ID NO: 788 - protein, 416 aa, Sorghum bicolor
MPDVQPLVSDFVLKLKRRKVEGSHAVARQTAELLRSVVSQHRMVSSANQAAALADAVRAVGEQLIAANPVELAVGNIVRRVLHIIKEEDISSTAVGIEGLSVTVDSDDEYNSEHDDRPALSAAVLAAHARNALRAPSLQTLLEDIPVSPAVSRTASSTGDSDGKSKSAGDKSSTRKLKHDVIAAIGDLIDEIDSCYEPISEQAVELIHQNEVILTLGRSRTVKEFLYAAKEKKRSFRVFVAEGAPRYQGHVLAKELVEKGVQTTVITDSAVFAMISRVNMVIVGAHAIMANGGVIAPVGMNMVALAAQRHAVPFVVVAGSHKLCPLYPHNPEVLLNELKSPSDLLDFGEFSDCMNFSTQDGSPLLNVVNPTFDYVPPKLVSLFITDTGGHSPSYMYRLIAEYYSADDLVVRRKATS

SEQ ID NO: 789 - protein, 345 aa, Sorghum bicolor
MTPLDCDMPPAASCKKRLSPSRPLPNRCLLILIVALAAAAAVASAQLSSEDYYDASCPAALFTIRTAVSTAVLLDRRMGASLLRLHFHDCFVQGCDASVLLDDTASFTGEKGAGPNAGSLRGFDVIDNIKMLLELLCPQTVSCADILAVAARDSVAQLGGPSWSVPLGRRDATTASASLANSDLPGPTSNLNGLLNAFSNKGLSSTDMVALSGAHTVGRAQCKNIRSRIYNDTDIDATYAASLRASCPAQAGGASDGALEPLDDATPDAFDNAYFGNLLSQRGLLHSDQALFGGGGGATDGLVSTYASSADQWGSDFAAAMVKMGNISPLTGTDGEIRVNCRRVN

SEQ ID NO: 790 - protein, 234 aa, Sorghum bicolor
METAAAAMLEAGVGRFSRAPAMATALLAEMWAPLAVALAALATLPSLLRRLQVIVLRLRSRGKEVIQSHIGTYYSSCDEEDGSDDEDESSDDEDEDASSSGDDGEGEDLKRIGFYEGASDGVFPWGGAVVRTWQGLPRRFSGCASGIGGGFGGATGGAFPGAVRLWGASTASGGEPWWAAVCSADEGGCRRDGGAAAAAEADQVVVGWRREHASQQQQQRRRRRRAVPLAHTGQ

SEQ ID NO: 791 - protein, 594 aa, Sorghum bicolor
MAVEEAAESCGSHAAAAAASGGRAAGPATSSSSAAAAAALARKQQQQQRHKLEVYTEVLRRLQDAGPPDARAPGFDDELWNHFNRLPARYAMDVNVERAEDVLTHKRLLEQAKDPAQRPAFAVRAVQVSPILDGNQIDADSNTAGEEVASRLNRQQSIHPPAFGSSTNLEALALEASKSHQDHDSTSDNGRSLYRPMHEITFSTIDKPKLLSELTSLLGELGLNIQEAHAFSTNDGYSLDVFVVVGWHDEETEDLVEAVQKEIGRIEETQAWSSSHSWSTPVENIQIAENSAADHVEIPTDGASEWEIDVKLLKFGNKVASGSYGDLYRGTYCSQDVAIKVLKPERINADMQREFAQEVYIMRKVRHKNVVQFIGASTKPPNLCIITEFMSSGSVYDYLHKHKGVFKLPALVGVAMDVSKGMNYLHQNNIIHRDLKTANLLMDENGTVKVADFGVARVKAQSGVMTAETGTYRWMAPEVIEHKPYDHKADVFSFGILLWELLTGKIPYEYLTPLQAAVGVVQKGLRPTIPKHTHARLSELLQKCWQQDPAQRPDFSEILETLQRIAEEVGDEHEGKHKDRTLGGFFSAFRGRSH

SEQ ID NO: 792 - protein, 782 aa, Sorghum bicolor
MDCSQDSQEESHQRRENGEEAEKAADYGNALSRKEATEELLGCVVHSEEEAYRLYCDYGHRIGFSVRKGKQSYFIGTKNIRTKDYYCSKEGLKYDEPVTEANFNRPDTRTNCKAMIRFRVDEKGRWTVIRFVPVHNHQLAKPGERHMLRSAKSLAVGKSGVIDPSASTESHPINGFSDMTGDIAENSGYTIRECYNQVCMQNITIIEAGDSQSLVSYFKRRTNEEGMFYWDVQVDQEGRMTNFFYRDGKSRNDYGCFGDAIIFDTTYRTNKYNLICAPFVGVDHHWQNVVFGCAFLLDESVTSYAWVFKSFLESMGGRSPKSIFTDQDEAIMQAVEQVFPNTQHCFSYWHIVKNAQSHLGSLNTSQAFQSMFTKCMQGSDSEEDFKESWTAMIQEYKLQDNSWLIDLYAFHRKWCSAFNKDTFDGGINSSQWGEVSSNIFNGISDENTSLTRFALLLEKVVKDLRRNESEEDFRCSQTAPVRAIKHSTVLKQAAESYTHRIYKLFEAEFLDGCGATSCHETSSGGNLLRFGITMQGRGSKVWDVVLDTSTMEISCGCRKFERMGLLCSHALKVFTLQNVDTIPEKYVLKRWTKDARRSMYTLAQDDSTQQECTEAELAYRNRAMQYAYNLIIKSQELEESRKIFWDSLETGEKALEVFFEMRNMRTQAAKDANKNEKKKKKTSKGPNPKKAKQAPGVSSTDLELIVQTNEHQFQSSQDAQGNATIGRPYYYQVPQTFPNAPIQPNQMYMHPNMHTVPLCTPQQDLSAFAIRPNSTFGGAKNI

SEQ ID NO: 793 - protein, 439 aa, Sorghum bicolor
MPPATGAVASPPAAAGTVLLGRYELGDLLGRGASAKVYLARDLLTGRSLAIKSFPNPRAAAAGDRPVAIEREAGILRRLRHRHVVRLHEILATRKKVHFVLDLAAGGELFSLVDASGRMTEDLARHYFRQLVSAVRYCHARGVYHRDIKPENLLLDESGALMVADFGLGAVAGTADGGGSLLRHTMCGTPAYVAPEILSRKGYEPAKVDIWSCGVVLFVLAAGYLPFNDASLVNMYRKIYAGRFRCPGWFSPALRDLLRRVLDPDPSARIDADGIVAHPWFRHGASDEELGRLMHGGGGEQEEEEEAWFGPVGESKADEEDREPTAFDILSFSPGSDLSALFLGAGKERVFVGEPVAAVVARVEAAGRKGGYRVRRDGKRATAVYVEEEESGVVVAKVSVFRIADAVSVVEVVKGDGPDAVVFWSELLEPAVKPPALSC

SEQ ID NO: 794 - protein, 429 aa, Sorghum bicolor
MATAARDRRLPPALPLATLIGRELRAGGSERPALRYGHAGFAKRGEDYFLVKPDCLRVPGDPASAFSVFAVFDGHNGVSAAVYSKEHLLEHVMSALPPDIGREDWLQALPRALVAGFVKADIDFQRKGEVSGTTATLVVIDGFTVTVASVGDSRCILDTQGGELQLLTMDHRLEENAEERERVTASGGEVGRLNLFGGQEVGPLRCWPGGLCLSRSIGDMDVGEFIVPIPHVKQVKLSNTGGRLIIASDGIWDALSNEAAAQACRGLPAELAAKLVVKQALKTSGLKDDTTCVVVDIIPSDHLTSPQLSPKKNQNKLKSLFRRRSHSSVGKLGGKSASIGSVEELFEEGSAMLEERLGRNLSLKAASPPFRCAICQVDQEPFEDLMTDNGGGYCSSPYAPWGGPHLCLDCRKKKDAMEGKRSSRSTACR

SEQ ID NO: 795 - protein, 1075 aa, Sorghum bicolor
MLRNGNEGMSTIPGFSQIQFEGFCRFINQGLAEELEKFPTIKDPDHEIAFQLFAKGYQLLEPSIKERNAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLAQVFDQTNPLTQTVHGRKVSCLGPGGLTGRTASFRSRDIHPSHYGRICPIDTSEGINVGLTGSLAIHARIDHWWGSIESPFYEISEKAKEKKERQVVYLSPNRDEYYMIAAGNSLSLNQGIQEEQVVPARYRQEFLTIAWEQIHVRSIFPFQYFSIGGSLIPFIEHNDANRALMSSNMQRQAVPLSRSEKCIVGTGLERQTALDSRVSVIAEREGKIISSDSHKILLSSSGKTISIPLVAHRRSNKNTCMHQKSRVPRGKSIKKGQILAEGAATVGGELALGKNVLVAYMPWEGYNFEDAVLISERLVYEDIYTSFHIRKYEIQTDTTSQGSAEKITKQIPHLEEHLLRNLDRNGVVRLGSWVETGDILVGKLTPQIASESSYIAEAGLLRAIFGLEVSTSKETSLKLPIGGRGRVIDVKWIQRDPFDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKQTKNPWVFEPEYPGKSRIFDGRTGDPFEQPVLIGKSYILKLIHQVDEKIHGRSTGPYSLVTQQPVRGRAKQGGQRIGEMEVWALEGFGVAHILQEILTYKSDHLIARQEILNATIWGKRVPNHEDPPESFRVLVRELRSLALELNHFLVSEKNFRVNREDV

SEQ ID NO: 796 - protein, 810 aa, Sorghum bicolor
MALTRLLMMASRPPCSLSLSLPSPSYKTSRCCCCHCHRGRRLLRSAMRVGACHDLSTVTPTPRQQSMAAQLDRGSLLVGGRELLVRAPPNVTLRPAGEAAAAADSGAAFLGATAAAASSRHVFSVGNLASGWRWLSLFRFKIWWMIPATGAGAAAMPAETQMLLLEYRSEARTERGSLYALMLPVLDGGFRASLQGSPEDELQFCFESGDPDVQTMEAVDAVFINSGDNPFKLLKESIKMVSKIKGTFSHIEDKEIPSNLDWFGWCTWDAFYKAVNPSGIEEGLQSLREGGVPPRFLIIDDGWQETVDEFKEGDEAIREQAVFAHRLSDLKENHKFRGETCKNLEDLIKKIKEKHGVKYIYMWHALLGYWGGVLATSDAMKKYNPKLLYPVQSPGNVANLRDIAMDSLEKFGVGIVDPDKIYEFYNDQHSYLSSVGVDGVKVDVQNVLETLGRGLGGRVAVTQKYQQALQESIAQNFKTNNLICCMSHNSDSIFSALKSAVARASEDFMPREPTLQTLHIASVAFNSLLLGEIFIPDWDMFHSKHESAEFHGAARALSGGGVYVSDKPGVHDFNVLKKLVLPDGSILRARYAGRPTRDCLFTDPVMDGKSLLKIWNLNNFTGVIGVFNCQGAGQWVWPVKETAYVPINVNIIGQLSPSDVESLEEIAGDDWDGETAVYAFGSCSLSRLQKHKSLEVSLSTMACEIYNISPIKIFSEAVWFAPLGLIDMFNSGGALHNVSSVADSSATTVHIRCRGPGWFGAYSATRPELCRVDEHEVEFTHAEDGLLTFYLPLSSSQDNLRHIEIVYRAL

SEQ ID NO: 797 - protein, 160 aa, Sorghum bicolor
MMMAEVANHSKRNHTDSYFSGKAAAVAVSATGPEEFASMSSKKPRNTSPRIAPVSPKEKKDKIGERVAALQQLVSPFGKTDTASVLQEASGYIKFLHQQLEVLSSPYMRAPPAPGAVPEDPEHYSLRNRGLCLVPVDLTLQLTQSNGADLWAPANTTRRR

SEQ ID NO: 798 - protein, 461 aa, Sorghum bicolor
MARWAEMVEEDDDDEYAKLVRRMNPPRVVIDNDACDNATVIRVDRVKKHGILLEAVQVLVDLNLVITKAYISSDGNWFMDVFNVTDQDGSKLQNREVIDHIQKCLESDGYLPPPANGGFVPPEDQFTSIELTGADRPGLLSEVCAVLAALSCNIVKAEVWTHDRRAAAVIQITDEATGLAIHDVGRLSKAQELLSNLMQSDGRCNRGATGVSVGTARTERRLHKMMLDDRVGGGEEAVGGGEERGGCGKARHKAAKVVVMDCTERQYTVVILRCRDRPKLLFDTLCALNDLQYVVFHGTVDAEGASKEAYQEYYIRHVDGHPVRADAERTRLVRCLEAAVERRASNGLELELEVRTEDRVGLLSEITRVFRENSLSIIRAAITTKDGKAEDTFYVSDTYGNPVDGRTIDAVGEQLGHAVLRVKRRGHDASVKHEAEGGAVSVLGSLLKGSFQGLRLIRSYS

SEQ ID NO: 799 - protein, 679 aa, Sorghum bicolor
MASGATSDAWPSSPYSSSAPDGEVLRSLHRLARDLSAAEAPAPFLRAVFAAVARRARLLAAVFDDLLLCGAAAGPLLLLPRSASLCLRELLLVLQRFKALVADCAARSRTRLLLQSDEVAARARELQHDLATLLDLLPVADLGLADDVSDLLALASRQCRRAVAAPELELKAGVLALIQEVEREIVPGRERLEGVLEDVGINDPASCSDEIETLEREIGDRVAERWTSSMIALVGLLRYAKCVLFSAATPRPVDSNKVDLDDGDGDDGAEPPSPPLDFRCPISLELMADPVVASSGQTYDRDSITRWFGSGKSTCPKTGQVLPNLELVPNKALKNLISRWCRENGIPMESSESGKSEPAPVVVGANKAAQKAARMTASFLVKKLSASFSPEATKRVVQEIRQLAKSGSDNRAFIGEAGAAGLLVPLLRSEDSALQLNAVTALLNLSILEANKKRIMHAEGAVDALCHVMCSGATWRAKENAAATVLSLAAVHAYRRRLGRNPRVVDSVVQLARAGPASTKKDALAALLCLSAERENVPRIVEAGAAEAALSAIGDAEAAAAVLASLAKRGGAEAIVALDGAVARLVAEMRRGTEWSRECAAAALVLLCRRAGAAAASQVMAVPGVEWAIWELLGTGTERARRKAASLGRACRRWAAAANAEQGTECPTSGDASGLTVAS

SEQ ID NO: 800 - protein, 307 aa, Sorghum bicolor
MEERIPQRPREAQAPTVAEPAPTTGKPCDDGDALAPAIQLLSSSSSGEESSDDEGELEFEFPFVSRDSPAGTAAPADELFADGRIRTFYPVFGRGASSHGGCTTRPAAPAAAPPRVRGQLGKLFLEETRERNSSTSSTSSSSSSSGAATDDDGLEGVAPESYCVWRPGSSASPSPPTPPRKSGSTGSMARWLRISDLAVGRSHSDGREKFLFLAAAPAHDAPRRSKKPAPVPARPAGARKPAPSAAVAAADADTAAAHRIAHLARGGLGVPVPPGGTPRRTFLPYREELVGFFANVNGISRSHHHPF

SEQ ID NO: 801 - protein, 395 aa, Sorghum bicolor
MGVGKLMNDVKPYLAMVLLQVGFSGMYIVSVASLKRGMNHFVLVVYRNLVATVVMAPFALIFERGVRPKMTPLIFLKIMGLAVLEPVLDQNMYYLGAKLTSATFGSALVNILPAITFLLALVMRMEKLRLRSLHSQAKVVGTVCTVAGAVLMILYHGPVVPFPWSSAGHHHAAAAAAAAASQSSASWLNGTVMIIGSCLCWSGFFILQSNTLQSYPAELTLATLICFLGSVLTGGVALVAERHDMSAWIIGFDTRLFTAVYSGIVCSGVAFYVQGIVTQARGPVFVTAFQPLCMIITTVLGSTILKEETTLGSVIGAVIIVVGLYCLIWGKSKDHLGSNGKPGAAAVAGELPLTSAPTANNGSYGKHAALGGGHHVVTGVETTPPPPPCVPKCVH

SEQ ID NO: 802 - protein, 419 aa, Sorghum bicolor
MATVSMDIPKPSALTAAGHEAATAKTRGGGEGLGKYYNQHIQDLLLAVQQRISDLSRLEAQRNDLNSQVKICREELHLLQEPGSHVGEVVKVMSKSKVLVKVHPEGKYIVDVDKSIDIAKLTPSTRVALRSGSYMLHVILPSKVDPLVNLMKVEKVPNSTYDMIGGLDQQIKEIKEVIELPIKHPELFESLGIAQPKGVILYGPPGTGKTLLARAVAHHTDCTFIRVSGSELVQKYIGEGSRMVRELFVMAREHAPSIIFMDEIDSIGSARMESSGSGDSEVQRTMLELLNQLDGFEATNKIKVLMATNRIDILDQALLRPGRIDRKIEFPNPSETSRFDILKIHSRRMNLMRGIDLKKIATKMNGASGAELKAICTEAGMFALRERRVHVTQEDFEMAVAKVMKKDTEKNMSLRKLWK

SEQ ID NO: 803 - protein, 220 aa, Sorghum bicolor
MSVVAAVGPVAAAAAAAAAGAYGHGQPLCGGGGGGARKRKDVGVVQDQEAGLRGSHVGAAAPRRGAGLFVLETVEEEAEAERLSSIGAVSEDEEEDGEEVNSGGTSSSTTKGAALASMDMDALDDALPIKRGLSNFFSGKSRSFANLQDAASAVTSARDLAKPENPFNKRRRVLRCCSIRRVASTSLTELPPFFLPPTTDPGSTGDDDDGCGAGGRRHSG

SEQ ID NO: 804 - protein, 143 aa, Unknown
  Sequence found in Organisms: Hordeum vulgare, Triticum aestivum
MAAALSLRAPFSVRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 805 - protein, 523 aa, Triticum aestivum
MGDDHGAKLVKSLRGAAQKYVGVGFFLGFFLVLLTYFTLSEQFAIAAPNAIRRTSAAHPTPTTPAVAEKTVQQQQLPVKKEEAPLPEHEQVQEKPPPVDEEPHRETEEPNSETEEDPKPIDEASKIVTTAEESAPAKKPACDIQGPWASDVCDLAGGSGGVRIHGSTHTVLVPPTIESGGSNPNPQEWRVLPYSRKHMSGIKEITVRELPTAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPTKEPTGHSMPEFTKFLRNVFALPRAAPMRVTAGSDKKPRMMIISRRHPRKLVNVAEVVALAKRIGFEVVIGDPPFNVDVGDFAREVNAADVLMGVHGAGLTNSLFLPTGAVFIQVNPFGKMEHIGEVDFGTPAVDMGLKYMAYSCGMEESTLVDTLGRDHPAVKDPESIHRSGWSKVAEYYLGKQDVKLDLQRFEPVLLKAMAMLRE

SEQ ID NO: 806 - protein, 131 aa, Triticum aestivum
MASTGVKDFYRQKKKGGVGKTSASSKKKTQNYTGGASVGASNKAQTAALISHGSLDLRDDFSEQEEQLRQFDMDMKFGPCIGVNRLQRWERASAMGLQPPPHLRDLLARASSGNNRNNGGPSPECLWEGKI

SEQ ID NO: 807 - protein, 349 aa, Triticum aestivum
MGSNDPSTPSKASKPPEQEQPPATTSGTTAPVYPEWPGFQGYPAMPPHGFFPPPVAAGQAHPYMWGPQHMVPPYGTPPPPYMMYPPGTVYAHPTAPGVHPFHYPMQTNGNLEPAGAQGAAPGAAETNGKNEPGKTSGPSANGVTSNSESGSDSESEGSDANSQNDSHSKENDVNENGSAQNGVSHSSSHGTFNKPMPLVPVQSGAVIGVAGPATNLNIGMDYWGATGSSPVPAMRGKVPSGSARGEQWDERELKKQKRKLSNRESARRSRLRKQAECEELGQRAEALKSENSSLRIELDRIKKEYEELLSKNTSLKAKLGESGGGGGSDAVPDMNERGDTNGGSHQKEP

SEQ ID NO: 808 - protein, 317 aa, Hordeum vulgare
MSSKKIELDHKDMVHDSAIDYYGKRLATASSDSTVKITNIGGASAPSQLVATLTGHYGPVWRVGWAHPKYGSILASCGYDGRVIVWKEAATGQWSQLYVFDNHKASVNSIAWAPYELGLCLACGSSDGTISVISMRLDAGGYDAATIERAHPVGVTAVSWAPAAPLGSMVGSGQLVHKLVSGGFDCVVKVWEFVNGGWKLESAMVSDMHKECVRDVSWAPVLGLAKSTIASASQDGKVVIWTSGKAGGKWEGKLMRDFEAPVWRVSWSLTGNILSVAAGEGDITLWKESSDGQWESLWTKASEEQPQEQAAIEEAMQ

SEQ ID NO: 809 - protein, 509 aa, Zea mays
METEMVAAAAAALCCALALYLYHALWLAPGRVRAALRAQGVAGPRPSFPYGNRADMRRATAGHRGGGGVVHDYRQALFPHYERWRKEYGPIFTYSIGSMVFLHASRSDVVRDLCLSVSSLDLGKSSYMKVTHRPLFGDGILKSSGEAWAHQRRLIAPEFFPDKVKGMVDLMVGSATALVASWGDRTGGGGVELKIDDDIRAYSADVISRTCFGSSYVKGKRIFAAIRELQKAVSKPNLLAEMTGLSFLPTRTNREAWRLNRVVRDLVLDVVREGGDDDRNLLNAMLRSASSSGGCSGDRVAVEEFVVDNCKNIYFAGYETTAVTAAWCMMLLALHPEWQDLVRDEVRQACGGGDFASLHKMKKLTMVIQETLRLYPAGAVVSRQALRDVTLGGVRVPAGVNIYVPVSTMHLDPELWGADAREFDPGRFADDHQRQRQPHAYLPFGAGARTCLGQAFAMAELKVLLALVLSRFRLALSPAYVHSPALRLIVEPEHGVRLLLTNVEPRGAS

SEQ ID NO: 810 - protein, 246 aa, Sorghum bicolor
MPKIKNLSNACKVSFSPQGPISEEALERVRALLDEIRPLDVGLDNEAQIARNWTSTTRPSNGRRGRNGANQFAAPIKYLHIHESESFSMGIFCMPPSSVIPLHNHPGMTVLSKLLYGRLHAESYDWVDVPDHPIDQLQSRPAKLVKDCEMTAPETTILYPNAGGNIHTFRAITPCALFDVLSPPYSAEDGRHCSYFRKSQMNQPPVVLPAEIDSSQVIWLEELEDHQPPEGFVVARGLYKGPVIRR

SEQ ID NO: 811 - protein, 533 aa, Sorghum bicolor
MATGTDRPWWAPPPTPKPPAAVPSAPRFPSPPSPSSSFTADPPAEFLCPISGTLMADPVVAPPGQTFERACIQACAALAFSPPAVAADLSQSHHSSSSSSPLVLVPNVALRTAILNWCDRLALPHPAPLSPDTAHDIVRRLMPPQQRSSLAQPQRPQTQVASSVRVRRPSVFDGFAQVQEPSSRQRGDALEEEIMAALGADGATPAEQASAMALLRQATRENQEVRRQLCTPRLLAALRPMLLSPDADVQVNAAAAVVNLSLEPENKVRIVRSGAVSPLVDVLRGGHPEARDHAAGAMYSLAVEDENRAAIGVLGAIPPLLDLFAGAGATGHRARREAGMALYHVSLSGMNRSKIARAPGAVRTLLSAAEARDRASETDAAALRRLAVMVLANLAGCPDGRAALMDGGAVAAVVRLMRNGSVAPGSAEQEYCISTLYGMSRGSMRFRGLARAAGVEAALQPVAEGEGGVGRDLARRTLRAMRGEDDDAPVTATGLLGRQWDDGSVVSEGLVSIRRPPHRSNYAGPSGSNTTQF

SEQ ID NO: 812 - protein, 69 aa, Zea mays
MGFWATTLIFLLAGVAASLFTLLCCNRGPSTNLFHLTLVTTAVICCWMMYAIVYLAQMKPLINPILSGE

SEQ ID NO: 813 - DNA, 1847 bp, Triticum aestivum
ccacgcgtccgcgcggcaaagacacagagaagagaggtgacaacagtcaaaagcgagcgaggcggaagaaatcccttgagatggatgcaagaccgcgacgggcatcgtcctcgccggcggcggcgacggcggccttgtccctgctgctcctgttccccatgttcttaggggggcaggcgtcggcgtacggcgacgattcgggcgccggcagcatgacggcgctgcagaagcacgcggcgttcttcgacggcgacaaggacggcgtcgtcaccttctccgagacatacgcagcgtttcgggcccttggattcgggtatgccgcctccaccttgagtgctaccttcatcaatggcgtccttggcccccagaccagaccggaaaatgatacggcgcgcatgtccatctacatcgagaacatccacaagggcatccatgggagcgattcaggcgcgtatgactctcaaggaaggttcgttcccgagaagttcgaggcggcattcgccaagcacgccaagacggtgccggacgccctgacgtccgcggaggtggacgagctgatcaccgcgaaccgggagcccagcgactacgcgggatgggcgggcgcgtcggcggagtggaagttgctgtacagcatcggcaaggacaaggacgggctcctccgcaaggacgccgccaggggcgtctacgacggcagcctcttcgccagggtggtgcaggagcggaggacatctataggagaaacccaggcatgatcgtggcacgccgtcacggtgtgtggctaccgtacaagcgacggaggccagtcgaacactcgagtccgtccgaaccgatgcgtcgctggctagttacagggcattacttatccggtgtgattggctcgtcgcgtcacgccgtcacggtctgtcgccacatagctacggacggtactatactgctgaattaatgtttaaaaaaataggcagtgtgaaagggtgtgaacgcttgtgaacggaatcttgggatgggaccgatgtcctgttgtttgtgtcctgtggatatggttttattatgcgtacaaaaaaacagagtttagcaatggcggccgggcgagcgtgtgctcttagcgcggtgcttgtggtggtggtggcgccgctcctcctggccggcgtggcggacgccgactgcttcgactactgcttcaaggactgcatcgccaaggacaagaacatgatcgactactgcaactacgcctgcgacaagacctgctacacgggcgcgccccagcggcccttggcggcggctgccgcccccggcgacatgggatgccagctctcctgcgccaggacttcctgccaccgtcttgatccagaccgcgaggccgctgaggcctgcttcgggcagtgctatgacggctgcaagaccaagactctgccgaggcctctccgcgccggcgccgggatgcccaccacgttaggcccggtggtcgccgaccttccttcatccgagccggacccggatgatgcggtccgtgcgtcgtcagaggcgcccgaacatcaggcgatggggccacgtacaccgttttcggagatccacgctgctcctccggcgtctgcgtaacaagaatacctcggcgtacggccgtgacagttagcattggccgaccaatcgatatgtaagcgcaatcaccaggtgcggagggattagcgcatggaccaaaaagccgcgtgctaatgggtgtacacgtattatttgtaacactgctgaatgaagtgtcttaggctacttgtaacgggaagttctctgtatcaatatagtgtacgggtttgttaaactcaggtaacggagattaaatctggtctcattcagtg

SEQ ID NO: 814 - DNA, 1046 bp, Triticum aestivum
cccacgcgtgccggagaagagaggggtcagcagtcaaagagcgagcgagcgaggcggaagaaatccctcgagatggacgcaagaccgcgacgggcgtcgtcctccccggcggcggcgacggcgacggcggcggcggccttgtccctgctgctcctgttccccatgttcctagggggccaggcgtcggggtacggcgacgattcgggcgccggcggcatgacggcgctgcagaagcacgcggccttcttcgaccgcgacaaggacggcgtcgtcaccttctccgagacgtacgcagcgtttcgggccctcggatttggatttgcttcgtccaccttgagtgccaccttcatcaatggcgtccttggcccccagaccagaccggaaaatgacacggcgcgcatgtccatctacatcgagaacatccacaagggcatccacgggagcgactcaggcgcgtatgactcccaaggaaggttcgttccggacaagttcgatgcggcgttcgccaagcacggcaagacggtgccggacgccctgacgtccgccgaggtggacgagctgatcaccgcgaaccggcagcccagcgactacgcgggatgggcgggcgcgtcggcggagtggaagctgctgtacagcatcggcaaggacgaggacgggctcctccgcaaggacgccgccaggggcgtctacgacggcagcctcttcgccagggtggtgcaggagcggagggcatcctcgctagaagaaacccaggcatgatcgtggcacgccgtcacggtgtgtgtgtggctaccgtacaagcgacggaggccagtctgaacactcgagtccgtccgaaccgatgcgtcgctggctaggtacagggcattactggtactcccttcgtcacggtttagaaggcgtgcttggaaattatccgagacctatgtggttatctattggttgtgagtggttgtgagatgggttaaaaatagcattcacactatccatacatatagaaatagtacatcgaagtactaattagctactagaaataaatgcaatac

SEQ ID NO: 815 - DNA, 1024 bp, Secale cereale
cgcggcaaagacacggagaagagaggggacaacagtcaaaagcgagcgaggcggaagaaatccctttgagatggacgcgcgaccgcgacgggcatcgtcctcgccgccgccagcggcggcggcggccttgtccctgctgctcctgttccccatgttcttagggagccaggcgtcgggttacggcgacgattcgggcgccggcggcatgacggcgctgcagaagcacgcggcgttcttcgacgccgacaaggacggcgtcgtcaccttctccgagacatacgcagcgtttcgggccctcggattcggatatggcgcctccaccttgagtgctaccttcatcaatggcgtccttggcccccagaccagaccggaaaacgatacggcgcgcatgtccatctacatcgagaacatccacaaaggcatccatggaagcgattcaggcgcgtatgactcccaaggaaggttcgttcccgagaagttcgaggcggtgttcgccaggcacgccaagacggtgccggatgccctgacgtccggtgaggtggacgagctgatcaccgcgaaccggcagcccagcgactacgcaggatgggcgggcgcgtcggcggagtggaagttgctgtacagcatcggcaaggacaaggacgggctcctccgcaaggacgccgccaggggcgtctacgacggcagcctcttcgccagggtggtgcacgagcggagggcggcgcgggaagaaacccaggcatgatcgatggatttatatcgtgtcacgccgtccggactgatgcgtcgctgccttagctacagacagtagtacgtcgtgtacttactaattaattggcctgtgtgaacgggtgttactaattaattggccagtgtgaacgggtgtgaacgcatgtgaacggaatctacggatggggccgatgtttctcttgtctgtatcctcctggggatatctctatctatctattggtctcggcgtgcgtacacggcttgcttggcgatgcacggtgaaggaatactccca

SEQ ID NO: 816 - DNA, 947 bp, Leymus cinereus x Leymus triticoides
cacgcgcgccgcggcaaagatacagagaagcgagggacaacacacaacagtcaaacagcgagcgaggcggaagaaatcccttgagatggacgcgcgaccgcgacaggcatcgtcctcgccgccgtcggcggtggcgggcttgttcctgctcctgttccccatgttcctagggagccaggcgtcggggtacggcgacgactcgggcgccggcggcatgacggcgctgcagaagcacgcggcgttcttcgacggggacaaggacggcgtcgtcaccttctccgagacatacgcagcgtttcgggccctcggattcggatatgccgcctccaccttgagtgctaccttcatcaatggcgtccttggcccccagaccagaccgggaaatgacacgtcgcgcttgtccatctacatcgagaacatccacaaaggaatccatggaagcgattcaggcgcatatgactcccaaggaaggttcgttcccgacaagttggaggcggtatttgccaggcacggcaagacggtgccggacgccctgacgtccgccgaggtggacgagctgatcaccgcgaaccggcagcccagcgactacgcaggatgggcgggcgcgtcggcggagtggaagatgctgtacagcatcggcaaggacaaggacgggctcctccgcaaggacgccgccaggggcgtctacgacggcagcctcttcgccagggtggtgcaggagcggagggcatcgcaagaaccagaagaaaccacccaggcatgatggattgatgattcatcgtggcacgccacgccgtccggaccgatgcgtcgctggcttagctacagacagtagtacgttctagtgcactaattaatctgccggtgtgaacggaaccaacggatggggccaatgttcctcttgtctgtatcccgtggacatctatctattggtctctgcgtgcgta

SEQ ID NO: 817 - DNA, 826 bp, Hordeum vulgare
caacagtcaaaagcgagcgtggctgatgaaatcctttgagatggacgcgcgaccgcgactgccatcgtcctcgccggcggcggcgactgcggccttctccctgctgttcctgttcctaatgctccaagggagccaggcgttggctcacggtaactattcggtcgcctgcggcatgacggcgctgtagaagcacgcggcgttcttcgacggcgacaaggacggcgtcgtcaccttctatgagacatactcagcgtttcgggccctcggattcggatacgccgcctccaccttgagcgctaccttcatcaatggcgtccttggtccccagaccagaccggaaaatgagacggcgcgctattctatctccatccagatacttcacgagggtattcatggatgcgattctagctcttatgactccatatgaatgattcggatcggacaagttcgaggcggcgttcgccaagcacgccaagacggtgcccgacgccctgacgtccgcctgagaggacgagctgatcaccgtgaaccgtgaggccagctactacccaagaatgggcgggcgcgtcggctgagtggaagatgctgcacagcttcggccaggacaaggacgggttcctcccaaaggactcctgccaggggctgtctacaatggaagacttttcgcccgggttgtctcaggatcacggagtaccttcctccttagaagaaacccacgcatgatgggttcgtcacgtttaatctgaaggacttatctgcgcctcagcgatggagggccactactgaaccccttcagttccctcccgcacttggtcccttcgctgcg

SEQ ID NO: 818 - DNA, 3242 bp, Triticum aestivum
tagatctctcccgtcgtctcgctgcccctcctgagctcgccgaactttgtctcacgcagcgcaactccttccagacacaagccacagggagggatcggagttgcaaacatatatagacacatacgattctcatcctagatctctctctaccaagttcctccgggctgcctccttctgctagatctgctgctgctcgtgttgttgcttggcaagcaagatatatatacccctctctccatatataggactgtactagcactatctttgttggagggaagggagagagagagatgcagatgtgtatgtgaagaaatggaaggtgcgggaagcaggagccgagcgctagggtttcggtgttagacaggctagtagcaaggtagagagtaccatgatgatcccggcgaggcacatgccgtcgtcgatgatcggccggagcagcggcggcgcgccctacggatcctcatcagcactgtcgcttggccagccaaacctgctggacggcagcaaccagcacctcctgccgcaccacctcctggagcagatcccggcgcgcgcagcggagagcggcgacaacaacggcagcgtcggcggcggcgtgggcatgatccgcgggcgtgactccatggacccgctgggggacgagttcgagagccggtccggcagcgagaacgtggacggcgacgccgtggacaacgcggagcaggagcaggaccccaaccagcggccgcgcaagaagcgctaccaccgccacacccagcaccagatccaggagatggaagcgttcttcaaggagtgcccgcaccctgacgacaagcagcgcaaggagctgagccgggagctggggctggagcccctccaggtcaagttctggttccagaacaagaggacccaaatgaagaaccagcacgagaggcacgagaactcgcagctgcgggcggacaacgacaagctgcgggccgagaacatgcgctacaaggaggcgctcagcagcgcgtcctgccccaactgcggcggcccggcggcgctcggcgagatgtcgttcgacgagcaccacctccgcgtcgagaacgcgcgcctgcgcgacgagatcgaccgcatctccgccatcgccgccaagtacgtcggcaagcccatggtgcccttcccggtgctctccagcccgctcgccgccgcccccggggcctccgcctacgacgtcttcgccggggccgcctccgtgctgcaggcgccgcccgacgacaagcagcagggcgtcgtcgtcgagctggctgtggcagctatggaggagctgctccgcatggcgcgcctcgacgacccgctctgggccaccacggtggaccaggcgctcgcgctggacgaggaggagtatgccaggatgttcatcgacccacgcggcggccttgggccgaagcagtatggcctcgtctctgaggcatcgcgcgacgccgccgtcgtcatcatgacccccgccagcctcgtcgagatcctcatggacgtcaaccagtacgcggcggtgttctcgagcatcgtgtcgagggcggcgaccctggaggtgctgtccaccggcgtggccgggtgctacgacggcgcgctgcaggtcatgtcggtggagttccaggtgccgtcgccgctggtgccgacgagggagagctacttcgtgcgctactgcaagcgcaacgctgatggggcctgggccgtcgtggacgtgtcgctggacggcctgcagggggtcaagtgccggcgcaggccctccggctgcctcatccaggaggcgcccaacggctactccaaggtgacgtgggtggagcacgtggaggtggacgacaggtccgtgcacaatatctacaagccgctggtcggctccggcctcgccttcggtgcacgccggtgggtcggcgtcctcggccgacagtgcgagcgccttgccagcgccatggccagcaacatcccaaccagcgatatcggagtgatcactagctcggaggggaggaagagcatgctaaagctagcggagaggatggtcgcgagcttctgtggcggcgtgacggcctctgtggcgcaccaatggaccacgctgtcaggcagcggcgccgaggacgtgagggtcatgaccaggaaaagcgtcgacgaccccgggaggccaccaggcattgtcctcaacgccgccacctccttctggctccccgtcccacctaagcgcgtcttcgacttcctccgcgacgagacctctcgcagcgagtgggacatcctctccaatggcggcatcgtccaagaaatggctcacatcgccaatggccgcgaccatggcaactgcgtctcactcctccgtgtcaatagcaccaactctaaccaaagcaacatgctgatcctgcaagagagctgcacggacgcgtcgggctcctacgtcatctacgcgccggtggacgtggtggccatgaacgtggtgctcaacggcggcgacccagactacgtcgcgctcctgccatcaggcttcgccatcctgcccgacggtcctgcagggacaatgcacgccgcggcaggggcaaccggcaccggtgggtcgctcctgacggtggcgttccagatcctggtcgactccgtccccactgccaagctctccctagggtcggtggccaccgtcaacagcctcatcgcctgcaccgtggagcgcatcaagaccgccgtcatctccaatggcggcgcctcacccccgcagtagcttcgctcaattcatcaatcttcctatgttctgtatcagaggagcagcaaaattttggagccttcattagtgggaagtcaagaacgcacctcagactctccttgccatgtggtgctcatagccacagattgttccccgtggattcgaccggggaaactccgcgacttcttcgtttcgtgcaaaaaaacatttgcgaaaacaagatgcggtcaccactatgcaagggcggttggttcgggtattgacttcctcttcgtgtcggcctctcggatgctgctacctctgggtttcttttctagggttcttcgtcgagtacaaaaaaccgtaattttcttcagtcagtcttgtaattcgttggacttgtcgttgttgctgctgctgtttcagacttccagtgctttgtaggtgctgcagaatagagatttgtgcccatctgtctgtctgctgctttggattgggtttataattttgtagcgctcctggtgatccgtcgccatttcaatcccaaaatttgtgttgtgat

SEQ ID NO: 819 - DNA, 3263 bp, Secale cereale
cagttcgtcgtccccttcctctagatcccccgtcgtctcgctgcccctcctgagctcgccgaacttcgtctcacgcagcgcaactccttccagagacgagccgtggggagggatcggagctgcaaacatatatagacacatacggttctcatcttagatctctctctgccaagttcctccgggctgcctccttctgctagatctgctgctgctcgtgctgttgcgtggcaagcaagatatatatacccctctctccatatataggactgtactagcactatctttgttggagggggaggagggagagagagagatgcagatgtgtatgtgaagaaatggaaggtgagggaagcaggagccgagcgctagggtttcggtgttagacaggctagcaaggtagagagtaccatgatgatcccggcgaggcacatgccgtcgtcgatgatgggccggagcagcggcggcgcgccctacggatcctcatcagcactgtcactcggccagccaaacctgctggacggcagcaaccagcacctcctgccgcaccacctcctggagcagatcccggcgcgcgcggcggagagcggcgacaacaacggcagcggcggcggcgtgggcatgatccgcgggcgtgactccatggacccgctgggggacgagttcgagagccggtccggcagcgagaacgtggacggcgacgccgtggacaacgcggagcaggaccaggaccccaaccagcggccgcgcaagaaacgctaccaccgccacacccagcaccagatccaggagatggaagcgttcttcaaggagtgcccgcaccctgacgacaagcagcgcaaggagctgagccgggagctggggctggagccgctgcaggtcaagttctggttccagaacaagaggacccagatgaagaaccagcacgagaggcacgagaactcgcagctgagggcggacaacgacaagctgcgggccgagaacatgcgctacaaggaggcgctcagcagcgcgtcctgccccaactgcggcggcccggcggcgctcggcgagatgagcttcgacgagcaccacctccgcgtcgagaacgcgcgcctgcgcgacgagatcgaccgcatctccgccatcgccgccaagtacgtcggcaagcccatggtgcccttcccggtgctctccagcccgctcgccgctgccccgggcgcctccgcctacgacgtcttcgccggggccgcctccgtgctccaggcgccgcctgacgacaagcagcagggcgttgtggtcgagctcgccgtcgccgccatggaggagctgctccggatggcgcgtctcgatgacccgctctgggccaccaccgtggaccagacgctggcgctggacgaggaggagtatgcaaggatgttcgtcgacccacgcggcggccttgggcctaagcagtatggcctcgtctctgaggcctcccgcgacgccgccgtcgtcatcatgacccccgccagcctcgtcgagatcctcatggacgtcaaccagtactcggcggtgttctcgagcatcgtgtcaagggcggcgacgctggacgtgctgtccaccggcgtggccgggtgctacgacggcgcgctgcaggtcatgtcggtggagttccaggtgccgtcgccgctggtgccgacgagggagagctacttcgtgcgctactgcaagcgcaatgctgatggtgcctgggccgtcgtggacgtgtcgctggacggcctgcagggggtcaagtgcaggcgcaggccctccggctgcctcatccaggaggcgcccaatggctactccaaggtgacttgggtggagcacgtggaggtggacgacaggtccgtgcacaacatctacaagccgctggtcggctccggcctcgccttcggtgcccgccggtgggttggcgtcctcggccgccagtgtgagcgcctcgccagcgccatggccagcaacatcccaaccagcgatatcggagtgatcactagctcggaggggaggaagagcatgctgaagctggcggagaggatggtggcgagcttctgcggcggcgtgacggcctctgtggcgcaccaatggaccacgctgtcgggcagcggcgccgaggacgtcagggtcatgaccaggaagagcgtcgacgaccccgggaggccaccgggcattgtcctcaacgctgccacctccttctggctccccgtcccacccaagcgggtcttcgacttcctccgtgatgagacctctcgcagcgagtgggacatcctttccaatggcggcatcgtccaagaaatggctcacatcgccaatggccgcgaccatggcaactgcgtctcactcctccgtgtcaatagcaccaactcgaaccaaagcaacatgctgatcctgcaagagagctgcacggacgcgtcgggctcctacgtcatctacgcgccagtggacgtggtggcaatgaacgtggtgctcaacggcggcgacccagactacgtcgctctcctgccgtcaggcttcgccatcctgcccgacggtcctgcagggacaatgcattccgcagcaggggcaaccgtcaccggtgggtcgctcctgacggtggcgttccagatcctggtcgactccgtccccactgccaagctctccctagggtcggtggccaccgtcaacagcctcatcgcctgcaccgtggagcgcatcaagaccgccgtcatctccaatggcggcgcctcacccccgcagtagcttcgcccaattcatcaatcttcctatgttctgtatcagaggagcagcaaaattttggagccttcatcagtgggaagtcaagaacgcacctcagactctccttgccatgtggtgctcatagccacagattctccccccgcggattcaaccggggaaactccgcgacttcttcgttccatgcaagaaaacatttgcgacaaacaaagatgcggtcaccactatgcaagggcggttggttcgggtattgacttcctcttcgtgtcggcctctcggatgctgctacctctgggtttcttcttctagggttcttcgtcgagtacaaaaaaccgtaattttcttcagtcagtcttgtaattcgttggacttgtcgttgctgctgctgctgtttcagacttccagtgctttgtaggtgctgcagaatagagatttgtgccaatctgtctgtctgctgctttggattgggtttataattttgtagcgctcctggtgatccgtcgccatttcaatcccaaaatttgtgttgtgat

SEQ ID NO: 820 - DNA, 3329 bp, Brachypodium distachyon
tcccccttcttcctcctccgcccttccccttccatggccgccgcccagctcctcttcccaaagttctctccttctctccgccgcctctagatctctacccttcagaaaaaacctcccgaaacttcgccgtttctatcagaagcacaacacacagggaggccaggatcgatcgacatataattacataaggttctcatcttagatctctcgatccctgccggcctgcaaagttcctctctctgggcttgcttgttcatagatctgctgctactcgtgtgctgttgttgcttggcaagcaagatatatacatctctttctctccatatataggactagcagtacttgtttgttttggctgagagaaagagagaagatgcatgtatgtatgtgaagaaatggaaggtctggcaggaagaaggcgagagcttgctagggtttcagagatagtttgctaaaaagagagagtatcatgatgatcccggtgaggcacatgccgtcgtcgatgatcggccggagcagcgccgcctacggatcgtcctcatcggcactctcactcggtcagccaaacttgttggacagcaatcaccagcagctccaccaccatcaggcgctcctgaatcaccagatcccggcgccggcgatggcggagagcagcgacaatagcggcaggaggagcatggtccggcggcggtccgagccgctgggcgaggacttcgagagcaggtccggcagcgagaacgtggacggcgacggcgtggaggacgagctgcagcagcaggctgaccccaacaagcgcccccgcaagcagaaccgctaccaccgccatacccagcaccagatccaggagatggaagctttctacaaggagtgtcagcacccggacgacaagcagcgcaaggagctgagccgggagctcgggctggagccgctgcaggtcaagttttggttccagaacaagaggacccagacgaagaaccagcaagagcggcacgagaactcgcagctgcgcggggagaacgacaagctgcgtgctgagaacatgcgttacaaggaggccctgagcagcgcctcctgccccagctgcggcggccccgccgccctcggcgagatgtccttcgacgagcaccacctccgcctcgagaacgcccgcctccgcgacgagatcgacaggatctcggcgatcgcggccaagtacgtgggcaagccggcggtgccgttcccggtgctctccaaccctctggccgccgtgggggcttacgggcaccaccacctgggcgccgacatgtttggagagctgcagcagccgatgaggcccaccggcggcgccggcgaccagaacaagggagtggtggtggagctggccgtggcggccatggaggagctgctgcggatgacacggctgaacgagccgctgtgggccgggcccggcgtcgcggggcccatggagacgctcaacgaggaggagtacgccaggatgttcggcggcccacgcggtggtgggctcgggcccaagcagtacgggcagctcgtctctgaggcgtcccgggaatcagctgttgttatcctgacccctgctaacctcgtcgagatcctcatggacgtcaatcagtatgcggcggtgttctcgagcatcgtgtcgagggcggccacgctggaggtgctgtccacaggcgttgctggctgctacgatggtgcactgcaagtgatgtcggtggagttccaggtgccatcgccgctggtgccaacgagggagagctacttcgtgaggtactgcaagcagaactctgacgggacatgggccgtcgtcgacgtctccctcgacacccttcaagggatcaagtgccggcgcaggccgtccgggtgcctcatccaggaggcgcccaatggctattcaaaggtgacatgggtggagcatgtggaggtggacgacaggtcggtgcacaacatctacaagctgctggtgaactccggcctggccttcggcgcgcgcaggtgggtcggcgcgctcggccgccagtgcgagcgccttgccagcgtcatggccagcaacatccccaacagcgacatcggagtgatcaccagctcagaggggaagaagagcatgcttaagctggcggagaggatggttgcgagcttctgcggtggcgttacggcctccgtggcacaccagtggaccaggctgtctgggagcggcgccgaggacgtcagggtcatgacgaggcagagtgtcgacgaccccgggaggccacctggcatcgtcctcaacgctgccacctccttctggctccccgtaccccctaagcgtgtctttgacttcctccgcgacgagacctctcgcagccagtgggacatcctctccaatggcggcgtcgttcaagaaatggctcacatcgccaatggccgcgatcatggcaactgcgtgtctctccttcgcgtcaatagcaccaactccaaccaaagcaacatgctgatcctgcaagagagctgcacggacgcgtcgggctcctatgtcatctatgcccccgttgacatcgtggccatgaacgtcgtcctcaacggcggcgacccggactatgttgcgctcctgccgtccggcttcgccatcctgccagacgggccagccggcaacatccataccgggggagggccctccgtcagtgatggtggtgtcggctccggtgggtctctcctgacagtggcgttccagatcctcgtcgactccgtccccaccgccaagctgtcgctcgggtcggtggcgacagtgaacagcctcatcgcctgcaccgtggagcgcatcaaggctgctgtctccggcgaaagctcgccgcagtagcctttgtttccaatgtttgtatcagaggagcagcaaaattttggagctttcatcagtgggaagtcaagaacgcacctcagactctccttgccatgtggtgctcatggatttgggcgattgttccccgcgaattcgaccggggtactccgacaagtggtgattaggttcttcattgcaaaaatttgcgaaaagatgtgtcaccactacgcaagggcggttggttcgggtattgacttcctcttcgtgttggcctctcggatgctgctacttctgggttttagggttcttcatgtagtacaaaaaccgtgatttttcagtctgtaatttgtgctgtcgttgttgctgctgcttctgttgttcagactttccagtgacttgagctgcagaatagagatttggatctgtcttcctgttgctttgggtttaattttgtagcgcctctggttatcgatcatcatttgaatcccaaatttaatgttgtgatgtgcttgctctc

SEQ ID NO: 821 - DNA, 5237 bp, Brachypodium distachyon
ccgtctcaacactctccggcattaactcctcccccttcttcctcctccgcccttccccttccatggccgccgcccagctcctcttcccaaagttctctccttctctccgccgcctctagatctctacccttcagaaaaaacctcccgaaacttcgccgtttctatcagaagcacaacacacagggaggccaggatcgatcgacatataattacataaggttctcatcttagatctctcgatccctgccggcctgcaaagttcctctctctgggcttgcttgttcatagatctgctgctactcgtgtgctgttgttgcttggcaagcaagatatatacatctctttctctccatatataggactagcagtacttgtttgttttggctgagagaaagagagaagatgcatgtatgtatgtgaagaaatggaaggtctggcaggaagaaggcgagagcttgctagggtttcagagatagtttgctaaaaagagagagtatcatgatgatcccggtgaggcacatgccgtcgtcgatgatcggccggagcagcgccgcctacggatcgtcctcatcggcactctcactcggtcagccaaacttgttggacagcaatcaccagcagctccaccaccatcaggcgctcctgaatcaccagatcccggcgccggcgatggcggagagcagcgacaatagcggcaggaggagcatggtccggcggcggtccgagccgctgggcgaggacttcgagagcaggtccggcagcgagaacgtggacggcgacggcgtggaggacgagctgcagcagcaggctgaccccaacaagcgcccccgcaagcagaaccgctaccaccgccatacccagcaccagatccaggagatggaagctttctacaaggagtgtcagcacccggacgacaagcagcgcaaggagctgagccgggagctcgggctggagccgctgcaggtcaagttttggttccagaacaagaggacccagacgaagaaccagcaagagcggcacgagaactcgcagctgcgcggggagaacgacaagctgcgtgctgagaacatgcgttacaaggaggccctgagcagcgcctcctgccccagctgcggcggccccgccgccctcggcgagatgtccttcgacgagcaccacctccgcctcgagaacgcccgcctccgcgacgagatcgacaggatctcggcgatcgcggccaagtacgtgggcaagccggcggtgccgttcccggtgctctccaaccctctggccgccgtgggggcttacgggcaccaccacctgggcgccgacatgtttggagagctgcagcagccgatgaggcccaccggcggcgccggcgaccagaacaagggagtggtggtggagctggccgtggcggccatggaggagctgctgcggatgacacggctgaacgagccgctgtgggccgggcccggcgtcgcggggcccatggagacgctcaacgaggaggagtacgccaggatgttcggcggcccacgcggtggtgggctcgggcccaagcagtacgggcagctcgtctctgaggcgtcccgggaatcagctgttgttatcctgacccctgctaacctcgtcgagatcctcatggacgtcaatcagtatgcggcggtgttctcgagcatcgtgtcgagggcggccacgctggaggtgctgtccacaggcgttgctggctgctacgatggtgcactgcaagtgatgtcggtggagttccaggtgccatcgccgctggtgccaacgagggagagctacttcgtgaggtactgcaagcagaactctgacgggacatgggccgtcgtcgacgtctccctcgacacccttcaagggatcaagtgccggcgcaggccgtccgggtgcctcatccaggaggcgcccaatggctattcaaaggtgacatgggtggagcatgtggaggtggacgacaggtcggtgcacaacatctacaagctgctggtgaactccggcctggccttcggcgcgcgcaggtgggtcggcgcgctcggccgccagtgcgagcgccttgccagcgtcatggccagcaacatccccaacagcgacatcggagtgatcaccagctcagaggggaagaagagcatgcttaagctggcggagaggatggttgcgagcttctgcggtggcgttacggcctccgtggcacaccagtggaccaggctgtctgggagcggcgccgaggacgtcagggtcatgacgaggcagagtgtcgacgaccccgggaggccacctggcatcgtcctcaacgctgccacctccttctggctccccgtaccccctaagcgtgtctttgacttcctccgcgacgagacctctcgcagccagtgggacatcctctccaatggcggcgtcgttcaagaaatggctcacatcgccaatggccgcgatcatggcaactgcgtgtctctccttcgcgtcaatagcaccaactccaaccaaagcaacatgctgatcctgcaagagagctgcacggacgcgtcgggctcctatgtcatctatgcccccgttgacatcgtggccatgaacgtcgtcctcaacggcggcgacccggactatgttgcgctcctgccgtccggcttcgccatcctgccagacgggccagccggcaacatccataccgggggagggccctccgtcagtgatggtggtgtcggctccggtgggtctctcctgacagtggcgttccagatcctcgtcgactccgtccccaccgccaagctgtcgctcgggtcggtggcgacagtgaacagcctcatcgcctgcaccgtggagcgcatcaaggctgctgtctccggcgaaagctcgccgcagtagcctttgtttccaatgtttgtatcagaggagcagcaaaattttggagctttcatcagtgggaagtcaagaacgcacctcagactctccttgccatgtggtgctcatggatttgggcgattgttccccgcgaattcgaccggggtactccgacaagtggtgattaggttcttcattgcaaaaatttgcgaaaagatgtgtcaccactacgcaagggcggttggttcgggtattgacttcctcttcgtgttggcctctcggatgctgctacttctgggttttagggttcttcatgtagtacaaaaaccgtgatttttcagtctgtaatttgtgctgtcgttgttgctgctgcttctgttgttcagactttccagtgacttgagctgcagaatagagatttggatctgtcttcctgttgctttgggtttaattttgtagcgcctctggttatcgatcatcatttgaatcccaaatttaatgttgtgatgtgcttgctctctggaattctttccaaagctccgatgaaggcacatgtcagttaatgtttgactgtgaaccatttccttttaaacttgtgctcactttgcagcacttctttcggtggtgaccggcagaaaccgggactcaatcacaacaagaccatcagaagatgtcatcactacagcatcagtattagaagatctgaatgtataacactgcttcacattcagaagatgtacggttgtgacaaaccgttccacgtatacacaatcgagtgcttctgaaacagtacaggaccggcgagattggaaaaggaaagaaccggataagaaaaagcatcatctgcactggatcttcagcacgctatgatcaccaatgatctctgtgcacatggtgtctgcgagagaatcattgctactcatggagggattttcattctgcggggagtaggtcggcgtatgagaagtcatgacaaggtggacctgaaacacatgccgagtgcaggtgtaagtgacttgtgtcccttccaaaaaaaagtgacttgtgtgttctcaataagattaccaccccaaaggaatatacaacagaaatataacatgatgattaagttacacgattagtttgctgaaaactgaatctgttttttaaaacttgattgttgagttttgtccttagatgcagcaacgtacatgccaccacattagaaggatgcagacatatttctgctgcttgtaaataagacagatgtttattctttagctgccctttctttttacctttttgtgcggctaaaaggtaaaatggaatgtgagctaccatcttcgtccctccttccctccagttcacaatgccaggaccatttccttgggcagtggatggtcccagtacagataaacaaatggcaggttcattcatgagccctaagtagtcacaggcacgttgccagactctcctgtctgaggtcctggaccgagcaacctgcaggaaagcaagtgacatatttcagtgatggataatatgccgacataacaaacccttgatgtgtttgttatgccagaaactaccttggccaaagatacgcgtgcccttggaagcaactcattatgacatgttgctagcttcgcaatggcagtcaccacaaagcagagaagcctagcttgggatgacttcctagaagttgcacccatagaatcaaatcctggttcctgacttaatcccaaacgacttggaaacaagagatgaaagaagtcaatcaggattaataccatggaagtttaaaaaagaaaagcttgtacaacgaagaccaacctagttgccagattttcatataatagcaactccaaattttcaaatagttcacgagctacatctttgtggtttatgcctcctgctccatgctcaccaatggcccaacacaaatgcaaagctaattctgtctgaatagcagcataggccatgtcccattaaaaaaaaaaggtacgatttcgtggagaagagaattagctattttacttactacagataattcggcacaagaacaacaaaagcaggcaatgatgcagcaactccagtaggcattgtagaagcaaaattagataaaatacttgacagatatacttgcctttgcagggttagcatgggcctccccaagtctatcagtaataggcttctgcagaatggtttgaaattgttatgcaaaactgttctagaataccatatgacataaaccttacgtagtaagagtcactcagttggtacctttagtagtgcaataatgtcaggggagcgctggaatgcagccaataagaaatccgaaagccttttcctgacctacaaggatgttagaacaaggaacttgttcaagttaaatccaaatatatcatgtgaactggtacaag

SEQ ID NO: 822 - DNA, 3423 bp, Setaria italica
cccctcttcctccacattctcttccacctccgttcccctttcttctcttcctcttcctcctcctcctcccttccccttccatggctgtctagctcctcaggatctctccgtctctccacttcctgctagctacccttctgagcttgcacgcggtaaagaatcatctcgagagctgcaacttgcaggcagacatagagagagatcagagttctatttttgcaaaggcgcacaacatatatagttcttctgctagatctcactgccagtctcacagagcgaaggtttatttgggctagtttgcccctagatctgttgctggctgtgttgttgcttggcaggcaaggtatctctatataggaataggattagcgcctgttctttggctgtagagagagagagttgtcctatgtgtctctgaagaaatggaaacgaatgagacggcaagaaattagggtttgcgaggtggtcagaggagaatgatgatcccggcgaggcacatgccgtcgatgatgatcggccggaacagcgcggcggcggcgtacgggtcctcgtcggcactgtcactcggtcagccaaacctgctggacaacccgcagctccagcaggcgctgcagcagcagcatctgctggaccagatcccggcgacgacggcggagagcggcgacgacatgatgcgcggcggccggggctccgaccctctgggggacgagttcgagagcaagtcaggcagcgagaacgtggacggcgtctccgtggacgaccaggaccccaaccagcggcccagcaagaagaaacgctaccaccgccacacccagcaccagatccaggaaatggaagctttcttcaaggagtgcccacacccggatgacaagcagcgcaaggagctgagccgggagctggggctggagccactccaggtcaagttctggttccagaacaaacgcacgcaaatgaagaaccagcacgagcggcaggagaactcccagctgcgggcggacaacgagaagctccgggccgagaacatgcggtacaaggaggccctgagcagcgcgtcctgccccaactgcggcgggcctgccgcgctcggcgagatgtccttcgacgagcaccacctccgcatcgagaatgcccggctccgcgaggagatcgacaggatctcggccatcgcggccaagtacgtgggcaagcccatggtgtccttccccgtgctctccagcccgctggctgcggcgcgcgcctcgacgctggacatcggcgtgggtgccggcgcgtatggtgctactgacatcttcggtggcgtcactgctggtgccggggagctgctgaggggtgccgtgcagtcagacgcggataagcccatgatcgtggagctggccgtcacggccatggaggagctggtgcgtatggcgcagctggacgagccgctttggaatgcaccggggctcgacggatcgagcgagacactgaacgaggaggagtactcgcgcatgttccctcgcgggcttggccctaagcagtatgggctcaagtctgaagcgtcccgcgacagctcggtggttataatgacacatgccaacctcgtcgagatcctcatggacgtgaatcagtacgcgacagtgttctcgagcatggtgtcgagagcagcgacactggaggtgctgtccactggcgtggccgggaactacaacggtgcattgcaagtgatgtcagtggagtttcaggtgccttccccgctggtgccgaccagggaaagctacttcgtgaggtattgcaagcagaacgctgatgggacatgggctgtcgttgacgtctcgctggacagcctgcgccccggatcagtcctcaagtgccggcgccggccatctggctgcctgatccaggaaatgcccaatggctactcgaaggtgacttgggtcgagcacgtagaggtggatgacaggtcggtgcacaacatctacaagttgcttgtgaactcagggctcgcctttggtgcacgacgatgggtggggacgctggaccgccagtgcgagcgcctcgccagcgtcatggccagcaatataccaaccagtgacattggtgtgatcacaagtacggaagggagaaagagcatgctgaagctggcagagaggatggtgatgagcttctgcggtggcgtgactgcctctgcagcacaccagtggacgacgctgtcaggcagcggcgctgaggacgtccgtgtcatgaccaggaagagcgttgacgacccaggcaggccgccgggcatcgtcctcaatgcagccacctccttctggctccccgtcccacccaagcgcgtcttcgatttcctccgcgacgagagctctcgcagcgagtgggacatcctctccaatggcggtgttgttcaagaaatggctcacatcgccaatggccgggatcatggcaactgcgtctcgcttcttcgtgtcaatagcacaaactcaaaccaaagcaacatgctgatcctgcaagagagctgcaccgacgcgtcgggttcctatgtcatctacgcgccggtagacgttgtggccatgaacgttgtcctcaacggcggcgatcctgactatgtggccctcctgccatcgggctttgccatcctacccgacggcccagccgggggcaacatgcaaggcgacggcggcgtcggctcaggtggctcgctcctgacagtggcgttccagatactagtggactctgtgcccacagccaagctctcgctggggtcagtggcaacggtgaacagcctcattgcttgcaccgtggagcgcatcaaggccgcggtctcaggcgagagcaatccccaatagcttcgttgaatctaaaaatgttcttatccttgcattggaggagcagcaaattttagagctttcatcagtgggaagtcaagaacgcacctcagactctccttgccatgtggtgctcatagtttgggttaattttcgcctagtttccgcaaaatttccggaaattccaagatatgtttcagttgtcaaagaaaatgcgtcaccactacgcaagggcagttggttcgggtattgacttcctcttcatgttggcctctcggatgctgctacctgtgatttttagggttcttatcttgtcgagtacaaaaccgtaatttagcctgtaatttgtgctgctgctgctgttaattgttcagacttctccagcatcctggtaggagagttccagaatagatatttgtgggccttcagttctatactttgtagcgtttctggtgtgggccaccatttcaatcccaaatgtgccgtgcttgatgtgcttgcaattgcattgctgcagcgtgcctttgttgcttcaagttgttctcgatttattcggttatagtgccatgaccatggaatgccaatttctcagttatgttcccgcagttttaaggaacatcag

SEQ ID NO: 823 - DNA, 3980 bp, Oryza sativa
ctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcattcttcaaggaatgtccacacccagatgataagcagcgcaaggagctgagccgggagctcggcctggagcctctccaagtgaagttctggttccagaacaagcgcacccaaatgaagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtggcggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcgaatcagtacgcggcagtgttctcgaacatcgtgtcgagggccatcacgctggaggtgctgtccaccggcgtcgcggggaactacaacggtgcattgcaagtgatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcgtgattacgagctcggaggggaggaagagcatgctgaagctggcggagaggatggtggtgagcttctgcggcggcgtgacggcgtcggtggcgcatcagtggacgacgctgtccggcagcggcgccgaggacgtccgcgtcatgacgaggaagagcgtcgacgaccccgggaggccccccggcatcgtcctcaacgccgccacctccttctggctccccgtccctcccaagcgcgtcttcgacttcctccgcgacgaatcctctcgcagtgagtgggacatcctctccaatggcggtatcgttcaagaaatggcccacatcgccaatggccgggatcagggcaactgcgtctcacttcttcgcgtcaacagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttatacttttagttctcttcagtgtttgatcagtgctgtttcaatccaaaattgtgtgtgctgtgcttgttattagttcttccttgctgcttcaatgaaggcgatgttaatttcagtttccagcagttgcagagttgtgtaagatgacttgcatttcattgccttcaacagtattctatcagaactgtcgcatatcccccaaaaaacagcacaatcaatttaatactccttgataaaatttatgccactcttattatttacatcactgattacccttcaaaagattacatatatacgacaatccctacatggaaatactcgagtgcttctgccataaccttcaccccatgaacaaacatttcagttcccagaaactatacggtctcatccaaagcaacttagctcgcctttagactgaataatgaactggataaactcataagagacgccacttggatcttcatgattcatgacattaccaccaaaagcctcggcagtcagcacagatgatgtccgcgagggaatcattgtatgaatccattgcactcatgaaagtacatcattccgtggggacgagatcgtcaaacgaaaaatcatggatcggtgcacctg

SEQ ID NO: 824 - DNA, 3404 bp, Oryza sativa
gcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcattcttcaaggaatgtccacacccagatgataagcagcgcaaggagctgagccgggagctcggcctggagcctctccaagtgaagttctggttccagaacaagcgcacccaaatgaagaaccagcatgagaggcacgagaactcgcagctgcggtcggataacgagaagctccgggccgagaacatgcggtacaaggaggccctgagcagcgcctcctgccccaattgcggcggccccgccgccctcggcgagatgtccttcgacgagcaccacctccgcatcgagaacgcccgcctccgcgaagagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtggcggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcgaatcagtacgcggcagtgttctcgaacatcgtgtcgagggccatcacgctggaggtgctgtccaccggcgtcgcggggaactacaacggtgcattgcaagtgatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcgtgattacgagctcggaggggaggaagagcatgctgaagctggcggagaggatggtggtgagcttctgcggcggcgtgacggcgtcggtggcgcatcagtggacgacgctgtccggcagcggcgccgaggacgtccgcgtcatgacgaggaagagcgtcgacgaccccgggaggccccccggcatcgtcctcaacgccgccacctccttctggctccccgtccctcccaagcgcgtcttcgacttcctccgcgacgaatcctctcgcagtgagtgggacatcctctccaatggcggtatcgttcaagaaatggcccacatcgccaatggccgggatcagggcaactgcgtctcacttcttcgcgtcaacagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttatacttttagttctcttcagtgtttgatcagtgctgtttcaatccaaaattgtgtgtgctgtgcttgttattagttcttccttgctgcttcaatgaaggcgatgttaatttcagtttccagc

SEQ ID NO: 825 - DNA, 991 bp, Secale cereale
tcagaaaaccaaaagccaacctagtctgcaacttcgtgatcatcagaggctattttgctgtactccatccaacccaaccaccttaaataccgctgcttggggcacaatccttaataacccagaaatagcactgcaacacactgccaacatctcctctttggttccacagcttccttcaacaccttcgcccagaaactctcgcaggcatggcggccgggaagcgcaccatcggcctcgcgatggactactcgccgtccagcaaggccgcgacgaggtgggtggtcgagaacctggtgaaggccggcgaccggatcatcctcatccacgtcctccccaagggagcagacgccagccacaagggcctctggaagagcaccggttcgcctctgatccctctgctggagttcatggagatgaatgtgcaggcgcggtacggggtcaacccggacaaggaggtgctggagatcctgcaggctgagtccaagtccaagcaggtggaaatactggcaaaaatatactggggtgatgcaagggagaaactttgcgaggctgtagatgatctcaaggtcgactctgttgtgcttggttgcaggggcttagggcccttaaaaagggctctacttggaagcgtcagcaactatgtcgtcaacaatgcaacctgccccgtcacagtggtgcgcggaccaaatggatcacttgcttgaagatgtcgctcctagaatgatggcctagtttgcgtgttcattgccgtcggcataggtgcaaatggtgctatttaagacaatagtgcaaactcagtgtgttttcctctgttatctcttggttatactacatttctgctgtttcttgcatactatttgtaaaaaaatgcctacagacttgttcagtggtgcattttcgtttatgtgcgtgactaggcaggcccgctaaagttgaattgttactcgagtttctgcagagcatctaaaagtggaatttttcttttatgaac

SEQ ID NO: 826 - DNA, 853 bp, Secale cereale
catctcctctttggttccacagcttccttcgacaccttcgcccagaaactctcgcaggcatggcggccgggaagcgcaccatcggcctcgcgatggactactcgccgtccagcaaggccgcgacgaggtgggtggtcgagaacctggtgaaggccggcgaccggatcatcctcatccacgtcctccccaagggagcagacgccagccacaagggcctctggaagagcaccggttcacctctgatccctctgctggagttcatggagatgaatgtgcaggcgcggtacggggtcaacccggacaaggaggtgctggagatcctgcaggctgagtccaagtccaagcaggtggaaatactggcaaaaatatactggggtgatgcaagggagaaactttgtgaggcagtagatgatctcaaggtcgactctgttgtgcttggttgcaggggattagggcccttaaaaagggcactccttggaagcgtcagcaactatgtcgtcaacaatgcaacctgccccgtcacagtggtgcgcggaccaaatggatcacttgcttgaagatgtcgcttgtagaatgatggcctagtttgtgtgttcattggtccgtcggcgtaggggcaaatgatgctatttaagacaatagtgatattttgccttttcggaacctttgctatccttgtagtgcaaactcagtgtgttttcctctgttatatcttggttatactacatttctgttgtttcttacatactactatttgtaaaaaaagaatgcatgcagacttgttcagtggtgcattttcgtttatgtgcgtgactaggcaggcccgctaaagttgaattgttactcgagtttc

SEQ ID NO: 827 - DNA, 1076 bp, Secale cereale
tagcactgcaacacactgccaacatctcctctttggttccacagcttccttcaacaccttcgcccagaaactctcgcaggcatggcggccgggaagcgcaccatcggcctcgcgatggactactcgccgtccagcaaggccgcgacgaggtgggtggtcgagaacctggtgaaggccggcgaccggatcatcctcatccacgtcctccccaagggagcagacgccagccacaagggcctctggaagagcaccggttcgcctctgatccctctgctggagttcatggagatgaatgtgcaggcgcggtacggggtcaacccggacaaggaggtgctggagatcctgcaggctgagtccaagtccaagcaggtggaaatactggcaaaaatatactggggtgatgcaagggagaaactttgtgaggcagtagatgatctcaaggtcgactctgttgtgcttggttgcaggggattagggcccttaaaaagggcactccttggaagcgtcagcaactatgtcgtcaacaatgcaacctgccccgtcacagtggtgcgcggaccaaatggatcacttgcttgaagatgtcacttctagaatgatggcctagtttgcgtgttcattggtccgtcggcgtaggtgcaaatggtgctatttaagacaatagtgatatcttgccttttcggaacctttgctatccttgtagtgcaaactcagtgtgttttcctctgttatctcttggttatactacatttctgttgtttcttacatactatttgtaaaaaaaatgcctacagacttgttcagtggtgcattttcgtttatgtgcaactaggcaggcccgctaaagttgaactgttactcaagtttctgaagagcatctaaaagtggaaggtttcttttatgaaccaaattcttttggttgcttctcactgaaacccagcggaagctgggaccttatacttggcagttgatgtatagcatcagatgaatgggcataaacagctactgctaactaggtctttctggaatatccaagactggatttttccaactaaacacaagattacataggacat

SEQ ID NO: 828 - DNA, 832 bp, Triticum aestivum
cctctcccaacacctcctctttgcttccagcttttccttcaacaccttcgtccagcttcgtccagaaactctcgcggacatggcggccgggaagcgcaccatcggcctggcgatggactactcgccgtccagcaaggcggcgacgaggtgggtggtcgagaacctggtgaaggccggcgaccggatcatcctcatccacgtcctccccaagggagcagacgccagccacaaggggctctggaagagcaccggttcacctctgatccctctgctggagttcatggagatgaacgtgcaggcgcggtacggggtcaaccctgacaaggaggtgctggagatcctgcaagctgagtccaaatccaagcaggtagaaatactggcaaaaatatactggggcgacgcaagggagaaactttgcgaggctgtagatgatctcaaggtggactctgttgtgcttggttgcaggggcttagggcccttgaaaagagcactccttggaagcgtcagcaactatgttgtcaacaatgcaacctgccccgtcacagtggtgcgtggaccaaatggatcacttgcttgaagatgtcacttctggaatgatgggctaatttgtgtgttcgttggtctgtcagcgtaggtgcaaatggtgctatttaagactgatagtgatattttgcctttttggattcctagctatccttgtggtgcaaattcagtgtgttttcctctgttatctcctagttatactacaatctgttgtttcttacatactatttgtaaaaaaaatgcctacagacttgttcagtggtgcattttcgattatgtgcatgactag

SEQ ID NO: 829 - DNA, 840 bp, Triticum aestivum
ggttagtgcctcctctcccaacacctcctctttgctcacagcttccttcaacaccttcgtccagaaactctcgcagacatggcggccgggaagcgcaccatcggcctcgcgatggactactcgccgtccagcaaggcggcgacgaggtgggtggtcgagaacctggtgaaggccggcgaccgcatcatcctcatccacgtcctacccaagggagcagacgccagccacaagggcctctggaagagcaccggttcacctctgatccctctgctggagttcatggagatgaacgtgcaggcgcggtacggggtcaacccggacaaggaggtgctggagatcctgcaggctgagtccaagtccaagcaggtggaaatactggcaaaaatatactggggtgatgcaagggagaaactttgtgaggcagtagatgatctcaaggtcgactcagttgtgcttggttgcaggggattagggcccttaaaaagggcactccttggaagcgtcagcaactatgttgtcaacaatgcaacctgccccgtcacagtggtgcgcggaccaaatggatcacttgcttgaagatgtcacttctggaatgatgggctagcttgcgtgttcattggtccgtcagcataggtgcaaatggtgctatttaagaggatagtgatatttgcctctttggatttcctggctatccttgtagtgcaaattcagtgtgttttcatctgttatattctagttatactacatttctgttgtttcttacatactatttgtaagaaaaaatgcctacagacttgttcagttgtttattttcgtttatgtgaatgactaggcaggccc

SEQ ID NO: 830 - DNA, 896 bp, Triticum aestivum
ctactacacctctcaacatctgctctttggttccacagcttccttcgacaccttcgtccagaaactctcgcggacatggcggccgggaagcgcaccatcggcctcgcgatggactactcgccgtccagcaaggcggcgatgaggtgggtggtcgagaacctggtgaaggccggcgacaggatcatcctcatccacgtcctacccaagggagcagacgccagccacaaggggctctggaagagcaccggttcacctctgatccccctgctggagttcatggagatgaacgtgcaggcgcggtacggggtcaatcccgacaaggaggtgctggagatcctgcaggctgagtccaagtccaagcaggtggaaatactagcaaaaatatactggggtgatgcaagggagaaactttgtgaggcagtagatgatctcaaggtcgactctgttgtgcttggttgcaggggattagggcccttaaaaagggcactccttggaagcgtcagcaattatgtcgtcaacaatgcaacctgccccgtcacagtggtgcgtggacccaatggatcacttgcttgaagatgtcgcttctagaatgatggcctagtttgcgtgttcattggtccgtcggcgtacgggcaaatggtgctatttaagacaatagtgatattttgccttttcggaacctttgctatccttgtagtgcaatctcagtgtgttctcctctgttatctcttggttatactacatttctgttgtttcttacatactatttgaaaaaaaatgcctacagacttgttcagtggtgcattttcgtttatgtgcatgactaggcaggcccgctgaggttgaattgttactcgagtttctgaagagcatctaaaagtggaaggtttctttag

SEQ ID NO: 831 - DNA, 1055 bp, Brachypodium distachyon
atccttctggagatcatccctaccatcatagctgcccacctgtcagcgatccatcggccatgaaaaaggaaagaatcgaagaaaccactttgctgatggaataaagccagcctagcctacggcttcgagatcaacagggtattgctgctggactgtctatgggcggacagcggactccaacaaccttaaataccgctgcttggggcacaatcctatgacccagaaatagctcacaacacagacctctctgcatctcttcttcccttccaagctccaccagcctttttcttggaactcaatcaggcaaagacatggccgccgagaagcacaccattggcctcgccatggactactcgccgtccagcaaggccgccgccaagtgggcgttcgataacctcgtgaaggccggcgatcggatcatcctgatccatgtcctccccaaaggaacagatgccagccacaaggggctctggaagagcaccggctcacctctgatccctctgctggagttcatggagatgaacgtgcaggcgaggtacggcgtcaatcctgacaaggaggtgctggagatcctgcaagctgaatcgaagtccaagcaggtagaagtactggcaaaaatatactggggtgacgcaagggagaagctttgtgaggcggtagatgatctcaaggtggactccgtggtgcttggttgcaggggcttagggcccttaaaaagggcactccttggaagtgtcagcaattatgtagtcaacaatgcaacctgcccagttacggtggtgcgtggaccaactggatcaaatgctgcataatgcttcgttaaagatatcacttctggaatgataagctagtctgtgggtctgttcgcggtgcagctgtatgcctgtatctgagatgatgctgtctaagaggatatttggctctgccagttggccttttcagattcttcgtaatagttgtcatagtgcaatttcagtgcgtttatctgttacctcctacccatacatttctgtcgtttcttatatacagagtaaaaaaagcatataaccttgttc

SEQ ID NO: 832 - DNA, 1950 bp, Brachypodium distachyon
atccttctggagatcatccctaccatcatagctgcccacctgtcagcgatccatcggccatgaaaaaggaaagaatcgaagaaaccactttgctgatggaataaagccagcctagcctacggcttcgagatcaacagggtattgctgctggactgtctatgggcggacagcggactccaacaaccttaaataccgctgcttggggcacaatcctatgacccagaaatagctcacaacacagacctctctgcatctcttcttcccttccaagctccaccagcctttttcttggaactcaatcaggcaaagacatggccgccgagaagcacaccattggcctcgccatggactactcgccgtccagcaaggccgccgccaagtgggcgttcgataacctcgtgaaggccggcgatcggatcatcctgatccatgtcctccccaaaggaacagatgccagccacaaggggctctggaagagcaccggctcacctctgatccctctgctggagttcatggagatgaacgtgcaggcgaggtacggcgtcaatcctgacaaggaggtgctggagatcctgcaagctgaatcgaagtccaagcaggtagaagtactggcaaaaatatactggggtgacgcaagggagaagctttgtgaggcggtagatgatctcaaggtggactccgtggtgcttggttgcaggggcttagggcccttaaaaagggcactccttggaagtgtcagcaattatgtagtcaacaatgcaacctgcccagttacggtggtgcgtggaccaactggatcaaatgctgcataatgcttcgttaaagatatcacttctggaatgataagctagtctgtgggtctgttcgcggtgcagctgtatgcctgtatctgagatgatgctgtctaagaggatatttggctctgccagttggccttttcagattcttcgtaatagttgtcatagtgcaatttcagtgcgtttatctgttacctcctacccatacatttctgtcgtttcttatatacagagtaaaaaaagcatataaccttgttcagtggtgcatcgtggtttatgtgcattattccccactaaagccagtgaaacccaacagaacaggcgaccttgttagttggcagtctttttatatgaatgaggggcaataaacagacccttctaggcaggtctcagtaacaaaatggaatattcaatagaagatacttttataactaaaaacaagaaatcatgtcaagagaagaatgatgaaaggaatataaacacaaatacattaagcttcatttccaaatggcagaaaggtgctctttattattgaattatatcagtgtatacagcagatgttcttaagacaaatgaaatgtctggaactcgaacacatagcggaagcaatttctagagcatatcaatcagaacatcttaccagtgccatctttgcgtgggagagattcttgaagatccattctgcgccagctcccagccaaagatgacatctgatcaaccttatcatacaaaccaagaagaccaccggtatggataaaaaggacttttcgtcctttccacttggctggattgctagacatgtctttcagcatcccatatgcccccttcccactgcagaaagagaatgcatatatattcagcaagataaatgataatcacaaaaaaagcaagagaaaatgtaaaatctcttcatcaattagttggagggatccttggtattagtttcacttcgatagagagaaacattccgtacgttttatttttagctaaaaatactagcataaaggatatcaaatcatatgagacatcacacgagaaaggaaagtattacctgtatactggatccagcacaatgcccgttgctgcagctatatctttaacaaacttaagctcctcggttgtgttcatggcgtaacctaagcctttagcctgt

SEQ ID NO: 833 - DNA, 3150 bp, Oryza sativa
agaaaaggcagtttgcacaaggaataaaggcaacctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacctttgattcctctgctggagtttatggagatgaacgtgcaggcgaggtatgggatcaaccccgataaggaggtactggagatcctgcaagctgaatccaagtccaagcaggttgaagtactggcaaaagtttactggggtgatgcaagggagaaactctgtgaggcagtagacgatctcaaggtgaatacctttgttcttggttgcaggggactaggacccttgaaaagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagcaaagataatagaaaaggtgcctggcagtacatcaaatgtatataaacctttatttccaaatggcagaaatatatgctttattctttaaatataacaaacagtgttttacattaaccatctgctttgaattttgtcgtacaaattgaggcgaatactctttttagacaatgagatgtctgaaacctctaacaacaatggaagcaattttggagcatagcaatcagaacatcttaccagttccatctttgcgtggaacagattcttcaagatccattctgcgccaactcccactcaaagatgataactcatcaaccttatcatacaaaccaagaagaccacctgtatgtacaaaaagaatttttcgcccttcccacttagctggattagcacccatgtctttcagcattccatatgctgcctttccactgcagaaatatgaagcatatatctttaggcaatgatatggccagtctatcatgaacttgtgatgaccttcaatattagtctaacagaacaaaactttttatacttttcgacaaatggcaagtatactggttgtaaaattagagttacatgcaaaaggtgtttcttgggattaatgtttcaacaaaaggaatatattgtacctgtagactggatcaaggacaatgcctgttgctgtagctatatctttaacaaacttaagctcctcagctgtgttcatggcataacctaagcccttagcctgtgaagcggcagttgcaggtaatcaagtcaaatgttcacaaaattctaccaatgcacattagcaggaaatatcatcaattagagttgcaccataaaattggaacaatgaaatgaataaactagtttcagaacaattatgttatatactgatacgcgcataacaatgtcataattagaggatgtaagtccactcttcaataccatttaaatatcaaatatagaactttaaaaatgtacttacattttcaatgttgactaaatcatgtgaacgcaaatcagaatgaagtccatcaatcaggtcttgaacataggaatggaaatatccaggatcatcacaaacagagaaagcatggacctatcctaaaaatggataattagtcgaacaatttcagcaggatagaaaacaatcaaagaaagtgcatacttttgcctttaagctactcaattttgatcctaaagcaagaccagcaatggttccaccgctgcataaatttaaaaatcattcaagtcataaagcagcaattgctactttcaggaactaggcatgacgcaataacaagtgagtacataagtaccccttaaaagtaaagaatggtgcgtattgacaaaatacctgccacatgcaacaacaatgtcgtcaaactgaacatcacctgatatctgaatttgatgttcaatctcccttattgcttctatatatcccctatcaagaaacaaaacaagttctgatttacaaaaagaaaaaggaaacaatacaagttacaaagataggtcaagtttcaacaatcgggtatcactttcacaaattctgagacctgtttgaactttgaagtgcaaaccttctctttacagtaatcttatattctattcaatgttgttgattaaatgtggatagaatacactacatttgtccttcagctatgctccacttgttagccaccacacaagatagaaccggatcttctagtgttgcatgagatccactagattcagagcctagggccttagacaattccaacattccaggtccaacatagtatattgaccaatagaaatttgccaaaaaaaagtgatgccctaatgtttattcaaatacaaactaatctcttcttttctgatagactgatggcaaacaccaatccatgaataataatagtccctgaggaatattcaaagtatgctataaacgcacaaagaaattgaaaatgcaaaaatggttcaatagttaggattgaacagaaaacaataccaagttcctagagagtttgatccaccaacaggaataacatatggttttcggccttcttccaaaagcttctttttcagcaagtccgctaaagcctgaac

SEQ ID NO: 834 - DNA, 1045 bp, Oryza sativa
acctagtctacaagttcgctatcaacaggcgatatgtcaccctatttctgttgctgttcaacgacgtccttaaataggagtacttgtgctacaagcctaacccagagatagcaccacaaatacctctcttttctttaggtgtttacttcgacagcttcaccaccttcgtttacccattgccatggcggctgagaagcgaaccattgggctcggcatggactactcgccgtcgagcaaggccgcggcgaagtgggcggtggataacctggtgaaggccggcgaccggatcatcctcgtccatgtccttcccaaaggagcagatgccagccacaaggagctctggaagagcaccggctcacctttgattcctctgctggagtttatggagatgaacgtgcaggcgaggtatgggatcaaccccgataaggaggtactggagatcctgcaagctgaatccaagtccaagcaggttgaagtactggcaaaagtttactggggtgatgcaagggagaaactctgtgaggcagtagacgatctcaaggtgaatacctttgttcttggttgcaggggactaggacccttgaaaagggccctacttggaagtgttagcaactatgttgtcaacaatgcaacctgcccggttactgtggtgcgtgcaccaaccgtgtcaaatgcctgattctatgctacatgggactgctggaaattggaatgctgggcttgttttgctgttcatccatcttttagcagagaaccttcatctgagttggtgccattgcaaggattggtctctggctcctgcacttagcttttccatgctattggaatgttattaagttgaatcttcggtgtatttccttctgttacttcctatgtatagttcattactactgtttaatggtgaatgttaaagattgccaatggtgtgcttgctttatgtatacgacaggggccctaagaacagttttttgcttaggcaggtctttgtaacagaaatggcatatctgattttcttttttataaaataaaacaatcttacataagc

SEQ ID NO: 835 - DNA, 871 bp, Sorghum bicolor
ttgcatcccagcttcagcttcacaccttcacatctttcgtacaccagcgaactccgcaagaaactcgcagcaggtccggacatggcagccgagaagcgcaccattggcatgggcatggactactcgccgtccagcaaggccgccgcaaggtgggcggtcgacaacctgctcaaggccggcgacaggatcatccttgtccatgtcctccccaagggggcggacgccagccacaaggagctctggaagagcacgggctcacctttgattcctctaccggagttcatggagatgaacgtgcaggcgaggtacggattgaaccctgataaggagatactggagatcctgcaggctgcatccaagtccaagcaggtggaagtactagcaaagatttactggggtgatgcaagggagaaactctgtgaggcagtggatgatctcaaggtgaactcctttgtgcttggttgcaggggcttagggccactgaaaagggctctccttggaagtgtcagcaactacgtagtcaacaatgcaacatgcccagttacagtggtgcgcggaccaactggatcgagtgcctgatcttttcttttcagcttaaaggtggaacttctgtagtgcaaggatcatttagtagaactgggttgacgtggtttgtgaggatgaactgttagttctggtaattaactacagtattatactattattgcttgacatctgttgtccagttgtgatatctgtgaattcctctctgttaaatcttgtctatatttatgcttttctttgtgaaattgtgtaagaaaatttctacagactatatgaatgtgctagtggtgagtctgcttttatctatgcgcatgacaaggcttcccct

SEQ ID NO: 836 - DNA, 914 bp, Sorghum bicolor
cgaactcttcccaggaacagcgctatatatagctgcctctgcgcctcggccttcctgcaccaccttcctttgcatcccagcttcagcttcacaccttcacatctttcgtacaccagcgaactccgcaagaaactcgcagcaggtccggacatggcagccgagaagcgcaccattggcatgggcatggactactcgccgtccagcaaggccgccgcaaggtgggcggtcgacaacctgctcaaggccggcgacaggatcatccttgtccatgtcctccccaagggggcggacgccagccacaaggagctctggaagagcacgggctcacctttgattcctctaccggagttcatggagatgaacgtgcaggcgaggtacggattgaaccctgataaggagatactggagatcctgcaggctgcatccaagtccaagcaggtggaagtactagcaaagatttactggggtgatgcaagggagaaactctgtgaggcagtggatgatctcaaggtgaactcctttgtgcttggttgcaggggcttagggccactgaaaagggctctccttggaagtgtcagcaactacgtagtcaacaatgcaacatgcccagttacagtggtgcgcggaccaactggatcgagtgcctgatcttttcttttcagcttaaaggtggaacttctgtagtgcaaggatcatttagtagaactgggttgacgtggtttgtgaggatgaactgttagttctggtaattaactacagtattatactattattgcttgacatctgttgtccagttgtgatatctgtgaattcctctctgttaaatcttgtctatatttatgcttttctttgtgaaattgtgtaagaaaatttctacagactatatgaatgtgctagtggtgagtctgctttta

SEQ ID NO: 837 - DNA, 837 bp, Panicum virgatum
  misc_feature (31)..(31): n is a, c, g, or t
  misc_feature (772)..(772): n is a, c, g, or t
atttacatatagctctgccccctccatcacnctgcgtcaactttcttccctccaagcttcacaaccttcgttcaccggcgactccacaagaaactcatcggcgtttaggctcggactgagagagacatggcggccgggaagcgcaccattggcatgggcatggactactcgccgtcgagcaaggccgcggcgaggtgggcggtcgacaacctggtgaaggccggcgaccggatcatcctcgtccatgtcctctccaagggggcggacgccagccacaaggagctctggaagagcaccggctcacctttgattcctctgccggagttcatggagatgaacgtgcaggcgaggttcgggctgaaccctgataaggaggtactggagatactgaaagctgcatccaaggccaagcaggtggaagtgctagcaaaaatttactggggcgatgcaagggagaaactctgtgaggcagtagatgatctcaaggcggactcatttgtgcttggttgcaggggcttagggccactgaaaagggctctccttggaagtgtcagcaactatgtagtcaacaatgcaacatgcccagttacagtggtgcgtggaccaactatgtgaagtgcctgatcttttttgcttaaagttagagcttttgtaatgcagggcacatttggtatatctgagttcaagttgtttgaaaggatggtgatgtttggctctggctattagcttcagtattattacttgaaatctgtcatctggttatgatatcaanaaatttccctctgttacatcgacttacatttctgctgtttttcatgtatataagcaattatctag

SEQ ID NO: 838 - DNA, 917 bp, Setaria italica
cgaactcttccctggaacagcattacatatagctcggcacatctgcctccctcccatcaacttttcttccctcccagcttcacaacctttccttcaccggcgactccacaagaaactcgtcggcgtttaggctcggattgagagagacatggcgaccgggaagcgcaccattggcatgggcatggactactcgccgtcgagcaaggcgtcggcgaggtgggcgatcgacaacctgctgaaggccggcgaccggatcatcctcgtccatgtcatccccaagggcgcggacgccagccacaaggagctctggaagagcaccggctctcctttgattcctctgccggagttcatggagatgaacgtgcaggcgaggtacggactggtccctgataaggagatactggagatcctgcaagctgcgtccaaggccaagcaggtggaagtgctagcaaagatttactggggcgatgcaagggagaaactctgcgaggcagtagatgatctcaaggtgaactcctttgtgcttggttgcaggggcttagggccacttaaaagggctctccttggaagtgtcagcaactatgtagtcaacaacgcaacatgcccggttacagtggtgcgtggaccaactgcatcaagtgcctgatctttttttctgcttaaaggtggagcttttgtaatgcagggcacatttggtatatctgagttgaggttgtttgaaaggatggtgatgtttggctctcgtattattacttgaaatctgttgtccagttatgatatcagcaaattacctctgttatatctacctgcatttatggtgttattttctatgaaagatatgtaagcaattgtcttgaaactgatttaatgtgccgcgcctatgtggtgaaaatgcttttatgtagagcatgacaagg

SEQ ID NO: 839 - DNA, 792 bp, Pennisetum glaucum
cttcccttcaccggcgactccacaggaaactcgtcggcgttcaggctgatcgggctcggactgagataagagacatggcggccgggaatcgcacagttggcatgggcatggactactcaccgtcgagcaaggcggcggtgaggtgggcggtcgataacctgctcaaggccggcgaccggatcatcctcgtccatgtcatccccaagaacgccgacgccagccacaaggagctctggaagagcaccggctctcctttgattcctctgccggagttcatggagatgaacgtgcaggcgaggtacggactggtccctgataaggagatactggagatcctgcaagctgcatccaaggccaagcaggtagaagtgctagcaaagatttactggggcgatgcaagggagaaactctgcgaggcagtagatgatctaaagttgaactcctttgtgcttggttgcaggggcttagggccacttaaaagggctcttcttggaagtgtcagcaactatgtagtcaacaacgcaacatgccctgttacagtggtgcgtggaccaactgcatcaagtgcctgatctttcttctacttaaaggtatatgtgaattgaggttgtttgaaaggatggtgatgtttgggtctcgtagtgcacttgaaactgatgtccagttatgatatcagcaaattacctatgttatatctacctacatttatggtgttagttttatgaaagaaatgtaagtgattgtctagaaagtgatttaatgtgttgtccctgtggggtgaaaatgctttta

SEQ ID NO: 840 - DNA, 894 bp, Zea mays
cgaactcttcccaggaacacccctatatatatagctgcctctgcgcctcggccttcctgcaccaccttccttttcacagccttcgtacaccggagaaccccgcaagaaacctgcagcaggtccgccaggcatggctgccgagaagcgcaccattggcatgggcatggactactcgccctccagcaaggccgccgcgaggtgggcggtcgacaacctgatcaaggccggggaccgtctcgtcctcgtccacgtcctccccaagggcgtggactccagccacaaggagctctggaagaccaccggctcacctttgattcctctctcggagttcatggagatgaacctgcaggcgaggtacgggctcaaccctgataaggagacactggagatcctgcgagctgtatccaagtccaagcaggtggaagtactagcaaaggtttactggggcgatgcaagggagaaactctgtgaggcggtagatgatctcaaggtggactcctttgtgcttggttgcaggggcttagggccactgaaaagggctctccttgggagtgtcagcaactatgtagtcaacaatgcaacatgcccggttacagtggtgcgcggaccaactgggttgagtgcctgatcttttctgtttaatgtggggcttttgtagtgcaaggatcatttagtacaactgggttgatgtcgtttgtgaggatggtgtgttagcacttagctctggtaattagcttcggtgttattacttgacatctgttgtccagttgtgatatctgtgaatttcatctattaaatcttatctacatatatttatgcttttctttgtgaaattatgtaagaaaatttctacatactatatatatgactgtgtcactggtgagtctgttttta

SEQ ID NO: 841 - DNA, 1535 bp, Leymus cinereus x Leymus triticoides
  misc_feature (334)..(334): n is a, c, g, or t
  misc_feature (699)..(699): n is a, c, g, or t
  misc_feature (1194)..(1194): n is a, c, g, or t
  misc_feature (1379)..(1379): n is a, c, g, or t
  misc_feature (1519)..(1519): n is a, c, g, or t
tcgcccgagacagccatggcggagcacgacctgacggcgagcgtggcggcgtggatggacccccatctggttctcccggtgctggagttcctccaggagcgcggggtctacgccgacgaggagatcctgcggggcaagatccgcctcctcggcggcaccaacatggtcgactacgccatggacatccacaagtcgctccacggcaccgacgacgtccccgccgacatggtcgcccgccgctccgaggtcgtcgagaggctcagggccctccaggaggccgtcgcgcccatcgtcgccttcctctccagcccgcagctcgtgcaggagctccacnccgacaagcagtacaacctccacatgctccaggagcgccaccagatcgggccggaccagatcgaggctctgtaccagtacgccaagttccagtacgagtgcgggatgtactctgatgctgctgatttcttgtcccagtaccgtgctctgtgcaccaacagcgagaggagcctgagtgccctgtgggggaagctggcggcggagatactgatgcagaactgggatgttgcgcaggaggagctcaacaggctcaaggagatgattgattccagcagcttcacctcgtcgcctgtgaaccagctccacagcaggatatggctgatgcattggagtctcttcatcttcttcaaccatgagaatggaagnaacgggatcatcgacctcttcttccaggacaggtacctgaatgctatccagacaaacgctccccatcttctgaggtaccttgctgctgcagttgttgtgaacaaaaggagaaggaacatgcttaaggaactgatcaaggtcatccagcaggagcagaacagctacaaggatcccatcatcgaattcctagagtgcctgtatgtcaagtatgattttgatggcgctcagcagaagctcgtcgagtgcgagcaggttatactgaatgatcctttcctggggaagcgcgtcgaagagaggaatggcattgctgttcctctgagagacgagttccttgaaaatgctcgcttgttcatctttgagacttactgccgtatacatcgctgcatcgatattggtgtgcttgcggagaagatgaacatgacctatgatgaagccgagttgtggataatgaacatggtcaagagttccaagctagatgccaagattgattcagtnacgggaactctcatcatgacgaccaatcgtgttgatgtccatgagcagattattgagagcatgaagaacctcaacgccaggacctacatgctagcaaagagtgtcgtggatccagggcatgcagcagcacagcaggctgctcggtgagaccaacagataatctgcagctttgaggcggtaaaaantactttggcaacttcgttgttaggcagtgacttcgttgctagtatttgaatcacattgctacagcttatgctgatgttttaaatgctttgtactccttttactcaagtttatcgtcctatgaattaatactgcaaaagangtttaatgcatttcca

SEQ ID NO: 842 - DNA, 1622 bp, Triticum aestivum
cctccctccctccacccgccgccgccgccacccacaaaccctagaaaccctagctctcatcccctcgcccgagacagccatggcggagcacgacctgacggcgagcgtggcggcgtggatggacccccacctggtgctcccggtgctggagttcctccaggagcgcggggtctacgccgacgaggagatcctgcggggcaagatccgcctcctcggcggcaccaacatggtcgactacgccatggacatccacaagtcgctccacggcaccgacgacgtccccgccgacatggtcgcccgccgctccgaggtcgtcgagaggctccgggccctccaggaggccgtcgcgcccatcgtcgccttcctctccagcccgcagctcgtgcaggagctccacgccgacaagcagtacaacctccacatgctccaggagcgccaccagatcggcccggaccagatcgaggccctctaccagtacgccaagttccagtacgagtgcgggatgtactcggacgccgccgatttcctgtcccagtaccgcgctctgtgcaccaacagcgagaggagcctgagcgccctgtgggggaagctggcggcggagatactgatgcagaactgggatgtcgcgcaggaggagctcaacaggctcaaggagatgattgattccagcagcttcacctcgtcgcctgtgaaccagctccacagcaggatatggctgatgcactggagcctcttcatcttcttcaaccatgagaatggaaggaacgggatcatcgacctcttcttccaggacaggtacctcaatgctatccagaccaacgctccccatcttctgaggtaccttgctgctgcagttgttgtcaacaagaggagaaggaacatgcttaaggaactcatcaaggtcatccagcaggagcagaacagctacaaggatcccatcattgagttcctggagtgcctgtatgtcaagtatgattttgatggcgctcagcagaagctcgtcgagtgcgagcaggttatactgaatgatcctttcctgggcaagcgcgtcgaagagaggaatggcattgctgttcctctgagagacgagttccttgagaatgctcgcctgttcatctttgagacctactgccgtatacatcgctgcatcgatattggtgtgcttgcggagaagctgaacatgacctatgatgaagccgagttgtggataatgaacatggtcaagagttccaagctagatgccaagattgattcagtgacgggaactctcatcatgacgaccaatcgtgttgatgtccatgagcagattattgagagcatgaagaacctcaacgccaggacctacatgctggcaaagagtgtcgtggatccagggcatgcagcagcacagcaggctgctcggtgagaccaacagatgatctgcagctttgaggcggtaaaaattactttgggaacttcgttgttaggcagtgacttcgttgctagtatttgaatcacattgctacagcttatgctgatgttttaaatgctttgtactccttttactcaagtttatcgtcctatgaattaatactgcaaaagacgtttaacgcatttccttgctgtggtgtcattgcatattt

SEQ ID NO: 843 - DNA, 1736 bp, Secale cereale
ccccccccccccctcccctccctccacccgccgccgccgccacccacaaaccctagaaaccctagcatcccctcgcccgagacagccatggcggagcacgacctgacggcgagcgtggcggcgtggatggacccccacctggtgctcccggtgctggagttcctccaggagcgcggggtctacgccgacgaggagatcctgcggggcaagatccgcctcctcggcggcaccaacatggtcgactacgccatggacatccacaagtcgctccacggcaccgacgacgtccccgccgacatggtcgcccgccgctccgaggtcgtcgagaggctccgggccctccaggaggcggtcgcgcccatcgtcgccttcctctccagcccgcagctcgtgcaggagctccacgccgacaagcagtacaacctccacatgctccaggagcgccaccagatcggcccggaccagatcgaggccctctaccagtacgccaagttccagtacgagtgcgggatgtactctgacgccgctgatttcctctcccagtaccgtgctctgtgcaccaacagcgagaggagcctcagtgccctgtgggggaagctggcggccgagatactgatgcagaactgggatgtcgcgcaggaggagctcaacaggctcaaggagatgattgactccagcagcttcacctcgtcgcctgtgaaccagctccacagcaggatatggctgatgcattggagcctcttcatcttcttcaaccatgagaatggaaggaacgggatcatcgacctcttcttccaggacaggtacctcaatgctatccagaccaacgctccccatcttctgaggtaccttgctgctgcagttgttgtgaacaagaggagaaggaacatgcttaaggaactcatcaaggtcatccagcaggagcagaacagctacaaggatcccatcatcgaattcctagagtgcctgtatgtcaagtatgattttgatggcgctcagcagaagctcgtcgagtgtgagcaggttatactgaatgatcctttcctcgggaagcgcgtcgaagagaggaatggcattgctgttcctatgagagatgagttccttgaaaatgctcgcttgttcatctttgagacctactgccgtatacatcgctgcatcgatattggtgtgcttgcggagaagctgaacatgacctatgatgaagccgagttgtggataatgaacatggtcaagagttccaagctagatgccaagattgattcagtgaccggaactctcatcatgacgaccaatcgtgttgatgtccatgagcagattattgagagcatgaagaacctcaacgccagaacctacatgctagcaaagagcgtcgtggatccagggcatgcagcagcacagcaggctgctcggtgagaccaacagatgatctgcacctttgaggccgtaagaattactttgcgaactttgttgttaggctgtgacttcgttgctagtatttgaatcacacagatatggtgattggcagtttgctacagcttatgctgacgttttaaatttttgtactactccttctactcaagtttatcgtcctatgaattaatactgcaaaagacgtttaatagtaaaaaaaaaacaaaaaaaaaaacaaaaaaaaaaaaacaaaaaaaaaacaaaaaaaaaagaaaaaaaactaaaacaaagaatagaacgtaagacgaacaagaggaagtagacag

SEQ ID NO: 844 - DNA, 1707 bp, Brachypodium distachyon
aacccaacctctcccgtattccccttctccccctcccctcgcgccgccgccctcgaaccctaaaacaaaacccccgatagagccaccggatagagcatcagccatggcggagcacgacctgacggcgcgcatggccgcgcagatggactgccatctggtgttcccgctgctggagttcctccaggagcgccagctctacgccgacgaccagatcctggaggccaagatccgcctcctcagcggcaccaacatggtcgactacgccatggacatccacaagtcgctccacggaaccgacgacgtccccgctgacatggtcgcccgccgctcagaggtcgtcgccaggctcaggaccctcgacgaggccgcagcgccgcttgtagggttcctctccaacccgcagctcgtccaggagctcaggcccgacaagcagtacaacatccacatgctccaggaacgctatcagattggacctgaccagattgaagctctgtatcaatatgctaaatttcagtttgagtgtgggaactactcaggagctgctgatttcttgtaccagtatcgtgctttgtgcacaaacagtgagaggagtttgagtgcgctgtggggaaagctcgctgcagagatattgatgcagaactgggatgttgcacaggaggagcttaatcggttgaaggagcttattgattcaaagaacttctcatcacctataaatcagctccacagcagaatatggctgatgcattggagtctctttatcttctttaaccatgaaaatggaagaaatgggatcatcgatctgttcttccaggacaggtacttgaatgcaattcagacaaacgcaccccatcttctgagataccttgctgctgcagttgttgtgaacaaaaggagaaggaatatgcttaaagaattgattaaagtcattcagcaggagcagcagtgctacaaggatcccataactgaattcctcgaatgcttgtatgtgaactatgatttcgatggcgcacaacagaaactcattgagtgcgagcaggttatattgaatgatccctttctgggaaagcgcattgaagaagggaatttcatcactgttcccctaagagacgagttccttgaaaatgctcgcctgttcattttcgagacttactgccgtatacatcggtgcatagatattggcatgcttgcggagaagatgaacatgacctacgacgaggcggaattatggataatgaacttggtcaagagttcaaaactggatgccaagattgattcagtgacaggaactcttatcatgacgaccaatcatgttaacgtccatgagcagatcattgagaacatgaagaaccttaacgcccgaacttacatgctagcaaagagccttgtggatccaggtcatgcagcagcacagcaggctgcccggtgagactaaaagcatctgcagttttgagtcggcaagaattgtttgggagcttggttcttcggctgcgcctttgttgttagtacttgaatcacacagacggtgatctgcaatttgctatagcttatgctgacgtttataatgttttgtactcggaattctgttactcaagttaattgtttatttagtattgcaatcactcatacctgattgtcacggtatttcttgtgtatccccaagtgccaaattgtgtgacttcgaatgggaacattgatgtctgggagaaa

SEQ ID NO: 845 - DNA, 1782 bp, Brachypodium distachyon
aaaccacaaaacctcaagcccagcccaataaacccaacccaacctctcccgtattccccttctccccctcccctcgcgccgccgccctcgaaccctaaaacaaaacccccgatagagccaccggatagagcatcagccatggcggagcacgacctgacggcgcgcatggccgcgcagatggactgccatctggtgttcccgctgctggagttcctccaggagcgccagctctacgccgacgaccagatcctggaggccaagatccgcctcctcagcggcaccaacatggtcgactacgccatggacatccacaagtcgctccacggaaccgacgacgtccccgctgacatggtcgcccgccgctcagaggtcgtcgccaggctcaggaccctcgacgaggccgcagcgccgcttgtagggttcctctccaacccgcagctcgtccaggagctcaggcccgacaagcagtacaacatccacatgctccaggaacgctatcagattggacctgaccagattgaagctctgtatcaatatgctaaatttcagtttgagtgtgggaactactcaggagctgctgatttcttgtaccagtatcgtgctttgtgcacaaacagtgagaggagtttgagtgcgctgtggggaaagctcgctgcagagatattgatgcagaactgggatgttgcacaggaggagcttaatcggttgaaggagcttattgattcaaagaacttctcatcacctataaatcagctccacagcagaatatggctgatgcattggagtctctttatcttctttaaccatgaaaatggaagaaatgggatcatcgatctgttcttccaggacaggtacttgaatgcaattcagacaaacgcaccccatcttctgagataccttgctgctgcagttgttgtgaacaaaaggagaaggaatatgcttaaagaattgattaaagtcattcagcaggagcagcagtgctacaaggatcccataactgaattcctcgaatgcttgtatgtgaactatgatttcgatggcgcacaacagaaactcattgagtgcgagcaggttatattgaatgatccctttctgggaaagcgcattgaagaagggaatttcatcactgttcccctaagagacgagttccttgaaaatgctcgcctgttcattttcgagacttactgccgtatacatcggtgcatagatattggcatgcttgcggagaagatgaacatgacctacgacgaggcggaattatggataatgaacttggtcaagagttcaaaactggatgccaagattgattcagtgacaggaactcttatcatgacgaccaatcatgttaacgtccatgagcagatcattgagaacatgaagaaccttaacgcccgaacttacatgctagcaaagagccttgtggatccaggtcatgcagcagcacagcaggctgcccggtgagactaaaagcatctgcagttttgagtcggcaagaattgtttgggagcttggttcttcggctgcgcctttgttgttagtacttgaatcacacagacggtgatctgcaatttgctatagcttatgctgacgtttataatgttttgtactcggaattctgttactcaagttaattgtttatttagtattgcaatcactcatacctgattgtcacggtatttcttgtgtatccccaagtgccaaattgtgtgacttcgaatgggaacattgatgtctgggagaaaatcacatctagcacagacgatcccaatatcctctattgac

SEQ ID NO: 846 - DNA, 1772 bp, Avena sativa
caccacaaaccctgaaaccctagccccctctcgccctatccgccggaagagagcagccatggcgaagtacgatctgacggcgcgcttgatagcgcagatggactgccatctggcgctcccgatgctggagtacctccaagagcgcaaggtctaccccgacgagcagatcctggagggcaagatctccctcctcagcggcaccaacatggtggactacgccatggacatccacaagtcgctccacggcaccgaggacgtcccggccgacatggtcgcccgccgctctgaggtcgtcgagaggctgaggagcctgcaagaggccgtcgggccgatcgtcgcgttcctctccaacccgcagctcgtgcaggaacttcgggccgacaagcagtacaacatccacatactgcaggagcgccaccggatcgggccggagcagatcgaggccctgtaccagtacgccaagtttcagttcgagtgcgggatgtactcggaggctgctgatttcctgtcccagtaccgtgctctgtgcacggacagcgagagaagcttgagcgctctgtggggaaagctggcagcagagatactgatgcagaattgggatgtcgcgcaggaggagcttaatcggttgaaggagattatcgactcaaacaaattctcgtcgccgataagtcagctccacagcaggatatggctgatgcactggagcctcttcatcttcttcaaccatgagaatgggaagaatggtatcatcgatctcttcttccaggaaaggtacctgaatgctatccagacaaacgccccacatctcctgaggtaccttgctgcagcagttgttgtgaacaagaggagaaggaacatgcttaaagagttgatcaaagtcatccagcaggagcagcagagctacaaggatcccataattgaattgctggaatgcctgtatgtgaagtatgattttgatggtgcgcaacagaaactcatcgagtgtgagcaggttattctgaatgatcctttcctgggaaagcgcattgaggagggtaatttcatccgcgttcctctgagagatgagttccttgaaaatgctcgcctgttcatctttgagaactactgccgtattcatcggtgcatcgatattggcatgcttgcggagaagatgaacatgacctacgatgaagctgaaccttggataatgaacttgatcaagagttcgcaactggatgccaagatcgattcggtgaccgggactctcgtcatggcgaccaaccatgttaatgtccatgagaagatcatcgagagcatgaagaaccttaacgcgaggacttacatgctagcaaagagcctcgtggatccaggtcacgcagcagcagcctaggctgctaggtgagagagactgcaagaataacttcagagattagttgtttcgcagtggcttccttcgtacttgaatcatatgcagatggtgatttgcagtttgctaaagctattgcttacgtttttaaggttttgtactcggatttctattactaagttaatcgttctatatctagctagcactgaacagaaaattagtacatttccttgttgtcgtgccattgttgctgtccgcatgtttactttactctgttgtctctatcaacctcaagttggttcaggcattgctaggtagttccagggttgtcttggccaggtatgtcttgaggcatgctgatggtgatatgcactttgctaaagctattgctggacgtttttaaagttttgtacttgggtttctgtta

SEQ ID NO: 847 - DNA, 1821 bp, Avena sativa
caccacaaaccctgaaaccctagccccctctcgccctatccgccggaagagagcagccatggcgaagtacgatctgacggcgcgcttgatagcgcagatggactgccatctggcgctcccgatgctggagtacctccaagagcgcaaggtctaccccgacgagcagatcctggagggcaagatctccctcctcagcggcaccaacatggtggactacgccatggacatccacaagtcgctccacggcaccgaggacgtcccggccgacatggtcgcccgccgctctgaggtcgtcgagaggctgaggagcctgcaagaggccgtcgggccgatcgtcgcgttcctctccaacccgcagctcgtgcaggaacttcgggccgacaagcagtacaacatccacatactgcaggagcgccaccggatcgggccggagcagatcgaggccctgtaccagtacgccaagtttcagttcgagtgcgggatgtactcggaggctgctgatttcctgtcccagtaccgtgctctgtgcacggacagcgagagaagcttgagcgctctgtggggaaagctggcagcagagatactgatgcagaattgggatgtcgcgcaggaggagcttaatcggttgaaggagattatcgattcaaacaaattctcgtcgccgataagtcagctccacagcaggatatggctgatgcactggagcctcttcatcttcttcaaccatgagaatgggaagaatggtatcatcgatctcttcttccaggaaaggtacctgaatgctatccagacaaacgccccacatctcctgaggtaccttgctgcagcagttgttgtgaacaagaggagaaggaacatgcttaaagagttgatcaaagtcatccagcaggagcagcagagctacaaggatcccataattgaattgctggaatgcctgtatgtgaagtatgattttgatggtgcacaacagaaactcatcgagtgtgagcaggttattctgaatgatcctttcctgggaaagcgcattgaggaggggaatttcatccgcgttcctctgagagatgagttccttgaaaatgctcgcctgttcatctttgagaactactgccgtattcatcggtgcatcgatattggcatgcttgcggagaagatgaacatgacctacgatgaagctgaaccttggataatgaacttgatcaagagttcgcaactggatgccaagatcgattcggtgaccgggactctcgtcatggcgaccaaccatgttaatgtccatgagaagatcatcgagagcatgaagaaccttaacgcgaggacttacatgctagcaaagagcctcgtggatccaggtcacgcagcagcagcctaggctgctaggtgagagagactgcaagaataacttcagagattagttgtttcgcagtggcttccttcgtacttgaatcatatgcagatggtgatttgcagtttgctaaagctattgcttacgtttttaaggttttgtactcggatttctattactaagttaatcgttctatatctagctagcactgaacaagaaaattagtacatttccttgttgtcgtgtcattgttgctgtccgcatgtttactgtactctgctgtctcgatcaacctcaagttggttcaggcattgctaggtagttccagcgttttcttggccagatatgtcttcaggcatgctgatggtgatatgcagtctgctaaagctatttgctagcgtttttaaagttttgtactcgggtttctgttactaagttaatcatttgatatcttgctagcactgaacagaaaaattagt

SEQ ID NO: 848 - DNA, 1675 bp, Panicum virgatum
ccactctcccctcgcctcctccctccccgcgccgccacccccctcgaaaccctaaccctagccgcctcccgggaggcgggtaggagagctcgcggcgccggccatggcggagcacgacctcacggcgctgctggcggcgcagatggaccgccacctggtgttcccgctgctggagttcctgcaggagcggcagctctactcggagccggagatcctcgaggctaagatccgcctcctcagcggcaccaacatggtcgactacgccatggacatccacaagtcgctccacggcaccgacgacgtgcccgaggacatggtccgccgccgcgccgaggtcgtctccaggctcaggtcgctcgaggaggccgcggcgccgctcgtcaccttcctccagaacccgcagctcgtgcaggagctcaggcccgacaagcagtacaacatccacatgctccaggaccgataccagattggtccagatcagattgaagctctgtatcagtatgccaaatttcagtttgagtgtggtaactactcaggggctgctgactacttgtaccagtatcgtgctttgtgcacaaacagtgagaggagtgtgagtgccctttggggaaagctggcagcagaaatcctgatgcagaactgggatgtagctttggaagaactcaaccgcttgaaggaaataattgattcaaagaacttctcatcacctctgaatcagctccagaacaggatatggctgatgcattgggctctcttcatcttcttcaaccatgaaaatggtagaaatgggatcattgatctgttcttccaagacaggtacttgaacgctattcagacaaatgcacaccatcttctgagatacctagctactgcagttgttgtgaacaaaaggagaaggaatatgcttaaagagcttattaaagtcattcagcaggagcaacatagctacaaggaccccataactgaatttctggaatgcttatatgtcaactatgattttgatggtgctcaacagaaactcatggagtgcgagcaggttattttgaatgatcctttcctgggaaagcgcattgaagaaggaaatttcgtcactgtccctttgagagatgagttccttgaaaatgctcgtctgtttattttcgagacttactgccgtattcatcggtgcattgatatcggcatgcttgcgcagaagctgaacatgagctacgatgaggcagagttgtggataatgaacttggttaggaactcaaaactggatgccaggatcgattcagtgtctggaacccttatcatgacaaccaatcatgtcaatgtgcatgagcagattatcgagagcttgaagggccttaacatgcggacatacatgctagcaaagaacatcgtggagccagctcaagcagcacagcaggcagctcggtgaggttagcggaatccacagttttgaggtgcccagtgttagttacagtagagacagctgtaaactctcggagctctattgtcaggaagtgacttcgtcatcagtatttgaacacctggggtgttggtttgccgtttgctacagcttatgctgacatttttagtattttgtactcagaatttcataacaggtgatctccttctctatgtattactgaaatgaatgatgcaatcagattcatgtttcggcattaag

SEQ ID NO: 849 - DNA, 1707 bp, Panicum virgatum
cccaaccccggcccatctcgtctccccctctccccccgtctcctccctccccgcgccgccacccccctcgaaaccctaaccctagccgcctcccgggaggcggagaggagagctcgcggcaccggtcatggcggagcacgacctcaccgcgctgctggcagcgcagatggaccgccacctggtcttcccgctgctggagttcctgcaggagcggcagctctactcggagccggagatcctcgaggccaagatccgcctcctcagcggcaccaacatggtcgactacgccatggacatccacaagtcgctccacggcaccgacgacgtccccgaggacatggtccgccgccgcgccgaggtcgtctccaggctcaggtcgctcgaggaggccgccgccccgctcgtcaccttcctccagaacccgcagctcgtgcaggagctcaggcccgacaagcagtacaacatccacatgctccaggatcgataccagattggtcctgatcagattgaagctctgtatcagtatgccaagtttcagtttgagtgtggtaactactcgggggctgctgactacctttaccagtatcgtgctttgtgcacaaacagtgagaggagtgtgagtgccctttggggaaagctggcggcagaaatcctgatgcagaactgggatgtagctttggaagaactcaaccgcttgaaggaaataattgattcaaagaatttctcatcaccccttaaccagctccagaacaggatatggctgatgcattgggctctcttcatcttttttaaccatgaaaatggtagaaatgggatcattgatctgttcttccaggacaggtacttgaatgctattcagacaaatgcacaccaccttctgagatacctagctactgcagtggttgtgaacaaaaggagaaggaatatgcttaaagagctgattaaagtcattcagcaggagcagcatagctacaaggatcctataactgaatttctggaatgcttatatgtcaactatgattttgatggtgctcaacagaaactcatggagtgcgagcaggttatattgaatgaccctttcctgggaaagcgcattgaaggaaattttgttactgtccctttgagagatgagttccttgaaaatgctcgtctgtttattttcgagacttactgccgtattcatcggtgcattgatatcagcatgcttgcgcagaagcttaacatgagctatgatgaggcagagttgtggataatgaacttggttaggagctcaaaactggatgccaggattgattcagtgtcaggaacccttatcatgacgaccaatcacgtcaatgtgcatgagcagattatcgagagcttgaagggccttaacatgcggacctacatgctagcaaagaacattgtggagccagctcaagcagcacagcaggcagctcggtgaggttagcggaatccacagttttgaggtgcccagggttagtgtagtagagacagctgtgaactttcggagctctatagccaggcagtgacttcgtcatcagtatttgaacacctggggtgctggtttgccgtttgcttcttatgctgacattttcagtattttgtactcggaatttcataacaggtgaaccttctctatgtattactacaatgaatgatgcaatcagattcatgtttcggcattaaggtgttaaacattcttcc

SEQ ID NO: 850 - DNA, 1736 bp, Sorghum bicolor
aaacccaaccccaacccttctcgacttccactcctctcttccttcctccccgcgccgccgccgcccccgccctccgaacccgaaaggaaccctaaccctagcggcctccgggagaggcagctaggagagctcggagcaccagcagccatggcggagcacgacctcacggcgctgatggcggcgcagctggaccgccacctggtgttcccgctgctggagttcctccaggagcggcagctctactcggagccggagatcctcgaggccaagatccgcctcctcagcggcacgaatatggtagactatgccatggatatccacaagtccctccacggcaccgacgacgtccccgaggacatggtcaagcgccgcgccgaggtcgtctccaggctcaggtcgctcgaggaggccgccgccccgctcgtcgccttcctccagaacccgcagctcgtgcaggagctcaggcccgacaaacagtacaacatccacatgctccaggagcgataccagattggtcctgaccagattgaagctctgtatcagtatgccaaatttcagttcgagtgtggtaactactcaggggctgctgattacctataccagtatcgtgctttgtgcacaaacagtgagcggagtgtgagtgctctctggggaaagctggcagcagaaatcttgatgcagaactgggatgtggctttggaggaacttaatcgcttgaaggaaataattgattcaaagaacttctcatcacctctgaatcagctccagaacaggatatggctgatgcattgggctctgttcatcttctttaaccatgaaaatggtagaaatgggattattgatctgttcttccaggacaggtacttgaatgctatacagacaaatgcacaccatcttctgagatatctagctactgcagttgttgtcaacaaaaggagaaggaatatgcttaaagagttgattaaggtcattcagcaggagcagcatacctacaaggatcccataactgaatttctggaatgcttatatgtcaactatgattttgatggtgctcaacagaaacttatggagtgtgagcaggttatactgaatgatcctttcctgggcaagcgcatagaagagggcaattttgtcactgttcctttgagagatgagttccttgaaaatgctcgtctgtttattttcgagacatactgccgtattcatcggtgcattgatatcagcatgctttcccagaagctgaacatgagctatgatgaggccgagttgtggataatgaacttggttaggagctcaaaactggatgccaggatcgattcagtgtcaggaactcttatcatgacaaccaatcacgtcaatgtccatgagcagattattgagaacttgaagggcctcaacatgcggacctacatgctggcaaagaacatcgtggagccagctcaagcagctcagcaggcaactcgttgagggtagcagagttcacagttttgaggcgccaaggactagtttagaggcagagcacaaacttttggagctctaatgtgtggcagtgaatttcgtcatcagaatttgaacagctgggagggtgtggcttgccgtttgatacagcttattatgctgacatttccaatattttgtactcggaatttcgtaacagtcgatccttctcaatgttttactgtaatgcaatggatacagtgaatcgattaacaccttatttatgccacattattcat

SEQ ID NO: 851 - DNA, 1773 bp, Sorghum bicolor
gacgacatcgatcggcagccgagccccaaaaccacaaaaacccaaccccaacccttctcgacttccactcctctcttccttcctccccgcgccgccgccgcccccgccctccgaacccgaaaggaaccctaaccctagcggcctccgggagaggcagctaggagagctcggagcaccagcagccatggcggagcacgacctcacggcgctgatggcggcgcagctggaccgccacctggtgttcccgctgctggagttcctccaggagcggcagctctactcggagccggagatcctcgaggccaagatccgcctcctcagcggcacgaatatggtagactatgccatggatatccacaagtccctccacggcaccgacgacgtccccgaggacatggtcaagcgccgcgccgaggtcgtctccaggctcaggtcgctcgaggaggccgccgccccgctcgtcgccttcctccagaacccgcagctcgtgcaggagctcaggcccgacaaacagtacaacatccacatgctccaggagcgataccagattggtcctgaccagattgaagctctgtatcagtatgccaaatttcagttcgagtgtggtaactactcaggggctgctgattacctataccagtatcgtgctttgtgcacaaacagtgagcggagtgtgagtgctctctggggaaagctggcagcagaaatcttgatgcagaactgggatgtggctttggaggaacttaatcgcttgaaggaaataattgattcaaagaacttctcatcacctctgaatcagctccagaacaggatatggctgatgcattgggctctgttcatcttctttaaccatgaaaatggtagaaatgggattattgatctgttcttccaggacaggtacttgaatgctatacagacaaatgcacaccatcttctgagatatctagctactgcagttgttgtcaacaaaaggagaaggaatatgcttaaagagttgattaaggtcattcagcaggagcagcatacctacaaggatcccataactgaatttctggaatgcttatatgtcaactatgattttgatggtgctcaacagaaacttatggagtgtgagcaggttatactgaatgatcctttcctgggcaagcgcatagaagagggcaattttgtcactgttcctttgagagatgagttccttgaaaatgctcgtctgtttattttcgagacatactgccgtattcatcggtgcattgatatcagcatgctttcccagaagctgaacatgagctatgatgaggccgagttgtggataatgaacttggttaggagctcaaaactggatgccaggatcgattcagtgtcaggaactcttatcatgacaaccaatcacgtcaatgtccatgagcagattattgagaacttgaagggcctcaacatgcggacctacatgctggcaaagaacatcgtggagccagctcaagcagctcagcaggcaactcgttgagggtagcagagttcacagttttgaggcgccaaggactagtttagaggcagagcacaaacttttggagctctaatgtgtggcagtgaatttcgtcatcagaatttgaacagctgggagggtgtggcttgccgtttgatacagcttattatgctgacatttccaatattttgtactcggaatttcgtaacagtcgatccttctcaatgttttactgtaatgcaatggatacagtgaatcgattaacaccttatttatgccacattattcat

SEQ ID NO: 852 - DNA, 1781 bp, Pennisetum glaucum
ctctcctcgtctcctccctccccgcgccgccaccccctcgaaaccctaaccctagccgccccgcagggaggctgggaggagagctcgcggcagcagccatggcggagcacgacctcaccgcgcttcttgcggcgcagttggatcgccacctggtgttcccgctgctggagttcctccaggagcggcagctctactcggagccggagatcctggaggccaagatccgcctcctcagcggaaccaacatggtcgactacgccatggacatccacaagtccctccacggcaccgacgacgtccccgaggacatggtccggcgccgcgccgaggtcgtctccaggctcaggtcgctcgaggaggccgctgccccgctcgtcaccttcctccagaacccgcagcttgtgcaggagctcaggcctgacaagcagtacaacatccacatgctccaggaccgataccagattggccctgaccagattgaagctctgtatcagtatgccaaatttcagtttgagtgtggtaactactcaggggctgctgactacttgtaccagtatcgtgcgttgtgcacaaacagtgagaggagcgtgagtgccctttggggaaagctggcggcagaaatcctgatgcagaactgggatgttgctttggaagaactcaaccgcttgaaggaaataattgattcaaagagcttctcatcacctcttaatcagctccagaacaggatatggttgatgcattgggctctcttcatcttcttcaatcatgagaatggtagaaatgggatcatcgatctgctcttccaggacaggtacttgaacgctattcagacaaatgcacaccatctcctgaggtacctagccactgcagttgttgtgaacaaaaggagaaggaacatgcttaaagagctgattaaagtcattcagcaggagcagcatagctacaaggatcccataactgaatttctggaatgcttatatgtcaactatgattttgatggtgctcagcagaaactcatggagtgtgagcaggttatattgaatgatcctttcctgggaaagcgcattgaagaaggaaattttgtcactgtccctttgagagatgagttccttgaaaatgctcgtctgtttattttcgagacttactgccgtattcatcggtgcattgatatcagcatgctttcgcagaagctgaacatgagctacgatgaggcagagttgtggataatgaacttggttaggagctcaaaactggatgccagaatcgattcagtgtcaggaactcttatcatgacgacaaatcaagtcaatgtgcatgagcagattattgagagcttgaagggccttaacatgcggacctacatgctagcaaagaaccttgtggagccagctcaagcagcacagcaggcaacccggtgaagttgccagagtccacagttttgaggcgccaagtattagttacactagagacgagctgtaaacttttggagctctattgttggtcagtgactgtcatcagtatttgaacacctgggaggtggtttgcagtttgctacagcatatgctgacatttcagtattttgtactcggaatttcataacaaggcatccttctttatgtgctactttagtgaatgatgcagcaggatttattagtgctttggcgttaaggtgattctttttttagggtggccggcccagcatttgcaggaaggcgtgagtggtgttgtttgctactggtgtcttggactggcagtcgcgtattttatgccgccattttgtt

SEQ ID NO: 853 - DNA, 1751 bp, Setaria italica
ctgatccacaaaaccacaaaaacccagcccgacccatctcgtcctcccctctcctcgtctcctccctccccgcgccgccagcccgccaccccctcgaaaccctaaccctagccgcccccgggaggctgggaggagagctcgcggcaccagccatggcggagcacgacctcaccgcgctgctggcggcgcagatggaccgccacctggtgttcccgctcctggagttcctgcaggagcggcagttctactcggagccggagatcctggaggccaagatccgcctcctcagcggcaccaacatggtcgactacgccatggacatccacaagtccctccacggcaccgacgacgtccccgaggacatggtcaggcgccgcaccgaggtcgtctccaggctcaggtcgctcgaggaggccgccgccccgctcgtcaccttccttcagaacccgcagctcgtgcaggagctcaggcccgacaagcagtacaacatccacatgctccaggaccggtaccagattggtcctgatcagattgaggctttgtatcagtatgctaaatttcagtttgagtgtggtaactactcgggggctgctgactacctgtaccagtatcgtgctctgtgcaccaacagtgagaggagtgtgagtgccctttggggaaagcttgcagcagaaattctgatgcagaactgggatgtagctttggaagaactcaaccgcttgaaggaaataattgattcgaagaacttctcatcacctcttaatcagctccagaacaggatatggctgatgcattgggctcttttcatcttcttcaaccatgagaatggtagaaatgggatcattgatctgttcttccaggacaggtacttgaatgctattcagaccaatgcacaccatctcctgagatacctagctactgcagttgttgtgaacaaaaggagaaggaatatgcttaaagagctgattaaagtcattcagcaggagcagcatagctacaaggatcccataactgaatttctggaatgcttatatgtcaactatgattttgatggtgctcagctgaaactcatggagtgcgagcaggttatattgaatgatcctttcctgggaaagcgcattgaagaaggaaatttcgtcactgtccctttgagagatgagttccttgaaaatgctcgtctgtttattttcgagacttactgccgtattcatcggtgcattgatatcagcatgctttcgcagaagctgaacatgagctacgatgaggcagagttgtggataatgaacttggttaggagctcaaaactggatgcaaggatcgattcagtgtcaggaacccttatcatgacgaccaatcacgtcaatgtgcatgagcagattatcgagagcttgaagggccttaacatgcggacctacatgctagcaaagaacatcgtggagccagctcaagcaacacagcaggcaactcggtgaagcttgcagagtctacagttttgaggtgccaaggattagttacattagaggaagagctgtaaacttttggagctctgttgttggtcagtgactgtcatcagtatttgaacacctgagtggtggtttgcagtttgctacagcttatgcttacattttcagtattttgtactcggaatttcataacaagtgatccttctttatgtactactatagtgaatgatgcaaccggatgtatgtgtttggcgtttaggtgtttcatacggtttgagagtccggctg

SEQ ID NO: 854 - DNA, 1647 bp, Saccharum officinarum
ctacccttccttcctccccgcgccgccgcccccctcgaacccgaaaggaaccctaaccctagccgcctccgggagaggcagctaggagagagctcgaagcaccggccatggcggagcacgacctcacggcgctgatggcggcgcagctggaccggcacctggtgttcccgctgctggagttcctccaggagcggcagctctactcggaggccgagatcctggaggccaagatccgcctcctcagcggcaccaacatggtcgactacgccatggacatccacaagtccctccacggcaccgacgacgtccccgaggacatggtcaagcgccgcgccgaggtcgtctccaggctcaggtcgctcgaggaggccgccgccccgctcgtcgccttcctccagaacccgcagctcgtgcaggagctcaggcccgacaaacagtacaacatccacatgctccaggagcgataccagattggtcctgaggagattgaagctctgtatcagtatgccaaatttcagttcgagtgtggtaactactcaggggctgctgattacctgtaccagtatcgtgctttgtgcacaaacagtgagcgaagtgtgagtgccctctggggaaagctggcagcagaaatcctaatgcagaactgggacgtggctttggaggaactcaaccgcttgaaggaaataattgattcaaagaacttctcatcacctctgaatcagctccaaaaccggatatggctgatgcattgggctctgttcatcttctttaaccatgaaaatggtagaaatgggatcatcgatctgttcttccaggacaggtacttgaatgctatacagacaaatgcacaccatcttctgagatacctagctactgcagttgttgtgaacaaaaggagaaggaatatgcttaaagagttgattaaggtcattcagcaggagcagcatagctacaaggatcccataactgaatttctggaatgcttatatgtcaactatgattttgatggtgctcaacagaaactcatggagtgtgagcaggttatactgaatgatcctttcctgggcaagcgcatcgaagagggaaattttgtcactgttcctttgagagatgagttccttgaaaatgcacgtctgtttatttttgagacatactgccgtatccatcggtgcattgatatcagcatgctttctcagaagctgaacatgagctacgatgaggcagagttgtggatcatgaacttggttaggagctcaaaactggatgccaggatcgattcagtgtcaggaactcttatcatgaccaccaatcatgtcaatgtccatgagcagattatcgagaacttgaagggcctcaacatgcggacctacatgctcgcaaagaacatcgtggagccagctcaagcagcacagcaggcaactcggtgaggttagcagagtccacagttttgaggcgccaagaactagtttagaggcagagctgtaaacttttggagctctattgtgtcatcaggatttgaacacctgggagggtgtggcttgccgtttgatacagcttattatgctgacattttcaatattttgtactcggaatttcgtaacagttgatacttctcaatgtattactattactgtaacgaatgatgcc

SEQ ID NO: 855 - DNA, 1661 bp, Setaria italica
ccccgcgccgccagcccgccaccccctcgaaaccctaaccctagccgcccccgggaggctgggaggagagctcgcggcaccagccatggcggagcacgacctcaccgcgctgctggcggcgcagatggaccgccacctggtgttcccgctcctggagttcctgcaggagcggcagttctatcggagccggagatcctggaggccaagatccgcctcctcagcggcaccaacatggtcgactacgccatggacatccacaagtccctccacggcaccgacgacgtccccgaggacatggtcaggcgccgcaccgaggtcgtctccaggctcaggtcgctcgaggaggccgccgccccgctcgtcaccttccttcagaacccgcagctcgtgcaggagctcaggcccgacaagcagtacaacatccacatgctccaggaccggtaccagattggtcctgatcagattgaggctttgtatcagtatgctaaatttcagtttgagtgtggtaactactcgggggctgctgactacctgtaccagtatcgtgctctgtgcaccaacagtgagaggagtgtgagtgccctttggggaaagcttgcagcagaaattctgatgcagaactgggatgtagctttggaagaactcaaccgcttgaaggaaataattgattcgaagaacttctcatcacctcttaatcagctccagaacaggatatggctgatgcattgggctcttttcatcttcttcaaccatgagaatggtagaaatgggatcattgatctgttcttccaggacaggtacttgaatgctattcagaccaatgcacaccatctcctgagatacctagctactgcagttgttgtgaacaaaaggagaaggaatatgcttaaagagctgattaaagtcattcagcaggagcagcatagctacaaggatcccataactgaatttctggaatgcttatatgtcaactatgattttgatggtgctcagctgaaactcatggagtgcgagcaggttatattgaatgatcctttcctgggaaagcgcattgaagaaggaaatttcgtcactgtccctttgagagatgagttccttgaaaatgctcgtctgtttattttcgagacttactgccgtattcatcggtgcattgatatcagcatgctttcgcagaagctgaacatgagctacgatgaggcagagttgtggataatgaacttggttaggagctcaaaactggatgcaaggatcgattcagtgtcaggaacccttatcatgacgaccaatcacgtcaatgtgcatgagcagattatcgagagcttgaagggccttaacatgcggacctacatgctagcaaagaacatcgtggagccagctcaagcaacacagcaggcaactcggtgaagcttgcagagtctacagttttgaggtgccaaggattagttacattagaggaagagctgtaaactgttggagctctgttgttggtcagtgactgtcatcagtatttgaacacctgggaggtggtttgcagtttgctacagcttatgcttacattttcagtattttgtactcggaatttcataacaagtgatccttctttatgtactactatagtgaatgatgcaaccggatgtatgtgtttggcgtctaggtgtttc

SEQ ID NO: 856 - DNA, 1778 bp, Zea mays
ttgccctcctctctttcttcctccccgctccccaccccctcaaacccgaaaggaaccctaatcctagccgcacgcgggaggcagctaagagagcttgaagcaccagccatggcggaccacgacctcacggcgctgatggcggcgcagctggaccggcacctggtcttcccgctgctggagttcctccaggagcggcagctctactcgaggccggagatcctggaggccaagatccgcctcctcagcggcaccaacatggtcgactacgccatggacatccacaagtccctccacggcaccgatgacgttcccgaggacatggtcaagcgccgctccgaggtcgtctccaggctcaggtcgctcgacgaggccgcagccccgctcgtcgccttcctccagaacccgcagctcgtgcaggagctcaggcccgacaaacagtacaacatccacatgctccaggagagataccagattggtcctgaccagattgaagctctgtatcagtatgccaaatttcagtttgagtgtggtaactactcctgggctgctgagtacctgtaccagtatcgtgctttgtgcacagatactgagcgaagtgtgagtgccctctggggaaagctagcagcagaaatcctaatgcagaactgggatgtggctttggaggaattcaaccgcttgaaggaaataattgattcaaagaacttctcatcacctctgaatcagctccagaacaggatatggctgatgcattgggctctgttcatcttctttaaccatgaaaatggtagaaatgggatcattgatctgttcttccaggacaggtacttgaatgctatacagacaaatgctcaccatcttctgagatacctagctactgcagttgttgttaacaaaaggagaaggaatatgcttaaagagttgattaaggtcattcagcaggagcagcatagctacaaggatcccataactgagtttctgcaatgcttatatgtcaactatgattttgatggtgctcaacagaaactcgtggagtgtgagcaggttatactgaatgatcctttcctgggcaagcgcgttgaagagggaaattttgtcactgttcctttgagagctgagttccttgaaaatgcccgactgtttattttcgagacatactgccgtatccatcggtgcattgatatcagcatgcttgctcagaggctgaacatgagctacgatgaggccgagttgtggataatgaacttggttaggagctcaaaactggatgcaaggatcgattcagtgtcaggaactcttatcatgacaaccaatcacatcaatgtgcatgagcagattatcgagagcatgaagggccttaacatgcggacgtacatgctcgcaaagaacatcgtggagccagctcagcaggcagctcggtaaggttagcggagtacagttttgaggcgccaagaactagtttagaggtagaggtctattgtgtggcagtgaattcgtcaccgggattgaacacatgggactgggaggtggcttgccgtttggtacagcttagtatgctgacattttcaatattttgtactcggaatttcgtaacagtttatccttctcaatgtatattactattaatgcctgtttggatcacattaattgaaacaaatatctagaaattgtttctcattttattattaggttacttttcaactcctgagaaccaatcagggcattaatgtaatgaatgatgatgctacaggatccttctcttctaggcattgtgttttctc

SEQ ID NO: 857 - DNA, 1837 bp, Oryza sativa
aagcccacctcattccattccattcctctctaccttctccctctccctcctcctcctcctcctcccgccgccgccgcacgcggaaccctagaaaaccctagcagcggcgagcaccggggagcgggcggccatggcggagcacgacctgacggcgcggatggcggggcagatggactgccacctggtgttcccgctgctggagttcctgcaggagcgtgcgctgtacgcgaacaaggagatcctggaggcgaagctccgcctcctcagcgggaccaacatggtggactacgccatggacatccacaagtccctccacgacaccgacgaggtccccgacgacatggtcaggcgccgcaccgacgtcgtctccaggctcagggcgctcgacgaggccaccgcccccatcgtctccttcctccagaaccagcagctcgtccaggagctcaggccagacaagcagtacaacctccacatgctccaggaccgcttccagattggtcctgagcagattgagactctgtatcagtatgccaagtttcagtttgactgcggtaattactcagatgctgctgtctacttgtatcaataccgtgctttgtgcacgaacagcgagaggagcttgagtgccctgtggggaaagctggcagccgagattttgatgcagaactgggatgttgcactggatgagctcaaccgtttgaaggagattattgattcaaagaacttctcatcaccactaaatcagctccagaataggatatggctgatgcattggagtatttttatcttctttaaccatgaaaacggcagaaatgggatcatcgatctgttcttccaggataggtacttgaacgcaatccagacaaatgcaccccatcttctgagataccttgctacagcagttgtcgtgaacaaaaggagaaggaacatgcttaaagagttgattaaagtcattcagcaggagcagcacagctacaaggatcccatcactgaattcttggaatgcttgtatgttaactatgattttgatggtgcacaacagaaactcatagagtgtgagcaggtcatattgaatgatcctttccttggaaagcgcattgaggaagggaattttgtcactgttcctttgagagatgaattccttgaaaatgctcgtctgtttatctttgaaacttactgccgtattcatcggtgcattgatattggcatgctttctcagaagctgaacatgagctacgatgaggcagaattgtggattatgaacttagttaggaattcaaagctcgacgccaagattgattcagtgtctggaactcttatcatgacgaccaatcatgttaacatccatgagcaggttatcgaaagcttaaagaatcttaacatgcggactttcctgctagcaaagaacattgtggagccggctcaagcagcacaacaggcagctcggtgagattgacagagaagaccacagttttgaggcgcccggaattatttaagtagagacaatcctctaaacttttggagttttgttgtttagcattgactccgttatcagtacctaagatcatctaggaggtggtttctcgttcgctacagcatatgccgacgttttctttctattttgtacttggaatcctgtggctgaagttaatcctttcgttggtactacaatcaagtattacctgattgttatggtgtttcgtgttgaagtgaagtgcggaagtgtggtcatttttataattgtaggttcaatgtttttcttggttctgctaaatttgtggcgccacattttaccttgatttcagtcaattatttgaccacacgattgacgctgaga

SEQ ID NO: 858 - DNA, 1948 bp, Oryza sativa
gaagagtgctctcaccatagtgatagacgacgacgacgacgacgactcaatccccaattcacaaaaaggcccacgaacccaacagcccaagcccacctcattccattccattcctctctaccttctccctctccctcctcctcctcctcctcccgccgccgccgcacgcggaaccctagaaaaccctagcagcggcgagcaccggggagcgggcggccatggcggagcacgacctgacggcgcggatggcggggcagatggactgccacctggtgttcccgctgctggagttcctgcaggagcgtgcgctgtacgcgaacaaggagatcctggaggcgaagctccgcctcctcagcgggaccaacatggtggactacgccatggacatccacaagtccctccacgacaccgacgaggtccccgacgacatggtcaggcgccgcaccgacgtcgtctccaggctcagggcgctcgacgaggccaccgcccccatcgtctccttcctccagaaccagcagctcgtccaggagctcaggccagacaagcagtacaacctccacatgctccaggaccgcttccagattggtcctgagcagattgagactctgtatcagtttgccaagtttcagtttgactgcggtaattactcagatgctgctgtctacttgtatcaataccgtgctttgtgcacgaacagcgagaggagcttgagtgccctgtggggaaagctggcagccgagattttgatgcagaactgggatgttgcactggatgagctcaaccgtttgaaggagattattgattcaaagaacttctcatcaccactaaatcagctccagaataggatatggctgatgcattggagtatttttatcttctttaaccatgaaaacggcagaaatgggatcatcgatctgttcttccaggataggtacttgaacgcaatccagacaaatgcaccccatcttctgagataccttgctacagcagttgtcgtgaacaaaaggagaaggaacatgcttaaagagttgattaaagtcattcagcaggagcagcacagctacaaggatcccatcactgaattcttggaatgcttgtatgttaactatgattttgatggtgcacaacagaaactcatagagtgtgagcaggtcatattgaatgatcctttccttggaaagcgcattgaggaagggaattttgtcactgttcctttgagagatgaattccttgaaaatgctcgtctgtttatctttgaaacttactgccgtattcatcggtgcattgatattggcatgctttctcagaagctgaacatgagctacgatgaggcagaattgtggattatgaacttagttaggaattcaaagctcgacgccaagattgattcagtgtctggaactcttatcatgacgaccaatcatgttaacatccatgagcaggttatcgaaagcttaaagaatcttaacatgcggactttcctgctagcaaagaacattgtggagccggctcaagcagcacaacaggcagctcggtgagattgacagagaagaccacagttttgaggcgcccggaattatttaagtagagacaatcctctaaacttttggagttttgttgtttagcattgactccgttatcagtacctaagatcatctaggaggtggtttctcgttcgctacagcatatgccgacgttttctttctattttgtacttggaatcctgtggctgaagttaatcctttcgttggtactacaatcaagtattacctgattgttatggtgtttcgtgttgaagtgaagtgcggaagtgtggtcatttttataattgtaggttcaatgtttttcttggttctgctaaatttgtggcgccacattttaccttgatttcagtcaattatttgaccacacgattgacgctgagatttgtgctgctgtacgtaaccac

SEQ ID NO: 859 - DNA, 1689 bp, Zea mays
gtcggatccaaacggagcctacataacccttcccttcctcgcttccctcctccccgcgccgccataccctcgaacccgagaggaaccctaacaccaaaacgcccccggaggcagctaggagagctcgaatcaccagccatgtcggagcacgacctcacggcgctgatggcggcgcagctggaccgccacctggtgttccccctgctggagttcctccaggagcggcagctctactcggagtcggagatcctggaggccaagatccgcctcctcagcggcaccaacatggtcgactacgccatggacatccacaagtccctctacggcaccgacgacgtgcccgaggacatggtgaagcgccgcgccgaggtcgtctccaggctcaggtcgctcgaggaggccgcagccccgctcgtcgccttcctccagaacccgcagctcgtgcaggagttcaggcccgacaaacagtacaacatccacatgctccaggagcgataccagatcggtcctgaccagattgaagctctgtatcagtatgccaaatttcagtttgagtgtggtaactactcaggggctgctgattacctttaccagtatcgtgctttgtgcacaaacagtgagcgaaatgtgagtgccctctggggaaagctggcagcagaaatcctaatgcagaactgggacgtagctttggaggaactcaaccgcttgaaggaaataattgattcaaagaacttctcatcacctctgaatcagctccagaacaggatatggctgatgcattgggctctgttcatcttctttaaccatgaaaatggtagaaatgggatcattgatctgttcttccaggacaggtacttgaatgctatacagacaaatgcacaccatcttattaggtatctagctactgcagttgttgtcaacaaaaggagaaggaatatgcttaaagagttgattaaggtcattcaacaggagcaccatagctacaaggatcccgtaactgaatttctggaatgcttatatgttaactatgattttgatggtgctcaacagaaactcatagagtgtgagcaggttatactgaatgatccattcctgggaaagcgcattgaagagggaaattttgtcagtgttcctttgagagatgagttccttgaaaatgctaggctttttattttcgagacatactgccgtatccatcggtgcatcgatatcagcatgcttgctcagaagttgaacatgagctacgatgaggccgagttgtggatcatgaatttggttagaagctcaaaactggatgccaggatcgattcagtatcaggaactctcatcatgacaaccaatcacgtcaatgtccatgagcagattgttgagagcttgaagggccttaatatgaggacctacatgctcgcaaagaacatcgttgagccagctcagcaggcaactcggtgaggatagcagacttcacagttttgagacgccaaggactagtttagagacaactgtaaacttttcgagctctattgtgtggcattggatttcaacacctggaaggtggcttgccgtttgatacagcttggagtattatgctgacattttcaatattttgtaatcggaacttcgtaacagtggatccttctcaatgtattgctattattttatgctgacattttcaacatctttctctattag

SEQ ID NO: 860 - DNA, 766 bp, Triticum aestivum
ccacgcgtccggtgaaaagaaagaagaaacaacacaacaagccaccacgtacgtaagctttatcaccttcaaaaatgtcgggttggttcggggggaagacggacgccaaggacgaggaggccgccaagacggggccgtccgtccaggaccgcgccatcgaggcgaaggaccagaccatcagcttcatcggcgagaaaagcgaggccgtcaccaaggcggcctcggacaccgccgacgcggccatgaagatgggcggcgacgccatggggaaggcctccgagacggggcaggccatcacggaccgcgccatcgagagcaaggaccagacgttcggcttcttcggagagaagacggaggctgccaagaagatggccgtcgacaccggcgacgctgccaagcagaagtccgccgaggccgcaaagtgtgtcgaggagaccgcggcgaagttcaccggggaacccgccgcccccaaggagcccaccggcaacatgttccagcaggccggcgggcaggtgatgggtgccgctactggcgccagggacgccgtcatgaacacgctcgggatgggaggagacaaagccgacaccggcaccgccaaatgaagaccgcaaagcgcaaaggacggctagcccacttttcgtttcgttattccctccgtgttgctttattttccgttccaagaaactgatttctacgcatgcgtcggtgtaacttcgtccggtgtattcaaagatgctttgaatatacagatttgctaattctcatc

SEQ ID NO: 861 - DNA, 720 bp, Triticum aestivum
cccacgcgtccggtgaaaagaaagaagaaacaacaccacaagccaccacgtacgtaagctttatcaccttcaaaaatgtcgggttggttcgggggtaagacggacgccaaggccgacgaggccgccaagacggggccgtccgtccaggaccgcgccatcgaggcgaaggaccagaccatcagcttcatcggcgagaaaagcgaggccgtcaccaaggcggcgtcagacaccgccgacgcggccatgaagatggggagcgacgccatggggaaggcgtcagagacggggcaggccatcacggaccgcgccatcgagagcaaggaccagacgttcggcttcttcggtgagaagaccgaggccgccaagaagatggccgccgacaccggcgacgccgccaagcagaagtccgccgaggccgcaaagtgcgtcgaggagaacgcggcgaagttcaccggggaacccgccgcccccaaggagcccaccggcaacatgttccagcaggccggcgggcaggtgatgggtgccgctacgggcgccagggacgccgttatgaacacgctcgggatgggaggagacaaagccgacgtcggcagcgccaaatgaagacccaaagcgcaaaggagggctagcccacttttcgtttcgttattccctccgtattccttttatttcggttccagaaactgatctctacccatgcgtcggtgtaacttcctccgg

SEQ ID NO: 862 - DNA, 776 bp, Triticum aestivum
ccacgcgtccggtgaaaagaaagaagaaacaacaccacaagccaccacgtacgtaagctttatcaccttcaaaaatgtcgggttggttcgggggtaagacggacgccaaggccgacgaggccgccaagacggggccgtccgtccaggaccgcgccatcgaggcgaaggaccagaccatcagcttcatcggcgagaaaagcgaggccgtcaccaaggcggcgtcagacaccgccgacgcggccatgaagatggggagcgacgccatggggaaggcgtcagagacggggcaggccatcacggaccgcgccatcgagagcaaggaccagacgttcggcttcttcggtgagaagaccgaggccgccaagaagatggccgccgacaccggcgacgccgccaagcagaagtccgccgaggccgcaaagtgcgtcgaggagaacgcggcgaagttcaccggggaacccgccgcccccaaggagcccaccggcaacatgttccagcaggccggcgggcaggtgatgggtgccgctacgggcgccagggacgccgttatgaacacgctcgggatgggaggagacaaagccgacgtcggcagcgccaaatgaagaccgcaaagcgcaaaggagggctagcccacttttcgtttcgttattccctccgtattcctttatttccgttccaagaaactgatctctacgcatgcgtcggtgtaacttcgtccggtgtatgcaaagatgctttgaatctacagacttgctaattctcatcaaaaaaaaaaa

SEQ ID NO: 863 - DNA, 766 bp, Triticum aestivum
cccacgcgtccggtgaaaagaaagaagaaacaacacaacaagccaccacgtacgtaagctttatcaccttcaaaaatgtcgggttggttcggggggaagacggacgccaaggacgaggaggccgccaagacggggccgtccgtccaggaccgcgccatcgaggcgaaggaccagaccatcagcttcatcggcgagaaaagcgaggccgtcaccaaggcggcctcggacaccgccgacgcggccatgaagatgggcggcgacgccatggggaaggcctccgagacggggcaggccatcacggaccgcgccatcgagagcaaggaccagacgttcggcttcttcggagagaagacggaggctgccaagaagatggccgtcgacaccggcgacgctgccaagcagaagtccgccgaggccgcaaagtgtgtcgaggagaccgcggcgaagttcaccggggaacccgccgcccccaaggagcccaccggcaacatgttccagcaggccggcgggcaggtgatgggtgccgctactggcgccagggacgccgtcatgaacacgctcgggatgggaggagacaaagccgacaccggcaccgccaaatgaagaccgcaaagcgcaaaggacggctagcccacttttcgtttcgttattccctccgtgttgctttatttccgttccaagaaactgatttctacgcatgcgtcggtgtaacttcgtccggggtattccaagatgctttgaatatacagatttgctaattctcatc

SEQ ID NO: 864 - DNA, 753 bp, Triticum aestivum
aaagaagaaacaacacaacaaaccaccacgtacgtactacgctttatcaccttcaaaaatgtcgggttggttcggggggaagacggacgccaaggccgacgaggccgccaagacggggccgtccgtccaggaccgcgccatcgaggccaaagaccagaccatcagcttcatcggcgagaaaagcgaggccgtcaccaaggcggcctctgacaccgccgaggcggccatgaagatgggcggcgacgccatggggaaggcctccgagacggggcaggccatcacggaccgcgccatcgagagcaaggaccagacgttcggcttcttcggcgagaagaccgaggccgccaagaagatggccgccgacaccggcgacgccgccaagcagaagtccgccgaggccgcgaaatgcgtcgaggagaccgcggcgaagttcaccggggaacccgtcgcccccaaggagcccaccggcaacatgttccagcaggccggcgggcaggtgatgggtgccgctacgggcgccaaggacgccgtcatgaacacgctcgggatgggaggagacaaagccgacgccggcaccgccaaatgaagaccgcgaaggatcatagccctcttttcgtttcgttattccctccgtgttgctttattttcggttccaagaaactgatttctacgcatgcgtcggtgtaacttcgtccagtgtatgcaaagatgctttgaatatacagatttgctaattctcatcaaaaaaaaaaa

SEQ ID NO: 865 - DNA, 767 bp, Triticum aestivum
cccacgcgtccggtgaaaagaaagaagaaacaacaccacaagccaccacgtacgtaagctttatcaccttcaaaaatgtcgggttggttcgggggtaagacggacgccaaggccgacgaggccgccaagacggggccgtccgtccaggaccgcgccatcgaggcgaaggaccagaccatcagcttcatcggcgagaaaagcgaggccgtcaccaaggcggcgtcagacaccgccgacgcggccatgaagatggggagcgacgccatggggaaggcgtcagagacggggcaggccatcacggaccgcgccatcgagagcaaggaccagacgttcggcttcttcggtgagaagaccgaggccgccaagaagatggccgccgacaccggcgacgccgccaagcagaagtccgccgaggccgcaaagtgcgtcgaggagaacgcggcgaagttcaccggggaacccgccgcccccaaggagcccaccggcaacatgttccagcaggccggcgggcaggtgatgggtgccgctacgggcgccagggacgccgtcatgaacacgctcgggatgggaggagacaaagccgacaccggcaccgccaaatgaagaccgcaaagcgcaaaggacggctagcccacttttcgtttcgttattccctccgtgttgctttattttccgttccaagaaactgatttctacgcatgcgtcggtgtaacttcgtccggtgtattcaaagatgctttgaatctacagacttgctaattctcatc

SEQ ID NO: 866 - DNA, 733 bp, Secale cereale
ccacgtacgtaagctttatcaccttcaaaaatgtcgggttggttcgggggcaagacggacgccaaggccgaggaggccgccaagacggggccgtccgtccaggaccgcgccatcgaggccaaggaccagaccatcagcttcatcggcgagaaaagcgaggccgtcaccaaggcggcctcggacaccgccgacgcggccatgaagatgggcggcgacgccatggggaaggtgtccgaaacggggcaggccatcacggaccgcgccatcgagagcaaggaccagacgttcggcttcttcggcgagaagaccgaggccgccaagaagatggccgtcgacaccggggacgccgccaagcagaagtcggccgaggtggcgaagtgcgtcgaggagaacgcggcgaagttcaacggggaacccgccgcccccaaggagcccaccggcaacatgttccagcaggccggcgggcaggtgatgggtgccgctacgggcgccaaggacgccgtgatgaacacgctcgggatgggaggaggcaaagccgacgccggcaccgccaaatgaagaccgcaaaaaggagggctagcccacttttcgtttcgttattccatccgtattgctttatttccgttccaagaaactgattcctacgcatgcgttggtgtaacttcgtccggtgtatgcaaagatgctatgaatgatttgctaattcttatttgatgaatatattctttacata

SEQ ID NO: 867 - DNA, 755 bp, Secale cereale
aacaagccaccacgtacgtaagctttatcaccttcaaaaatgtcgggttggttcgggggcaagacggacgccaaggccgaggaggccgccaagacggggccgtccgtccaggaccgcgccatcgaggccaaggaccagaccatcagcttcatcggcgagaaaagcgaggccgtcaccaaggcggcctcggacaccgccgacgcggccacgaagatgggcggcgacgccatggggaaggcgtccgaaacggggcaggccatcacggaccgcgccaccgagagcaaggaccaaacgttcggcttcttcggcgagaagaccgaggccgccaagaagatggccgtcgacaccggcgacgccgccaagcagaagtccgccgaggccgcgaagtgcgtcgaggagaacgcggcgaagttcaccggggaacccgccgcccccaaggagcccaccggcaacatgttccagcaggccggcgggcaggtgatgggtgccgctacgggcgccaaggacgccgtgatgaacacgctcgggatgggaggaggcaaagccgacgccggcaccgccaaatgaagaccgcaaaggagggctagcccacttttcgtttcgttattccctccgtattgctttatttccgttccaagaaactgattcctacgcatgcgtcggtgtaacttcgtccggtgtatgcaaagatgctttgaatgatttgctaattctcatttgatgaatatattctttacatatcagatttttttttt

SEQ ID NO: 868 - DNA, 812 bp, Leymus cinereus x Leymus triticoides
  misc_feature (4)..(4): n is a, c, g, or t
  misc_feature (8)..(9): n is a, c, g, or t
  misc_feature (18)..(18): n is a, c, g, or t
  misc_feature (137)..(137): n is a, c, g, or t
  misc_feature (262)..(262): n is a, c, g, or t
  misc_feature (366)..(366): n is a, c, g, or t
  misc_feature (677)..(677): n is a, c, g, or t
ccgncctnntcggataangagaaagaacacaagccaccacgtacgtacgctcgctccatcaacttcagaaatgtctggctggttcggggggcagacggacgccaaggccgacgaggccgcgaagacggggccgtccntccaggaccgcgccgtcgaggcgaaagaccagaccatcagcttcatcggcgagaaaagcgaggccgtcacgaaggcggcctcggacactgccgaggcggccatgaagatggggggcgacgccatngggaaggcgtccgagacggggcaggccatcacggaccgcgccatcgagagcaaagaccagacgttcggcttcctcggcgagaagaccgaggctgccaagaaganggccgtcgacaccggcgacgccgccaagcagaagtccgccgaggccgcaaagtgtgtcgaggagaccgcggcacagttcaccaaggaaccggccgcccccaaggagcccaccggcaacatgttccagcaggccggcgggcaggtgatgggcgccgctacgggcgccagggacgccgtcatgaacacgctcggtatggggggagacaaaggcgacgccggcagcgccaaatgaagaccgcaaaggataactagacgcgtccgcaggcccctgctcgctctagcccacttttcgtttcgttattccctccgtnttgctttattttccgttccaaggaactgatttctacgcatgcgtcggtgtaacttcgtccgatgtatgcaacgaagcaatgaatataccgatttgctaattctcatctacatgaatatattcttcacaagactca

SEQ ID NO: 869 - DNA, 728 bp, Secale cereale
cacaacaagccaccacgtacgtaagctttatcaccttcaaaaatgtcgggttggttcgggggcaagacggacgccaaggccgaggaggccgccaagacggggccgtccgtccaggaccgcgccatcgaggccaaggaccagaccatcagcttcatcggcgagaaaagcgaggccgtcaccaaggcggcctcggacaccgccgacgcggccacgaagatgggcggcgacgccatggggaaggcgtccgaaacggggcaggccatcacggaccgcgccatcgagagcaaggaccagacgttcggcttcttcggcgagaagaccgaggccgccaagaagatggccgtcgacaccggggacgccgccaagcagaagtcggccgaggtcgcgaagtgcgtcgaggagaacgcggcgaagttcaacggggaacccgccgcccccaaggagcccaccggcaacatgttccagcaggccggcgggcaggtgatgggcgccgctacgggcgccaaggacgccgtgatgaacacgctcgggatgggaggaggcaaagccgacgccgacaccgccaaatgaagaccgcaaaggagggctagcccacttttcgtttcgttattccctctgtattgctttatttccgttccaagaaactgatttctacgcatgcgtcggtgtaacttcgtccggtgtatgcaaagatgctttgaatgatttgctaattctcatttgatgaa

SEQ ID NO: 870 - DNA, 405 bp, Hordeum vulgare
ttcatctccgaagctccaaccgaaccgaggatgtcttgctgcggaggaaactgcggctgcggcagcgcctgcaagtgcggcaacggctgcggcggctgcaacatgtacccggaggttgaggccgccggcgccaccctcctcgtcgccgccgccgccacccacaaggcgagctccggcgggatggagatggcggcggagaacggcggctgcggctgcacccagtgcaagtgcggcaccagctgcggctgctcctgctgcagctgctagatcgatcgtcgatcatgcatgcaccgtgcatgcatcatcgtatcgtatcgatctactactatcataccatgtaaccgcaacctgatcgagggcctttatgtacgcacctgacctgcatcagagcaggtgccatgccat

SEQ ID NO: 871 - DNA, 445 bp, Avena sativa
agcacacaagaagctcatagccattcaaagcctcttcatctccgaagctccaaccgaaccgaggatgtcttgctgcggaggaaactgcggctgcgggagcgcctgcaagtgcggcaacggctgcggcggctgcaacatgtacccggaggtcgaggccgccggcgccaccctccttgtctctgccaccgccacccacaaggcaagctccggcgggatggagatggcggccgagaatggcggctgcggctgcacccagtgcaagtgcggcaccagctgcggctgctcctgctgcagctgctagatcgatcgtggatcatgcatgcaccatgcatgctgcatcgtggtatcgatctactactaccataccatgtaaccgcaacctgatcgagggcctttatctttgcacctgagctgcatcagcagtcaggtgccatgccatgcttgt

SEQ ID NO: 872 - DNA, 696 bp, Triticum aestivum
gaattcggcacgaggcaagaagcacacaggaagctcctagccaacaccaatcaaagcctccatccaatcccaagcaacctcgaggatgtcttgctgcggaggaaactgcggctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgtaacgccacctgatcgagggtctttgtatgtatgtaagcacctgccagcatgagcagagcaggtgcactgccatgcatgtaaaccgacccctaaataaaatctcccgtggtttaacctatacttgtgtttgtactatcaacttgcgaggtgcctgggttgttactagaccagccgaatgctctcttgaagcaacgtgtgcaccgcttggaatcggtgtatctttatacacctgtgtatttattttacaggtgtatatttttcttagaagaaaaaggctgcgcccctgttccatttcaaaaaaaaaa

SEQ ID NO: 873 - DNA, 504 bp, Hordeum vulgare
aagccagcaagcaggaagcacacaggaagctcctagccaataccaatcaaagcctctaaccccaatcccaagcaacctcgaagatgtcttgctgcggaggaaactgcggctgcggcagcgcctgcaagtgcggcaacggctgcggcggctgcaacatgtacccggaggttgaggccgctggcgccaccctcctcgtcgccgccgccgccacccacaaggcgagctccggcgggatggagatgacggcggagaacggcggctgcggctgcacccagtgcaagtgcggcaccagctgcggctgctcctgctgcagctgctagatcgatcgtcgatcatgcatgcaccgtgcatgcatcatcgtatcgtatcgatctactactatcataccatgtaaccgcaacctgatcgagggcctttatgtacgcacctgacctgcatcagagcaggtgccatgccatccttgtaaaacgccctcctaaataaaatctccctggtttaactata

SEQ ID NO: 874 - DNA, 490 bp, Setaria italica
cagcaagcaagaagcacacaggaagctcctagccaacaccaatcaaagcctccatccaatcccaagcaacctcgaggatgtcttgctgcggaggaaactgcggctgcggcagcgcctgcaagtgcggcaacggctgcggcggctgcaacatgtacccggaggccgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcggtcatgcatgcaccgcgtgcatcatatctatgatctatctacaatctacttaccatgtaacgccacctgatcgagggtctttgtatgtatgtaagcacctgccagcatgagcagagcaggtgcactgccatgcatgtaaaccgacccctaaatagatcggaagag

SEQ ID NO: 875 - DNA, 411 bp, Triticum aestivum
gtcttgctgcggaggaagctgcggctgcggcagcgcctgcaagtgcggcaacggctgcggcggctgcaacatgtaccctgaggtcgaggccgccggcgccaccctcctcgtcgccgccaccgccacccacaaggcgagctccggcaggatggagatggcagcggagaacggcggctgcggctgcacccagtgcaagtgcggcaccagctgcggctgctcctgctgcagctgctagatcatcggtcatgcatgcaccgcgtgcctcatatctatgatctatctatatatccatctaccaccatgtaacgctacctgatcacggtctttgtatgtatgtacgcacctgcctgcatgagcagagcaggtgccatgccatgcatgtaaacccctaaataaaatctctcgtggttt

SEQ ID NO: 876 - DNA, 386 bp, Triticum aestivum
gcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccaatgcaagtgcggcaccagctgcggctgctcctgctgcagctgctagattcatcatcgatcatgcatgcaccgtgccgtgcgtgcatcatcgatcgtatcgatctactactaccatacatgtaaccgcaac

SEQ ID NO: 877 - DNA, 427 bp, Triticum aestivum
tcgacgatgtcttgctgcggaggaaactgcggctgcggtagcgcctgcaagtgcggcaacggctgcggcggctgcaacatgtacccggaggccgaggccgccggcgccaccctcctcgtctccgctaccgccacccacaaggcgagctccggcggcatggagatggcggcggagaacggcggctgcggctgcacccagtgcaagtgcggcaccagctgcggctgctcctgctgcagttgctagatccatcatcggtcatgcatgcaccgcgtgcatcatatctttgatcgatccatccatctacttaccatgtaacgctacctgatcgagggtctttgtatgtatgtacgcacctgcctgcatgagcagagcaggtgccatgccatgcatgtaaacccctaaataaaatctcccgtggtttaaccta

SEQ ID NO: 878 - DNA, 516 bp, Triticum aestivum
aaaagccagcaagaagcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactataaaaaaaaa

SEQ ID NO: 879 - DNA, 643 bp, Secale cereale
aaccaaagcctccatccaatcccaagcaacctcgaagatgtcttgctgcggaggaagctgcggctgcggcagcgcctgcaagtgcggcaacggctgcggcggttgcaacatgtacccggaggtcgaggtcgccggcgccaccctcctcgtctccgccaccgccacccacaaggcgagctccggcgggatggagatggcggcggagaacggaggctgcggctgcacccagtgcaagtgcggcaccagctgcggctgctcctgctgcagctgctagatccatcttcgatcatgcatgcacctgccgcgcgcgtgcatcatatctatgatcgatcggtccatctactgccatgtaacgctgcctgatagagggttctttgtatgtatgtatgcaagcacctgcctgcatgagcagagctggtgtcatgccatgcatgtaaacccctaaataaaatctcctgtggtttaacctatacatgtgtttgtattatagaccagcttctggcccatgtttactagtatcaacttgcgaggtcttaattaataaaccagctgaatgctgtgtcttgaagcaacgcatgcaccaccgcttgcaatcggtgttatctttatacacctgtatttattttaacaaaaacaaactgag

SEQ ID NO: 880 - DNA, 430 bp, Secale cereale
accgagccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccttcctcgtctccgccaccgccacccacaaggcgagctccggcgggatggagatggcggcagagaacggcggctgcggctgcacccagtgcaagtgcggcaccagctgcggctgctcctgctgcagctgctagatccatcttcgatcatgcatgcacctgccgcgcgcgtgcatcatatatatgatcgatcggtccatctactgccatgtaacgctgcctgatagagggttctttgtatgtatgtatgcaagcacctgcctgcatgagcagagct

SEQ ID NO: 881 - DNA, 384 bp, Secale cereale
aaggaagctcatagccaatcaaagcctctccatctccgaagctccaacccaaccgaggatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccgggcggcgatggagatggcggccgagaacggcggctgcggctgcacccagtgcaagtgcggcaccagctgcggctgctcctgctgcagctgctagatcgatcatcgaccatgcatgcaccgtgccgtgcgtgcatcgtcgtatcgatctactactaccttaccatcgtaaccgcaacctgat

SEQ ID NO: 882 - DNA, 565 bp, Secale cereale
ctcctagccaacaccaaccaaagcctccatccaatcccaagcaacctcgaagatgtcttgctgcggaggaagctgcggctgcggcagcgcctgcaagtgcggcaacggctgcggcggttgcaacatgtacccggaggtcgaggtcgccggcgccaccctcctcgtctccgccaccgccacccacaaggcgagctccggcgggatggagatggcggcggagaacggaggctgcggctgcacccagtgcaagtgcggcaccagctgcggctgctcctgctgcagctgctagatccatcttcgatcatgcatgcacctgccgcgcgcgtgcatcatatatatgatcgatcggtccatctactgccatgtaacgctgcctgatagagggttctttgtatgtatgtaagcacctgcctgcatgagcacagcaggtgccatgccatgcatgtaaacccctaaataaaatctcccgtggtttaacctatacatgtgtttgtgttatagaccagcttctggcccatgtttactactccctccgtcccaaaattcttgtcttcgatttataact

SEQ ID NO: 883 - DNA, 483 bp, Secale cereale
atagaagaagctcctagccaacaccaaccaaagcctccatccaatcccaagcaacctcgaagatgtcttgctgcggaggaagctgcggctgcggcagctcctgcaagtgcggcaacggctgcggcggctgcaacatgtacccggaggttgaggcagccggcgccaccctcctcgtctccgccaccgctacccacaaggcgagctccggcgggatggagatggcggcggagaacggcggctgcggctgcacccagtgcaagtgcggcaccagttgcggctgctcctgctgcagctgctagatcgataatcgatcatgcatgcacctgccgcacgcgtgcatcatatctataattgatccatcgatctactaccatgtaaccctgcctgatcaggggtctttgtatgtatgtaagcgtctgcctgcatgagcagagcaggggccatgccatgcatgtaaacccctaaataaaatatccggtggtt

SEQ ID NO: 884 - DNA, 662 bp, Secale cereale
ccatccaatcccaagcaacctcgaagatgtcttgctgcggaggaagctgcggctgcggcagctcctgcaagtgcggcaacggctgcggcggctgcaacatgtacccggaggttgaggcagccggcgccaccctcctcgtctccgccaccgctacccacaaggcgagctccggcgggatggagatggcggcggagaacggcggctgcggctgcacccagtgcaagtgcggcaccagttgcggctgctcctgctgcagctgctagatcgataatcgatcatgcatgcacctgccgcacgcgtgcatcatatctataattgatccatcgatctactaccatgtaaccctgcctgatcaggggtctttgtatgtatgtaagcgtctgcctgcatgagcagagcaggggccatgccatgcacgtaaacccctaaataaaatatccggtggtttaacctatacatgtgtttttcgacatcaaagtacccaaccctataaatgtgtttgtgttatagaccagcttatggcccttgtttactatcaacttgcgactttttttagaaaaggaggagtgtccccggcctctccatctggacgatgcatgcatctactttattaattattcacacaagaccttacaaagtcatacaacagtaagactaaagcc

SEQ ID NO: 885 - DNA, 495 bp, Avena sativa
agcacacaagaagctcatagccaatcaaagcctctccatctccgaagctccaaccgaaccgaggatgtcttgctgcggaggaaactgcggctgcggcaacgcctgcaagtgcggcaacggctgcggtggctgcaacatgtacccggaggccgaggttgccggcgccaccctcctcgtcgccgccacagccacccacaaggcgagctccggtgggatggaaatggcggcggagaacggcgggtgcggctgcacccagtgcaagtgcggcaccagctgcggctgctcctgctgcagctgctagatggatcatatcgatcacgcatgcacccggcatcatatctatgatcgatctatccatctacgtaccatgcatgtaacgctacctgatcgagggtctttgtatgtatgtacgcacaggtacctgcctgcatgagcagagtaggtgtcatgccatgcatctaaacccctaaataaaatcttcaatggtttaactag

SEQ ID NO: 886 - DNA, 651 bp, Triticum aestivum
aagcacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaactataaaaaaaaagtagaagtggataagcatcacattattgtttcgttagaatatggcgctagctcttcacctacaccacttattcagttactctatggattttttgtttgttaaaatttgcctctactggacacagattatcaccataaaacagcttggtca

SEQ ID NO: 887 - DNA, 444 bp, Triticum aestivum
tcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctagtaccatgtaacgctacctgatcgagggtctttgtatgtatgtaagcacctgccagcatgagcagagcaggtgcactcccatgcatgtaaaccgacccctaaataaaatctcccgtggtttaacctatacatgtgtttg

SEQ ID NO: 888 - DNA, 423 bp, Triticum aestivum
tcgaatatgtcttgctgcggaggaaactgcggatgcggcaccgcctgcaagtgcggcaacggctgcggtggctgcaacatgtaccccgaggttgaggccgccggcgccaccctcctcgtctccgccactgccactcacaaggggagctccggcggcatggagatggcggccgagaacggcggctgcggctgcacccagtgcaagtgcggcaccagctgcggctgctcctgctgcagctgctagatcattgatcatgcatgcgccgcgtgcatcatatctatgatctacgtatccatctactaccatgtaatgccacctgatcgagggtctttgtatgtatgtagtatgtacgcacctgcctgcatgagcagagcgggtgccattccatgcatgtaaacccctaaataaaatctcccgtggttt

SEQ ID NO: 889 - DNA, 493 bp, Triticum aestivum
aagcacacaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccagctgcggctgctcctgctgcagctgctagatcgatcatcgaccatatgcatgcaccgtgccgtgcgtgcatcatcgatcatatcgatctactactaccataccatgtaaccgcaacctgatcgagggcctttatctatgcacctgacctgcatcagcagtcaggtgccatgccatgattgtaaacaggcccccctaaataaaatttcccctgattaacta

SEQ ID NO: 890 - DNA, 441 bp, Triticum aestivum
gctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccaatgcaagtgcggcaccagctgcggctgctcctgctgcagctgctagatcgatcatcgaccatatgcatgcaccgtgccgtgcgtgcatcatcgatcatatcgatctactactaccataccatgtaaccgcaacctgatccagggcctttatctatgcacctgacctgcatcaacagtcaagtgccatgccatgattgt

SEQ ID NO: 891 - DNA, 923 bp, Secale cereale
gtccatcaagcgcttcgccacatcctcagctcaataccagcagttgcctgaacctcttaatcaatgatgaattcatgggcacagttccattgactccacggaaagaactgggtagtgtttctccagacgctttgccatgtagttcgcgttcaggatagcaatctttgaagcttcagtgagtccctgagagcccatcatggctatgtaggtgtacgaaattggaagaatcatagccaatcaaagcctctccatctccgaagctccaacccaaccgaggatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatgcaccgtgccgtgcgtgcatcgtcgtatcgatctactactaccttaccatgtaaccgcaacctgatcgagggcctttatatacgcacctgacctgcatcagcagagcaggtgccatgccatgcttgttgtaaaccggccctctaaataaaatctcccctcattaactatacatgtgtctgtgctatgcatatatcatcaccttctttttcttcttcctcatggtacaaaaacactgcttaagagctgagagcgctgagaatattagaaatgattgtgagttttgcccaagaaaatgttgaagacgtacctgaacggaaaataacagtggatgcatcttaccatgcatgctgatgctggaaaataaaagagaaaggatgccgctttacca

SEQ ID NO: 892 - DNA, 609 bp, Secale cereale
ctactaacgtaccaactcaaacgtcctctaccctatccaccgtaacggaccgtccaacccaaccgaggatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcatgctgcagctgctagatcgatcatcgaccatgcatgcaccgtgccgtgcgtgcatcgtcgtatcgatctactactaccttaccatgtaaccgcaacctgatcgagggcctttatctatgcacctgacctgcatcagcagtcaggtgccatgccatgcttgttgtaaaccggccctctaaataaaatctccctggtttaaccacatgtgtctgtgctttatgcatatatcatcaccttctttttcttcttcttcttcatgccacaaaaacactgcttaagagttgagagcactgagaaaattataaattatcatgaagca

SEQ ID NO: 893 - DNA, 463 bp, Secale cereale
tcctagccaacaccaaccaaagcctccatccaatcccaagcaacctcgaagatgtcttgctgcggaggaagctgcggctgcggcagctcctgcaagtgcggcaacggctgcggcggctgcaacatgtacccggaggttgaggcagccggcgccaccctcctcgtctccgccaccgccacccacaaggcgagctccggcgggatggagatggcggtggagaacggcggctgcggctgcacccagtgcaagtgcggcaccagctgcggctgctcctgctgcagctgctagatcggtaatcgatcatgcatgcacctgccgcacgcgtccatcatatctataattgatccatcgatctactaccatgtaaccctgcctgatcaggggtctttgtatgtatgtaagcgtctgcctgcatgagcagagcaggggccatgccatgcatgtaaacccctaaataaaatat

SEQ ID NO: 894 - DNA, 460 bp, Secale cereale
ctctccatctccgaacgactccaacccaaccgaggatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatgcatgcaccgtgccgtgcgtgcatcgtcgtatcgatctactactaccttaccatgtaaccgcaacctgatcgagggcctttatctatgcacctgacctgcatcagcagtcaggtgccatgccatgattgttgtaaacaggcccctaaataaaatctccctggtttaac

SEQ ID NO: 895 - DNA, 421 bp, Secale cereale
gatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatgcaccgtgccgtgcgtgcatcgtcgtatcgatctactactaccttaccatgtaaccgcaacctgatcgaggcctttatctatgcacctgacctgcatcagcagtcaggtgccatgccatgcttgttgtaaaccggccctctaaataaaatctccctggtttaa

SEQ ID NO: 896 - DNA, 477 bp, Secale cereale
gactagccaatcaaagcctctccatctccgaagctccaacccaaccgaggatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatgcaccgtgccgtgcgtgcatcgtcgtatcgatctactactaccttaccatgtaaccgcaacctgatcgagggcctttatctatgcacctgacctgcatcagcagtcaggtgccatgccatgattgttgtaaacaggcccctaaataaaatctccctggtttaaccaaaaa

SEQ ID NO: 897 - DNA, 489 bp, Secale cereale
ggcacacaagaagctcatagccaatcaaagcctctccatctccgaagctccaacccaaccgaggatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatgcaccgtgccgtgcgtgcatcgtcgtatcgatctactactaccttaccatgtaaccgcaacctgatcgagggcctttatatacgcacctgacctgcatcagcagagcaggtgccatgccatgcttgttgtaaaccggccctctaaataaaatctcccctcattaacta

SEQ ID NO: 898 - DNA, 456 bp, Gossypium hirsutum
ttcggcaccagcaggaagctcctagccaataccaatcaaagcctctaaccccaatcccaagcaacctctaagatgtcttgctgcggaggaaactgtggctgcggcagcgcctgcaagtgcggcaacggctgcggcggctgcaacatgtacccagaggttgaggccactggcgccaccctcctcgttgacgccgccgtcacccacaaggcgagctccggcgggatggagatggcggcggagaacggcggctgcggctgcacccagtgcaagtgcggcaccagctgcggctgctcctgctgcagctgctaaatcgatcgtaaatcatgcatgcaccgtgcgtgcatgaaatctatgatcgacctatccatatactaccatgttacgctacacgatcaacggtctatgtatgtatgtaaacacctgctgcctgcatgaacagagcgggtgccatgccag

SEQ ID NO: 899 - DNA, 455 bp, Triticum aestivum
gtcttgctgcggaggaagctgcggctgcggcagcgcctgcaagtgcggcaacggctgcggcggctgcaacatgtacccggaggctgaggccgccggcgccaccctcctcgtctccgccaccgccacccacaaggcgagctccggcgggatggagatggcggcggagaacggcggctgcggctgcacccagtgcaagtgcggcaccagctgcggctgctcctgctgcagctgctagatcatcgatcatcgatcatcgaccatgcatgcacctgccgcgcgcgtgcatcatatctatgatcgatcggtccatctactaccatgtgtaacgccacctggtcgagggtctttgtatgtatgtaagcacctgccagcatgagcagagcaggtgcactcccatgcatgtaaaccgacccctaaataaaatctcccgtggtttaacctatacatgtgtttgt

SEQ ID NO: 900 - DNA, 493 bp, Triticum aestivum
gcacacaagaagctcatagccatccaaagcctctccatctccgaagctccaacccaacccaggatgtcttgctgcggaggaaactgcggctgcggcaccgcctgcaagtgcggcaacggctgcggcggctgcaacatgtaccccgaggccgaggccgccggcaccaccctcctcgtctccgccaccgccacccacaaggcgagctccggcggcatggagatggcggccgagaacggcggctgcggctgcacccagtgcaagtgcggcaccagctgcggctgctcctgctgcagctgttagatcgatcatcgaccatgcatgcatgcaccgtgccgtgcgtgcatcatcgatcatatcgatctactactaccttaccatgtaaccgcaacctgatcgagggcctttatgtacgcacctgacctgcatcagcagtcaggtgccatgccatgattgtaaacaggcccccctaaataaaatctcccctgattaacta

SEQ ID NO: 901 - DNA, 405 bp, Secale cereale
gatgtcttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagcctccgggcggcatggagatggcggccgagaacggcggctgcggctgcacccagtgcaagtgcggcaccagctgcggctgctctgctgcagctgctagatcgatcatcgaccatgcatgcaccgtgccgtgcgtgcatcgtcgtatcgatctactactaccttaccatgtaaccgcaaacctgatcgagggccttttatctatgcacctgacctgcatcagcagtcaggtgccatgccatgattgttgtaaacaggcccctaaa

SEQ ID NO: 902 - DNA, 610 bp, Secale cereale
tcagcacaaaggaagctccgagccaacaccaatcaaagcctccattcaatcccaagcaacctcgaagatgtcttgctgcggaggaagctgcggctgcggcagcgcctgcaagtgcggcaacggctgcggcggctgcaacatgtacccggaggtcgaggccgccggcaccaccttcctcgtctccgccaccgccacccacaaggcgagctccggcgggatggagatggcggcggagaatagcggctgtggctgcacccagtgcaagtgcggcaccagctgcggctgctcctgctgcagctgctagatccatcttcgatcatgcatgcacctgccgcgcgcgtgcatcatatctatgatcgatcggtccatctactgccatgtaacgctgcctgatagagggttctttgtatgtatgtaagcacctgcctgcatgagcacagcaggtgccatgccatgcatgtaaacccctaaataaaatctcccgtggtttaacctatacatgtgtttgtgttatagaccagcttctggcccatgtttactagtatcaacttgcgaggtgcctgggttgttaattaatacaccagctgaatgatgtgtcttgaagcaaaaa

SEQ ID NO: 903 - DNA, 399 bp, Triticum aestivum
gcggaggaagctgcggctgcggcagcgcctgcaagtgcggcaatggctgcggcggctgcaacatgtacccggaggtcgaggccgccggcgccaccctcctcgtctccgccactgccacccacaaggcgagctccggcgggatggagatggcggcggagaacggcggctgcggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatgtatgtacgcacctgcctgcatgagcagagcgggtgccatgccatgcatgtaaacccctaaataaaatctcccgtggttt

SEQ ID NO: 904 - DNA, 417 bp, Secale cereale
cttgctgcggaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatcgcaccgtgccgtgcgtgcatcgtcgtatcgatctactactaccttaccatgtaaccgcaacctgatcgagggcctttatctatgcacctgacctgcatcagcagtcaggtgccatgccatgattgttgtaaacaggcccctaaataaaatctccctggtttaa

SEQ ID NO: 905 - DNA, 417 bp, Triticum aestivum
gaagaagctcctagccaacaccaatcaaagcttccatccaatcccaagcaacctcgacgatgtcttgctgcggaggaaactgcggctgcggtagcgcctgcaagtgcggcaacggctgcggcggctgcaacatgtacccggaggccgaaggccgccggcgccaccctcctccgtctccgctaccgccacccacaaggcgagtccggcggcatggagatggcggcggagaacggcggctgccgctgcacccaatgcaagtgcggcacaactgcggttgctcctgctgaattgctagttccaacaatccgccatcatgcaccgctgcatcatacttttgatcgatccaatccatctacttcacaatgttacgctacctgattaaggtctttggacgtctgttccccactgcctgcatga

SEQ ID NO: 906 - DNA, 429 bp, Secale cereale
ctcaaagatgtcttgctgcggaggaagctgcggctgcggcagctcctgcaagtgcggcaacagctgcggcggctgcaacatgtacccggaggtcgaggccgccggctccaccttcctcgtctccgccaccgccacccacaaggcgagctccggcgggatggagatggcgtttgagaacgggggctgcggctgcacccagtgcaagtgcggcaccagctgcggctgctcctgctgcagctgctagatcgataatcgatcatgcatgcacctaccgcgcgcgtgcatcatatctatgattgatccatcgatctactaccatgtaaccctgcctgatcaggggtctttgtatgtatgtaagcgcctgcctgcatgagcagagcaggggccatgccatgcatgtaaacccctaaataaaatatccggtggttt

SEQ ID NO: 907 - DNA, 432 bp, Secale cereale
cctagccaacaccaaccaaagcctccatccaatcccaagcaacctcaaagatgtcttgctgcggaggaagctgcggctgcggcagctcctgcaagtgcggcaacagctgcggcggctgcaacatgtacccggaggtcgaggccgccggctccaccttcctcgtctccgccaccgccacccacaaggcgagctccggcgggatggagatggcgtttgagaacgggggctgcggctgcacccagtgcaagtgcggcaccagctgcggctgctcctgctgcagctgctagatcgataatcgatcatgcatgcacctaccgcgcgcgtgcatcatatctatgattgatccatcgatctactaccatgtaaccctgcctgatcaggggtctttcagtctttgtatgtatgtaagcgcctgcctgcatgagcagagca

SEQ ID NO: 908 - DNA, 505 bp, Secale cereale
aaaccaacaagcaagaagaatagaagaagctcctagccaacaccaaccaaagcctccatccaatcccaagcaacctcaaagatgtcttgctgcggaggaagctgcggctgcggcagctcctgcaagtgcggcaatggctgcggcggctgcaacatgtacccggaattcgaggccgccggcgccaccttcctcgtctccgccaccgccacccacaaggcgagctccggcgggatggagatgacggtggagaacggcggctgcggctgcacccagtgcaagtgcggcaccagctgcggctgctcctgctgcagctgctagatcgataatcgatcatgcatgcacctaccgcgcgcgtgcatcatatctatgattgatccatcgatctactaccatgtaaccctgcctgatcaggggtctttgtatgtatgtaagcgcctgcctgcatgagcagagcaggggccatgccatgcatgtaaacccctaaataaaatatccggtggtttaa

SEQ ID NO: 909 - DNA, 548 bp, Secale cereale
gactagaagctcctagccaacaccaaccaaagcctccatccaatcccaagcaacctcaaagatgtcttgctgcggaggaagctgcggctgcggcagctcctgcaagtgcggcaacggctgcggcggctgcaacatgtacccggaggtcgaggccgccggcgccaccttcctcgtctcggccaccgccacccacaaggcagctccggccgggatggagatggcggtggagaacgggggctgcggctgcacccagtgcaagtgcggcaccagctgcggctgctcctgctgcagctgctagatcgataatcgatcatgcatgcacctaccgcgcgcgtgcatcatatctatgattgatccatcgatctactaccatgtaaccctgcctgatcaggggtctttgtatgtatataagcgcctgcctgcctgcatgagcagagcaggggccatgccatgcatgtaaacccctaaataaaatatccggtggtttaacctatacatgtgttttcgacatcaaagtaccctagcctataaatgtgtttgtgttctga

SEQ ID NO: 910 - DNA, 647 bp, Secale cereale
catagccaatcaaagcctctccatctccgaagctccaacccaaccgaggatgcttgctgcgaggaaactgcggctgcggcaccgcctgcaagtgcggcaacggctgcggcggctgcaacatgtacccggaggtcgaggccaccggcgccaccttcctcgtctccgccaccgccacccacaaggcgagctccggcggcatggagatggcggccgagaacggcggctgcggctgcacccagtgcaagtgcggcaccagctgcggctgctcctgctgcagctgctagatcgatcatcgaccatgcatgcaccgtgccgtgcgtgcatcgtcgtatcgatctactactaccttaccatgtaaccgcaacctgatcgagggcctttatctatgcacctgacctgcatcagcagtcaggtgccatgccatgattgttgtaaacaggcccctaaataaaatctccctggtttaaccacatgtgtctgtgctatatgcatatgtcatcaccttctttttcttcttcttcttcatgccacaaaaacactgcttaagagttgagagcactgagaaaattataaattatcatgaagcaagattaaggatgttgtgagttttgcccaagaaaataaattatctcatctccccgcaaaaa

SEQ ID NO: 911 - DNA, 503 bp, Secale cereale
agccaacaccaaccaaagcctccatccaatcccaagcaacctcgaagatgtcttgctgcggaggaagctgcggctgcgggcagctcctgcaagtgcggcaacggctgcggcggctgcaacatgtaccggacggttgaggcagccggcgccaccctcctcgtctccgccaccgcacccacaaggcgagctccgcgggatggagatggcggtggagaacggcggctgcggctgcacccagtgcaagtgcggcaccagctgcggctgctcctgctgcagctgctagatcggtaatcgatcatgcatgcacctgccgcacgcgtccatcatatctataattgatccatcgatctactaccatgtaaccctgcctgatcaggggtctttgtatgtatgtaagcgtctgcctgcatgagcagagcaggggccatgccatgcatgtaaacccctaaataaaatatccggtggtttaacctatacatgtgtttttcgacatcaaagtaccc

SEQ ID NO: 912 - DNA, 468 bp, Triticum aestivum
  misc_feature (30)..(30): n is a, c, g, or t
  misc_feature (117)..(117): n is a, c, g, or t
  misc_feature (135)..(135): n is a, c, g, or t
  misc_feature (141)..(141): n is a, c, g, or t
  misc_feature (147)..(147): n is a, c, g, or t
  misc_feature (150)..(150): n is a, c, g, or t
  misc_feature (162)..(162): n is a, c, g, or t
  misc_feature (170)..(170): n is a, c, g, or t
  misc_feature (231)..(231): n is a, c, g, or t
  misc_feature (234)..(234): n is a, c, g, or t
  misc_feature (248)..(248): n is a, c, g, or t
  misc_feature (258)..(258): n is a, c, g, or t
  misc_feature (276)..(276): n is a, c, g, or t
  misc_feature (300)..(300): n is a, c, g, or t
  misc_feature (347)..(347): n is a, c, g, or t
  misc_feature (363)..(363): n is a, c, g, or t
  misc_feature (398)..(398): n is a, c, g, or t
  misc_feature (404)..(404): n is a, c, g, or t
  misc_feature (447)..(447): n is a, c, g, or t
  misc_feature (456)..(456): n is a, c, g, or t
  misc_feature (462)..(462): n is a, c, g, or t
ctcgtgccgaattcggcacgagcacacaanaagctcatagccaatcaaagcctctccatctccgaagctccaaccgaaccgaggatgtcttgctgcggaggaaactgcggctgcggnaccgcctgcaagtgcggnaacggntgcggnggntgcaacatgtanccggaggncgaggccgccggggccaccctcctcgtctccgccaccgccacccaaaaggcgagctccggnggnatggaaatggcggncgagaacggnggctgcggttgcacccantgcaagtgcgggaccagatgcggntgctcctgctgcagctgctaagatcattgatcatcgatcatgcatgnaacgcgcgtgcagcancgatcatatcgatctactactaccataccatgtanccgctncctgatcgaggggcttatctatgcaactgacctgcatcaaaantcaaggtgncaatgncatgcc

SEQ ID NO: 913 - DNA, 603 bp, Secale cereale
tgcggcagcgcctgcaagtgcggcaacggctgcggcggctgcaacatgtacccggaggtcgaggccgccggcgccacctcctcgtctccgccaccgccacccacaaggcgagctccggcgggatggagatggcggcagagaacggcggctgcggctgcacccagtgcaagtgcggcaccagctgcggctgctcctgctgcagctgctagatccatcttcgatcatgcatgcacctgccgcgcgcgtgcatcatatatatgatcgatcggtccatctactgccatgtaacgctgcctgatagagggttctttgtatgtatgtatgcaagcacctgcctgcatgagcagagctggtgtcatgccatgcatgtaaacccctaaataaaatctcctgtggtttaacctatacatgtgtttgtattatagaccagcttctggcccatgtttactagtatcaacttgcgaggtcttaattaataaaccagctgaatgctgtgtcttgaagcaacgcatgcaccaccgcttgcaatcggtgtatctttatacacctgtatttattttacagatgtattcatgtatatcatcgagaaactggtttattctg

SEQ ID NO: 914 - DNA, 272 bp, Setaria italica
caagaagcacacaggaagctcctagccaacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcgggatggagatggcggcggagaacggcggctgcggctgcacccagtgcaagtgcg

SEQ ID NO: 915 - DNA, 1430 bp, Triticum aestivum
ggtcgcctttccacggcgaaaggcatcccggcggcgatggcggcggctgcggcaaggtccggatcccggcgcttgttctccatatccgccctggtgccaccgaagccgccgacccctcccccgaaggcagaccccttcgccagcctcttcgcccccgggttaagcaagcgaacaacaactgatggacttagggaagcttttgcaaagtctggtgaagttgtgcatgcatcatctgtaaaaaattcaaggtggtatatgatcaatgcaaaccgttcaggtcctttgacagtgcgtaaagaataccgcaaagtgcttccttctttcataaggccatctgcatcttactccacagaagcctcagaaaaaagaccaaaacaggagagaacagacttgacgactgttgaagatccctttaatgcccctacctacaatatacctgagaagccagtgacatttgtcgagggcgcctcttacagtgttgtaatacttgctgggcttggagttgctgcattggctggatatgctgttttcaaagagcttatatttgaaccaaaagagtacaagatttttgggaaagctctagtaagagttcagagtgatagtcaggttacagccaaaattggttaccctataactggttatggtacggaatccagaaaccgcgcagctcggcagcgcatccaaaacagggtttggacagatgaggatggtgttgaacatgtggaggtaggctttcacatccgagggccgcatggagctggaaaggtctttgcggagatgttcaaagatagctccgacaggacatggaagttcacgtttcttctcgtcgagattacgtcaccgcgacctgcacaaatcatgttagaatcttacctaccagcatagggatgcaagagaccagatcagccagcagtggcacatccatgcgacacttcattttacatcccatctccaatggcctgcatctgatgttaaatacccgtcctcggattaaagaagttgtgaattttgaacttccccgaaagcataagtaggaggaagatgaaccatcagagctgctgaccagagtatcttagacatggtgtaccgtgcaaggaccttgatgttgttgctttgtttagctgaaaggcgtgcaggcacatgtgtacaacccttctttcccggtgctcctcaaacatgggagggagcaagtgatccttcatctatcgagttttggtcccatttcaggcagttttaatgatgcacatggatttcgtgcaagcctccaatgatgtccaaatagcaataatatctggttacattacgactttcaagcctgggtttccaggcatgtatgaagtgatcttcaatacaagggtgcatgtttctttagcattgctaaaattcagttaaaacctagagacggtaaaagtaccgcacttgcggacccc

SEQ ID NO: 916 - DNA, 1414 bp, Triticum aestivum
ggtcgcctttccacggcgaaaggtatcccggcggcgatggcggcggctgcggcaaggtccggatcccggcgcttgttctccatatccgccctggtgccaccgaagccaccgagccctcccccgaaggcagatcccttcgccagcctctttgttcccgggttaagcaagcgaacagtagctgatggacttaggggagcttttgcaaagtctggtgaagtcgtgcatggttctcttttgacaaaccttccagcatcatctgtaaaaaaatcaaggtggtatatgatcaatgcaaaccgttcaggtcctttgacagtgcgtaaagaataccgcaaagtacttccttctttcataaggccatctgcatcttactccacacaagcttcagaaaaaagaccaaaacaggagagaacagacttgacgactgttgaagatccctttaatgcgcctacctacaatatacctgagaagccagtgacatttgtcgagggcgcctcttacagtgttgtaatacttgctgggcttggagttgctgcattggctggatacgctgttttcaaagagcttatatttgaaccaaaagagtacaagatttttgggaaagctctagcaagagttcagagtgatagccaggttacagccaaaattggttaccctataactggttatggtacggaatccagaaaccgtgcagctcggcagcgcatccaaaacagggtttggacagatgaggatggtgttgaacatgtggaggtaggctttcatatccgagggccgcatggagctggaaaggtgtttgcggagatgttcaaagacagctccgacaggacatggaagttcacgtttcttctcgtcgagattacgtcaccgcgacccgcacaaatcatgttagaatcttacctaccagcatagggatgcaagagacaacatcagccagcagtggcacatctatgcgacacttcattttacatcctatctccaatggcctgcatctgatgttaaatacccgtcctcggattaaagaagttgtgaattttgaactttcccgaaagcataagtaggaggaagatgaaccatcagagctgctgaccatctctagtatcttagacatggtgtaccgtgcaaggaccttgatgttgttgctttgtttagctgaaaggcgcgcaggcacatgtatacaagccatctttcctgatgctcctcaaacaacatggaacggagcgagtgatccttcatctatcgagttgtggtctcgtttcaggcagttttaatgatgcctatggatttcatgcaaacctccaatgatgtccaaatagcaataatatctggttacattacggctctcaagcctggggttccaggcatgtatgaagtgatcttcaatacaagtgtgcatgtttctttaccattgctaaaa

SEQ ID NO: 917 - DNA, 1132 bp, Leymus cinereus x Leymus triticoides
  misc_feature (749)..(749): n is a, c, g, or t
ctttccacgtgcgaaaggcatcccggcggcgatggcggcggctgcggcaaggtccggatcccggcgcttgttctccatatctgccctggtgccaccgaagccgccgacccctcccccgaaggcagaccccttcgccagcttcttcgtccccgcatcatctgtaaaaaattcaaggtggtatacgatcaatgcaaaccgttcaggtcctttgacagtgcgtaaagaataccgcaaagtacttccttctttcataaggccatctgcatcttactccacacaagcttcagaaaaaagaccaaaacaggagagaacagacttgacgactgttgaagatccctttaatgcccctacctacaaaatacctgagaagccagtgacatttgtcgagggggcctcttacagtgttgtaatacttgctgggcttggagttgctgcattggctggatatgctgttttcaaagagcttatatttgaaccaaaagagtacaagatttttgggaaagctctagcaagagttcagagtgatagtcaggtcacagccaaaattggttaccctataactggttatggtacggaatccagaaaccgtgcagctcggcagcgcatccaaaacagggtttggacagatgaggatggtgttgaacatgtggaggtagggtttcatatccgagggccgcatggagctggaaaggtgtttgcggagatgttcaaagataactccgacaggacatggaagttcacatttcttntcgtcgagattacgtcaccgcgccatgcacaaatcatgttagaatcttacctaccagcatagggatgcaagagaccagatcagacagcagtggcagatccatgcgacatttcattttacatcccatctccaatgactgcatctcatgttaaatacctgtcctcggattaaagaagttgtaaattttgaacttccccgaaagcataagtaggaggaagatctctagtattttagacatggtgtaccgtgcaaggaccttcatgttgttgctttgtttagctgaaaggcgtgcaggcacatgtatacaacccatctttcccggtgctcctcaaacatgggacggagcgactgatccttggtctatcgagttttcaggcagtttta

SEQ ID NO: 918 - DNA, 1391 bp, Avena sativa
ccggcgcccaaagctcgctgccccgtagccgtccccaattcgctgcgcagcctccgccggacacagcaatagaagaaggaaatccctatcctccgattgcctttccacgtcgaagacatcctggtggtgatggcggtggctgcagcaaggtctggatcccggcgcctgttctccatctcggccattgtgccacggaagctgccaaaccctcccctgaaggctgagtccttccccaacctcttggtccctgggttaagcaagcagacaacacttggtggacttagggaagcttttccaaagtctggtgaagttgggcatgcatcatcttcaaaaagttcaaggtggtatatgatcaattcaaaccgttcaggttctcttacagtgcgtaaagaatgccgcaaagtacttccttcttcaataaggccatctgcatcttactccacacaagcttcagaaaacaaaccaaatcaggagagaacagacttgacaacaactgaagatccctttgattcccctacatataatatacctgagaagccagtgacatttgttgaaggggcctcttacactgttgtaatactcgcggggcttggagttgctgcggtggctggatatgctgttttcaaagagcttatatttgaaccaaaagagtacaagatatttgggaaagctctagcaagagttcagagtgatagtcaggttacggccaaaattggttaccctataactggttatggtacggaatccagaaaccgtgcagctcggcagcgcattcaaaacctttggacagacgaggacggtgttgaacatgtggaggtgggatttcatatccgagggccacatggagctggaaaggtgtttgctgagatgtttaaagataactctgacaggacatggaagttcacatttcttcttgtcgagattacatcaccacgtcattcacagatgatgttggaatcttacatcccagcataaggatgcaagaggcaaaaccagctagcggggacacatccatgcgatacttttttttacatcctatctcatgtttaatactggtcctcagattaaaaaaagttctgaattttgatcttcctataagcataggcaggaggaagataaactatcagagccgctgatcatctcttgcatcttatatatagtgtaccgcaaaaggaccgtaatgttaggattgtttagctgaaggccgtgtaagctcatgtaggcagctcatttcccctaatgttcctcaaacctggtgcggagaacaagtgatccttcatctgagttttttgtctcattttttcaggtcagatggtttaccgctgtctatggattttcatccaaacctctgatgatatccaaatagctataacatgcattttgtaataaca

SEQ ID NO: 919 - DNA, 1409 bp, Avena sativa
ccggcgcccaaagctcgctgccccgtagccgtccccaattcgctgcgcagcctccgccggacacagcaatagaagaaggaaatccctatcctccgattgcctttccacgtcgaagacatcctggtggtgatggcggtggctgcagcaaggtctggatcccggcgcctgttctccatctcggccattgtgccacggaagctgccaaaccctcccctgaaggctgagtccttccccaacctcttggtccctgggttaagcaagcagacaacacttggtggacttagggaagcttttccaaagtctggtgaagttgggcatgcatcatcttcaaaaagttcaaggtggtatatgatcaattcaaaccgttcaggttctcttacagtgcgtaaagaatgccgcaaagtacttccttcttcaataaggccatctgcatcttactccacacaagcttcagaaaacaaaccaaatcaggagagaacagacttgacaacaactgaagatccctttgattcccctacatataatatacctgagaagccagtgacatttgttgaaggggcctcttacactgttgtaatactcgcggggcttggagttgctgcggtggctggatatgctgttttcaaagagcttatatttgaaccaaaagagtacaagatatttgggaaagctctagcaagagttcagagtgatagtcaggttacggccaaaattggttaccctataactggttatggtacggaatccagaaaccgtgcagctcggcagcgcattcaaaacctttggacagacgaggacggtgttgaacatgtggaggtgggatttcatatccgagggccacatggagctggaaaggtgtttgctgagatgtttaaagataactctgacaggacatggaagttcacatttcttcttgtcgagattacatcaccacgtcattcacagatgatgttggaatcttacatcccagcataaggatgcaagaggcaaaaccagctagcggggacacatccatgcgatacttttttttacatcctatctcatgtttaatactggtcctcagattaaaaaaagttctgaattttgatcttcctataagcataggcaggaggaagataaactatcagagccgctgatcatctcttgcatcttatatatagtgtaccgcaaaaggaccgtaatgttaggattgtttagctgaaggccgtgtaagctcatgtaggcagctcatttcccctaatgttcctcaaacctggtgcggagaacaagtgatccttcatctgagttttttgtctcattttttcaggtcagatggtttaccgctgtctatggattttcatccaaacctctgatgatatccaaatagctataacatgcattttgtaataacattttaaaattctttcaaa

SEQ ID NO: 920 - DNA, 1710 bp, Triticum aestivum
tgcccggatcggaccccacctccgcctcccaggaccactgctctgctcctgctgggatctcccctcgtcgccggcaaccgcgccgcaccgcacccaagcagcagcagcggcgatgaggtgcctgccgttcctgcacggggacggcaagtcaagggacgacgaccggcgcacgggccccagcgccgccatgtcggcctcggtgcgctccttcagcaccgagtccacggagcgcggcgacccgcgctccggctccgacctcaactccatcaacgtctccgacatgagcgccgagtccatccgccggacgcagtaccccagcttcaccgaccgccccgccaacctccgggtcttcaccttccccgagctcaaggccgccacccgcaacttcagccgctccctcatggtcggcgagggcggcttcggctgcgtctacaggggcgtcatcaagggctccgacgaccccaccgagcgcgtcgagatcgccgtcaagcagctgaaccgcaagggagtccaggggcagaaggaatggttaacagaaatgaacgtgcttgggattgttgagcacccaaaccttgtcaaactaataggttactgcgcggacgacgatgagcggggaatgcagcggcttctggtatacgaatacatgcccaacggaagcgtggatgaccacttggcaagtaggtcaacttctactctgtcatggccaatgagattgaaagtagctcttgatgctgcccgcggactcaagtatctgcatgaggagatggactttcaggttattttccgagacctgaaaacatctaacattctattagatgagaactggaatgcaaagttatcggacttcggattggctaggcatggaccacaagaagggctatcccatgtctccacagcggttgttggaactctaggatacgccgcgccggagtacatgcaaaccgggcgcctcaccgcaaaaagcgacatatggggctacggcgtgctcctctacgagctcatcaccggccgccgtcccatcgaccggaaccgcccaaagggcgagcagaagctcctggactgggtgaaaccgtacatctccgacatcaagcggttccccatcatcgtcgacccgcggctcgagggacactacaacctcaagtccatgacgaggctggccggcgtggcaaaccgctgcctcctgcggctaccaaagacgcgcccgaagatgagcgaggtgtatgaaatggtccagaagatcgtcgacagcgtcgaggtcggcccaccggagcctcccctgcactaccatggctcggtgtccggaccgggcgcgaagcggaccaagaaagggtcgctgaagaggaggctccaggagttcaagttcgggtgccgccagatcgtgtggcggggctggaaacctgagatcataaagacctgctgaaatggatgccaccctcctcctgcctgtgactgtaagtatagctgttcatagagatataaagttcgtaaccggtgcgcggtttgcgctgcagcgtgtaacttttttggtcctgtagatttatgtttgagccgtcttgtgtttgtgtattactctggtctgagctgcaagattgtgaatcagtaggtcgtttgcgtttttggtccagtttcagctcttccatcttgtgaactcttattgctagcagaatagagagtactaatattgtttgtgcaaaaaaaaaaaaaaaacga

SEQ ID NO: 921 - DNA, 1642 bp, Brachypodium distachyon
agagatggggtgcttggctttcttgcatggggagagcaaagaggagcgtcctgccccaaaatcggcctccgtgcgctccttcagcacgacatccacggaacgcgaagtcccatctggctctgacctcacctccatgaacatctctgacatgagtgcggagtcaataaggaggacgcagtaccccagcttcactgaccggcccagcaacctcagggtgttcaccttttctgagctcaagaatgccacccgcaacttcagccggtcgctcatggttggtgagggtgggtttgggtgcgtgtacaggggaatcatcaagaattctgatgaaccgaatgagcggattgagatcgctgtgaagcagttgaatcgcaaaggagttcaggggcagaaggaatggttaacagaaatgaatgtgcttgggattgtcgagcatccaaacctcgtcaaactaataggttactgcgctgacgatgatgagcggggaatgcaacggcttctagtatacgagtacatgcctaatggaagcgtggatgaccacttggcaagtaggtcaacttcaactctatcatggccaatgagactaaaggtagctctcgatgctgctcgggggctgaagtatctgcacgaagagatggattttcaggttattttccgagacctgaaaacatctaacattctattagatgagaactgggatgcaaaattgtcagactttggattggctaggcatggaccacaggaaggtctaagccatgtctccacagcggtcgttggaacgctaggatatgcagcgccggagtacatgcagactggacgcctcactgcaaaaagcgacatgtggagctatggcgtactcctctatgagctcatcactggccgccgtcctatcgacaagaaccgcccaaagggcgagcagaagctcctggattgggtgaaaccatacatctctgatgtcaaaaggtttcccatcattgtagacccacggcttgagggacactacaacctcaagtccgtgacaaagttggccgctgtggcgaaccgctgcctcgtccggctaccaaagtcacggccaaagatgagcgaggtgtacgagatggttcagaagatcgttgacagcattgagactggcccaccacaacctcctctgcactaccatggctctgtttctgaacctggcgcgaagcgaacaaagaaaggatctctgaagagaaggttccaagaattcaaatttggttgccgccagattgtatggcgtggctggaagcctgagattataaagacttgctgaaaggacagtaatacctgcctgtaattatagttgtccatatgggtgcaccatttagttgcagcgtgcgactttttgtcctctagttttctgtgtaatccatcttgttttgtgtatgacaatctgagctacaagcaagatggtggtcaataggttgtttgtatttttgatgcaacatcagtcttcctgtcttacaaactcttcgatagccaaataccgactttatttatgcaaaccctgatactgtcattttccttctggaaaagggttggatacagggaatgattctgattcagttgaggtgtgacatgaacccagtggattgccacagaccaatcggaaaatgtgccttatctc

SEQ ID NO: 922 - DNA, 2085 bp, Oryza sativa
gaaaggggagaacctgagactgatgagagggagagggataaaacaaatcaatatgaggcaaagctcccaactttgactgctgcttagcccaagtccaagtctttcttcctcctccgacctccccccatctccatctccgtgctcatctgccttcttctctcccctttccccgtcgcttcctgcctggatcgcacacacaaagagatccctcgcaggcggagtggtgcttcccctctcggatcatcttcgcctctgcaagattggcaagcaatgaggtgcctgcctttcttgcatggagattccaaagaggaggatcccgtcaacaagtcggcttctgtccggtcgttgagcacaacatcgacggagcgggatgtccggtccggctccgacttcaactccttgaatgtctctgacatgagtgccgaatcaatacggaggacacagtatcccagcttcactgatcggcccagtaacctcagggtgttctctttctctgagctgaagaatgccactcgcaattttagccggtctcttatggttggtgagggtgggtttggatgtgtgtataggggtgtcatcaagaattccgatgaaccaactgagcgcaccgagattgctgttaaacagctgaatcgcaaaggacttcaggggcagaaagaatggttaacagaactgaatgtgcttgggattgtagagcatccaaacctcgtcaaactaattggctactgcgctgaagatgatgaaaggggcgtacagcgtctcctagtatacgaatacatgcctaatggaagcgtggatgatcacttgtcaagtaggtcaaattcaactctatcatggccaatgagactaaaagtagctctggacgctgctcggggactgaagtatctgcatgaagagatggaatttcaggttatcttccgtgacctaaaaacatctaacattctgttagatgagaactggaatgcaaagttgtctgactttggattggctaggcatggaccatcagaaggcctgacccatgtctctacagcggtcgtgggaactcttgggtatgcagctccggagtacatgcagaccggacgcctcactgccaagagtgacatatggggctatggtgtgctcctttatgagctcatcaccggccgccgtcccattgaccggaaccgcccaaagggtgagcagaagctcctggattgggtgaaaccatacatatctgatatcaagcggttccccatcatcatagacccacggctagaggggcactacaacctcaagtccatgacaaagctggctagtgtggcgaaccgctgtctcgtccggctaccaaagtcgcgcccaaagatgagtgaggtgtatgagatggttcagaagattgtggccagcattgagaccggcacaccacagcctcctctgcactaccatgggtcggtttctgaaccgggctcaaagcggccaaagaaggggtcactgaagagaaggttccaagaattcaaattcggttgccggcagattgtatggcggagctggaagcctgagatcataaagacttgctgagagaatacagtagcttcctgcctgtaagtatatagctaagttgttcatagggataaagctcttcttcctctgtatgcttcctgtccttggggtgatctgatcccatttcgggcacacagttgagtacttgagttgcagtgtgaagctttttatcttatagggttctgtgtgatgcatcttgaggttgtagattccatgtgttttcagtataatccctgtggctttcctcatcatgtaatatagatcttgtttgtgcaatatgaaagaaaaaaaaagatgagctttcttgtatgaaagaaaaggggattggattgctggggatgattcagattgaggcaagatgtggcctgaatgatggatttgccgccggccaatcggaatattgtagcttatctcaacctcgatttcagaacgatccgatggccggcgttacatgctagccattcttttgattaagataagactcggcggcgcagattgaaagagacccttcttccaattgggaaaactaaatatgcagattttgcaaaa

SEQ ID NO: 923 - DNA, 2029 bp, Oryza sativa
gaggcaaactccaactttgactgctgcttagcccaagtccaagtctttcttcctcctccgacctccccccatctccatctccgtgctcatctgccttcttctctcccctttccccgtcgcttcctgcctggatcgcacacacaaagagatccctcgcaggcggagtggtgcttcccctctcggatcatcttcgcctctgcaagattggcaagcaatgaggtgcctgcctttcttgcatggagattccaaagaggaggatcccgtcaacaagtcggcttctgtccggtcgttgagcacaacatcgacggagcgggatgtccggtccggctccgacttcaactccttgaatgtctctgacatgagtgccgaatcaatacggaggacacagtatcccagcttcactgatcggcccagtaacctcagggtgttctctttctctgagctgaagaatgccactcgcaattttagccggtctcttatggttggtgagggtgggtttggatgtgtgtataggggtgtcatcaagaattccgatgaaccaactgagcgcaccgagattgctgttaaacagctgaatcgcaaaggacttcaggggcagaaagaatggttaacagaactgaatgtgcttgggattgtagagcatccaaacctcgtcaaactaattggctactgcgctgaagatgatgaaaggggcgtacagcgtctcctagtatacgaatacatgcctaatggaagcgtggatgatcacttgtcaagtaggtcaaattcaactctatcatggccaatgagactaaaagtagctctggacgctgctcggggactgaagtatctgcatgaagagatggaatttcaggttatcttccgtgacctaaaaacatctaacattctgttagatgagaactggaatgcaaagttgtctgactttggattggctaggcatggaccatcagaaggcctgacccatgtctctacagcggtcgtgggaactcttgggtatgcagctccggagtacatgcagaccggacgcctcactgccaagagtgacatatggggctatggtgtgctcctttatgagctcatcaccggccgccgtcccattgaccggaaccgcccaaagggtgagcagaagctcctggattgggtgaaaccatacatatctgatatcaagcggttccccatcatcatagacccacggctagaggggcactacaacctcaagtccatgacaaagctggctagtgtggcgaaccgctgtctcgtccggctaccaaagtcgcgcccaaagatgagtgaggtgtatgagatggttcagaagattgtggccagcattgagaccggcacaccacagcctcctctgcactaccatgggtcggtttctgaaccgggctcaaagcggccaaagaaggggtcactgaagagaaggttccaagaattcaaattcggttgccggcagattgtatggcggagctggaagcctgagatcataaagacttgctgagagaatacagtagcttcctgcctgtaagtatatagctaagttgttcatagggataaagctcttcttcctctgtatgcttcctgtccttggggtgatctgatcccatttcgggcacacagttgagtacttgagttgcagtgtgaagctttttatcttatagggttctgtgtgatgcatcttgaggttgtagattccatgtgttttcagtataatccctgtggctttcctcatcatgtaatatagatcttgtttgtgcaatatgaaagaaaaaaaaagatgagctttcttgtatgaaagaaaaggggattggattgctggggatgattcagattgaggcaagatgtggcctgaatgatggatttgccgccggccaatcggaatattgtagcttatctcaacctcgatttcagaacgatccgatggccggcgttacatgctagccattcttttgattaagataagactcggcggcgcagattgaaagagacccttcttccaattgggaaaactaaatatgcagattttgcacaa

SEQ ID NO: 924 - DNA, 1933 bp, Setaria italica
cttcctcccccgtcgtcttctcacctgcgttcccggacagagcgaagaaaattcgggcgcacacaaacacggcatactatagtgtagcaataataaaaagaagccgtctttgcttcgcagcttcttggttggtgacacagcagagcgctggaggagtgggggaggaaaaaaaaatatcaggcgagctccgaactttgaccgctgctgccgccgccgtgcttgctgcgtagccccgcagccccaggccttctctccgcctccgctttccccgtcgcctcccggatcggagctcccctccccgggtcaccgccggccgcctcccctcggatcagctccacctccacaggataggcgagcaatgaggtgcctgcctttctggcatggagaggtcaaagaggaggatcctgtcaccatgtccgcgtctgtacggtccatcagcacaacatcaacagagcgcgatgtccgctctggttcagacttcacctccttgaatgtatccgacatgagtgccgagtcaataaggaggacacagtaccccagcttcaccgaccgaccatctaacctgagggtgttctccttcgctgaattgaagagtgccacacgcaacttcagccggtcactcatggttggcgagggtggctttggctgtgtgtacaggggcatcatcaagacctctgacgaacctaatgaacgaattgagatcgctgttaagcagttgaatcgtaaaggacttcaggggcagaaggagtggttaacagagatgaatgtgcttggaattgttgaccatccaaacctagttaaactaataggctactgtgctgaagatgatgagcggggagtacaacggcttctagtgtacgaatatatgcttaacggaagtgtggatgatcacttgtcgagcaggtcaacttcgactctatcatggccaatgagactaaaagtagctcttgattctgcccggggactgaagtatctgcatgaagaaatggaattccaggttattttccgagatctgaaaacatccaacatcctgttggatgagaactggaatgctaaattgtcagactttggtttggctaggcatggaccaacggaaggtctgacccatgtctccacagcggtcgttggaactctaggctatgcagcacctgagtacatgcaaaccgggcgccttactgcaaagagcgacatatggagctacggcgttctcctgtacgagctcatcaccgggcggcggcccatcgaccggaaccggccaaagagcgagcagaagctgctggagtgggtgaagccatacgtcggggacaagaagcggttccctatcatcatcgacccgcgcctggaggggcactacaacctcaagtccatgttgaagctgtccagcgtggcgaaccgctgccttgtccggatgccaaagagccggccgaagatgagcgaggtgtacgagatggtccagaagatcgtcgacagcgtcgagaccgggccgccgcagccgcctctgcactaccacggctcggtgtccgaaccaggcgcgaagcggaccaagaaagggtcgctgaagaggaggctccaggagtttaagttcgggtgccggaacatcgtgtggcggggctggaagcctgagatcgtgaagaccttctgagactctccttgctgtaagtatagctgtgcatagggatgataggtggtggttcctctgtgtgtttgccattcgggcgagttgaaaccaaccaggcgcacaaatttgccgtgtaattcacctggtcccgggcaacacaacgcgtgagctgcaagatggtgatcggtaggccccctttgtgttttcagtgcaattcctggtgttttcagtccaattacgaactgcctcgtgtctgcagtgcaattcctggccttcttttgtacttttctggtatgatgaagtcagggttctgtt

SEQ ID NO: 925 - DNA, 2595 bp, Zea mays
cgtccggcgatccatccgtcttccccctccctctgccctcgtgctcctcccgtcaccctcgtctccactccccgtgacgaccaggaaggaattcttcctccgtccccgttcgccccgtcgtctcgtcgttttctcacctgcgtgctgcgttcgcggacaaagtgtgggaaaatgaaaacctgagcgcaaacaaacactctgagcctcgcaggagggagaggggggagagcggaggagaaaccacctttctttccgttccagacaagctcccagctttgaccgccgccgccgccgccgctgtgtgtgtgtgctcccttagtagttagtccctgtcgcgtcccggatcggagctcccctccgtgcacgggacaccgccggtccgggcgtctccactcccccccggatcgatcagctccgcctccgcaagataggcaagcaatgaggtgcctgcctttcttgcatggagacaccaaagagaaggatccagtcactaagtcggcctctctacggtccatgagcacaacatcaacggagcgcgatgtccgctccggttcagacttcacctccttgaatgtttccgacatgagcgccgagtcgataaggaggacgcagtaccccagcttcactgaccgcccgtctaacctgagggtgttctcctttgctgaactgaagagtgccacccgcaacttcagccggtctctcatggttggcgagggtggctttggctgtgtgtacaggggtgtcatcaagacctccgatgaaccgaacgaacgaattgagatcgctgttaagcagttgaatcgtaaaggacttcaggggcagaaggagtggttaacagagatgaatgtgcttggaattgtggatcatccaaacctagttaaacttataggctactgtgctgaagatgatgagaggggagtacaacggcttttagtgtacgaatatatgcctaatggaagtgtggatgatcacttgtcgagtaggtcaacttctactctgtcatggccaatgagactaaaagtagctcttgattctgctcggggactgaagtatctgcatgaagaaatggaattccaggttattttccgggacctgaaaacatctaacattttgttggatgagaactggaatgctaaactgtcagactttggtttggctaggcatggaccagcagaaggtctgacccatgtctccacagcggtggtcgggactctaggctacgcagctccagagtacatgcagactgggcgcctgaccgcgaagagcgacatatggagctacggcgtcctcctgtacgagctgatcacaggccgccgccccatcgaccggaaccgcccaaagagcgagcagaagctcctggactgggtgaagccgtacatctcggacgtgaaacggttccccatcatcgtcgacccgcggctggaggggcactacaacctcaagtccatgacgaagctgtccagtgtggcgaaccggtgcctggtccggatgcccaagtctcgccccaagatgagcgaggtgtacgacatggtgcagaagatcgtggactgcgtggggaccggcccgccgcagcccccgctgctgcactaccacggctcggcctctgagcctggccctggcgacaagcgcgccaggaaagggtcggtgaagaggaggaggctctgggagctcaggttcggctgccggcacatcgtgtggcgcggctggaagcctgcgatcgtgaaggacatctgaggagggcggggtggctccggtgctgtaagtacagtagctagctagctgttcatagagacggtggtaacagtttgttccaccgtgtagtgcttggttggtatatagggtgagttcatgcttgcataataccagtcgagaagaagaagaagaaaggtgcacagttgagtggggtggcgttggaatggagtacatagagtagtgctgtgtgtaatttccagtgcaacttctgctgctggctttcttcgtctttgggacaagtttggtgtggtcttcggggatgattcagatacccattcccttgtatgccatttttgactgatgtccagggacccagcgcaccctggtctcattcatttcttcgtccacccttctgatggtctcatatacccttttcataacgaggaatggagaaagaggatagatgctagaagacagaagagaaagtatggatcaaaagggtgtagtggaagagagatgggagagcacaacaaggtggagatcgaggatggtggcataccacaatggtgtagagacatatctatgcatggattcgccatgtgtgattgctccttcatgtgcctgaacccacaacacaacaatgttgagattgaggacaacaacatacctcaatggtgtggaggtcggtctccatctagatttattatgttcgcctgctccttcatctacatcggcccacaacatgacaaggtggagatcgacgacgatagccacaggctcaccgcctccttcatccatctttacacacgtgagatctacatgacctcactccatcgccttctccttgggcaaatatgcaagcaaaggaaggagcgaatctaaaaggaaaaaagagaaaaaaaa

SEQ ID NO: 926 - DNA, 2474 bp, Sorghum bicolor
gaaattttgaaaagtttttagattttggatggaagtaaaaatggaaaagcagcagtgacactctcctctctctctctctctcgtgctgcgcggcgcggacggagagagatagagcggactgcaataaatttgtcgcgtccggcgatccatctcccacctctgccctgacctcccttccctcgtgctcctcccgtcacgctcatctctactccccgtgacgaccaggaaggaattcttcttcctccgtcctcgccccgtcgtcttctcacctgcgtgctgcgttcgcggacaaacttcttggttggtgacactgcggagcccgagcctcagcctcgcaggaggagacggagagcggaggagcgggaggagaaagccacctttcttcccgtttcagacaagctcccagctttgaccgccgttgctgctgctgctgctaccgtgtgctccctgagtccctgttgcgtcccggatcggagttcccctccgcacgggacaccgccgggccgggcgtctccactcccctcggatcgatcagccccccccaccgccgccgcaagataggcaagcaatgaagtgcctgcctttcttgcatggagatgccaaagagaaggatcctgtcactaagtcggcctctgtacggtccatgagcacaacatcaacggagcgcgatgtccgctccggttctgacttcacctccttgaatgtttccgacatgagtgccgagtcaataaggaggacacagtaccccagcttcactgaccgcccgcctaatctgagggtgttctcctttgctgaactgaagagtgccacccgcaacttcagccggtctctcatggttggcgagggtggctttggctgtgtgtacaggggtgtcatcaagaactctgacgaaccgagtgaacgaattgagattgctgttaagcagttgaatcgtaaaggacttcaggggcagaaggagtggttaacagagatgaatgtgcttggaattgtggaccatccaaacctagttaaactaataggctactgtgctgatgatgatgagagaggagtacaacggcttctagtgtatgaatatatgcctaatggaagtgtggatgatcacttgtcgagtaggtcaacttctactctgtcatggccaatgagactaaaagtagctcttgattctgcccggggactgaagtatctgcatgaagaaatggaattccaggttattttccgagatctgaaaacatctaacattttgttggatgaaaactgggatgctaaattatcagactttggtttggctaggcatggaccggcagaaggtctgacccatgtctccacagcggtagttgggactctaggctacgcagctccagagtacatgcagactggacgcctcaccgcgaagagcgacatatggagctacggcgtccttctgtacgagctcatcacaggccgccgccccatcgacaagaaccgtccaaagagcgagcagaagcttctggactgggtgaaaccatacatatctgacgtgaaacggttccccatcatcgtcgacccacggttggaagggcactacaacctcaagtccatgacgaagctgtctagcgtggcgaaccggtgcctggtccggatgcccaagtcccgcccaaagatgagcgaggtgtacgacatggtccagaagatcgtggacagcatcgggaccgggccgccgcagcccccgctgctgcactaccgtggctcggcctctgacccggccaccaagcgcgccaagaaagggtctctgaggacgaggctccgggagtttgggctcggctgccggaacatcgtgcagcggggctggaaagcctgagatcgtgaagaacctctgagtgagtctgaggaggcgcggcgtggctccggtggtgctgtaagtacagtagctgttcatagagacggtggtaacagttccaccgtgtagtgcttggttggtatagagtgagttgatgcagatgcatgcataccagttgagaaagacaaggtgcacagttgagtggtggcgttcgtgtagagtagtgctgtgtctgtgtaattcacctggttttgactcctgtggttaacacaatgtgtgagctgcgatatggtgagctatagggggggcccttgtgttttcagtgcaattttttctgctgcctcttcgtcttcttgagaaacccttcagtagcattagaagtctgcttcggttctgctccattgattcagattcccattcccgtgtatgccttttttttggtagaaccttctatgccatttttgactgatgggcagggtacccttgttttatttcttcgttgactgatggccttgtaaccaataaatccaccctcttttcgaatcgtggactgcgatcctcccactccacccttcttttctaaccgtggactgggctcctttaacgggccctaggtcacaggctcgctccatccaccctcgatctttgcgagatctac

SEQ ID NO: 927 - DNA, 1966 bp, Zea mays
tggatcagacctatctaggccgagcttcatctggctgtgccggaccggcggcgtttgaacatcactatccggagcccgagcctcagtctcacaggagggagagggacagcggaggagaaatcgcccttcttccagtttcattcagacaaattccttcccagttttgactgtcgttgctcctgctgcttccgtgcgctccctgaatcccagtctcctcccccgtcgcgtcccggatcggagctcccctccggcacgggcgtctccactcccctcggatcggccagccccgtcgccgcaagataagcaagctatgaggtgcctgcctttcttgcatggagacgtcagtgagaaggatcctgtcactaagtcggcctctgtacggtccatgagcacaacatcgcgctcccgctccggttcagacttcacctccttgaatgtttccgacatgagcgccgagtcaataaggaggacacagtaccccagcttcactgactgcccgtctaacctgagggtgttctcctttgctgaattgaagagtgccacacgcaacttcagccgatctctcatgcttggcgagggtggctttggctgtgtgttcagcggcatcatcaagacctctgacaaacctaatgaacgaattgagattgctgttaagcaattgaaccgtaaaggacttcaggggcagaaggagtggttgacagagatgaatgtgcttggaattgtggaccatccaaacctagttaaactaataggctactgtgctgaagatgatgagaggggagtacaacgccttctagtgtatgaatatatgcctaatggaagtgtggatgatcacttatcaagtaggtcaactactctgtcatggccaatgagactaaaagtagctcttgattctgctcggggactgaagtatctgcatgaagaaatggaattccaggttattttccgagacctaaaaacatccaacattctgctggatgaaaactggaatgctaagttgtcagactttggtttggctaggcatgggccaacagaaggtctcacccatgtctccaccgcggtggttggaactctaggctacacagctccagaatacatgcagactggacacctcacggcgaagagcgacatatggagctacggagtcgtcctgtacgagctcatcacaggccgccgccccatcgaccagaaccgtccaaagagcgagcagaagcttctggactgggtgaagccatacatctcggacgtgaagcggttccccgtgatcatcgacccgcggctggaggggcactacaacctcaagtccgcgacgaagctggcgagcgtcgcgaaccggtgcatggtccggctgcccaagtcccgccccaagatgagcgaggtgtacggcatggtccagaggatcgtggacggcgtcgggaccggcccgccgcagcccccgctgctgcactaccaccatggctcggcctccgagccgggtgccaagcgcgccgagaaagggtcgctgaggaggaggttccgggaattcaggtccggctgccggcacgttgtcctgcggcggggcaggaagcctgaggtcgtgaaggacctctgagggagggaggcggtggtggatccggtgctgcaagtatatggtagtagtaggtgttcatagagacggtggtatcagttccaccgtgtagtgcttgggttggtatagggtgagttcatgcatgcataccagtcttgaagaagaaagaaagaaagaaaaaaagaaagaaagacaaggtgcaccgttgagcggtggcgttcgtgtagagtagtgctagctgtggttttgacctcctgtgtggtttacacaatgtgtgagctgcgataaggtgatctacagcatagggacccctttgtgtttacagtgcaacttctgctggctctttcgtcttgttgagaatcctttcagtagagttagaaattataggagtggtcttcg

SEQ ID NO: 928 - DNA, 16511 bp, Brassica rapa
ccattgcatattggcacttatcgagtatagaatagatctgcttctctttcttcttatgaacagaattggcttcttatttttaatggaatgaaataaatattcgcgctttctgacacagaatcccctagaagggttaggtacataggatatggatagtctttttcaatgcgataaaataaagcgacatcgtgtctatttttctttgctaaaggggtatttccatgggtttgccttggtatcgtgttcatactgtcgtattgaatgatccgggtcgattgcttgcggtgcatataatgcacacagctctagtttctggttgggctggctcaatggctttatacgaattagcagtttttgatccctctgatcctgttctggatccaatgtggagacaaggtatgttcgtaattcccttcatgactcgtttaggaataacggattcgtggggtggttggagtatttcaggaggaactgtaacaaatccgggtatttggagttttatgaaggtgtggcaggtacgcatattgtgttttctggcttgtgtttcttggcagcgatctggcattgggtatattgggacctagaaatattctctgatgagcggacgggaaaaccctctttggatttgcccaagatctttggaattcatttatttcttgcaggggtggcttgctttggctttggggcatttcatgtaacgggtttgtatggtcctgggatatgggtatccgatccttatggactaactggaaaagtacaagctgtaaatccagcgtggggtgcagaaggttttgatccttttgttccggggggaatagcttctcatcatattgctgcgggtacattgggtatattagcgggcttattccatcttagtgtccgtccgcctcaacgtctatataaaggattacgtatgggcaatattgaaactgtactttccagtagtatcgctgctgttttttttgcagctttcgtagttgctggaactatgtggtatgggtcagcaacgaccccaatcgaattatttgggcctactcgttatcagtgggatcagggatactttcagcaagaaatatatcgaagagttagcaatggtttagccgaaaatcttagtttatcagaagcttggtctaaaattcccgaaaaattagccttttatgattatattggtaataatccggcaaaagggggattattcagagcaggctcaatggacaatggggatggaatagctgttggatggttaggacaccccgtctttagagataaagaaggacgtgagctttttgtacgccgtatgcctactttttttgaaacatttccggttgttttggtagatgaggagggaattgttagagcagacgttccttttagaagagcagaatccaaatatagtgttgaacaagtaggtgtaacggtggagttctatggtggcgaacttaatggagtaagttattctgatcctgctactgtaaaaaaatatgcgaggcgttctcaattaggggaaatttttgaattagaccgggctactttgaaatctgatggtgtttttcgcagcagtccaaggggttggttcacttttggtcatgctacctttgctttgctcttctttttcggacacatttggcatggcgctagaacattgttccgagatgtttttgctggtattgatccagatttggatgctcaagtggaatttggaacattccaaaaagtgggagatccaactacaaggaaacaggcagtctgatacacattgttatagtatctttcacctctcttttttgatttgacatgggaaacatctcccatcctttctttgactctttttctttctttatatgggaaattctcccaaatgacaaatgaataggtgtggaagttataattgtaaatataccaggatcgaatctatggaagcattggtttatacgttccttttagtttcgactttagggataatttttttcgctatcttcttccgagaaccacctaaggttccaccaactccaactaaaagaataaaataatttcatttaagtaagaagtccccctatctgggagacttcttacttaaattagtctccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacaccaatgattaaatagaatttatggctacacaaaccgttgaagatagttctaaacctaggccaaaacgaactggtgcaggtagtttactgaaacccttgaattcggaatatgggaaagtcgccccgggttgggggactactccttttatggggatcgcaatggctttattcgctatattcctatctatcattttagaaatttataattcttccgttttactggacggaattttaaccaattaggtttctactaactaaaactaggaagtcagagtttttccatccaaaaaagcctttctagtttaagatctacatttctagatattatggtagttcgaccgcggaatttttttggggactcgggttagttacctatctcaataaagtatatgattggtttgaggaacgtcttgagattcaggcaattgcagatgatataactagtaaatatgttcctccccatgtcaacatattttattgtttagggggaattacacttacttgttttctagtacaagtcgctaccggttttgctatgactttttactaccgaccaaccgttacagaggctttttcctcggttcaatacataatgaccgaggccaactttggttggttaatccgatcagttcatcgatggtcagcaagtatgatggttttaatgatgatcctgcatgtatttcgtgtgtatctcacagggggatttaaaaaaccccgtgaattaacttgggtcacaggtgtggttttggctgttttgactgcatcatttggtgtaactggttattctttgccttgggatcaaattggctattgggcagtcaaaattgtgacaggtgtacctgacgccattccggtaataggatcgcctttagtggagttattacgcggaagtgctagtgtgggccaatccactttgactcgtttttatagtttacatgcctttgtactgcctctgcttactgccgtatttatgttaatgcactttccaatgatacgtaagcaaggtatttcgggtcctttatagggaaggcatatcatagagaattataattatcatatatcatatcgggtaggttttggtatttcattgctacaagcatgggttattgtaaaataacacatgtcatttggatacttctcttcaactccaaagtatttttatacaatacaaatagttgaagttaattttacgaaagaaaaaaggcggattatgggagtgtgtgacttgaattattgatttggccatgcagataaagaattggatctgccacattagaattcacaaccaaaggtgtctccgcatccaatcaacatgtaagtcccctacctaggaaggataggctggttcacttgaggagaatatcttctatgatcataccgcaaccatgtcatccatgaacaggctccgtaagatcccatagagtagaaatggaataagtcatgtgacatgatccagttctctatttattacacttacctttttattatagtatggaaatgcattcattttctttgcatcgattgtgatccgcaatactatcggagtaaaagaagggatctaaggaagaatgtaggctaaactttttgattttttattagtaacaagtaaatattttgtttggaggtaagaaacttgcgatattgaggggataaataccaactaatcaagagacatgagacaatccacaaagcaattgatcatgatcaaatttgtaagcccacttggatattgagcatttacccataagaataggattattttcaatgagtagttgtaggtgcaacttcggaaaagagaatctgataaagcttttcttgcctagagtcattgagtcattataaaccttaattctattaaggatcttccgcggtcttatttctttcactcttgctcgagccggatgatgataaattctcatgtccggttcctttgggggatggatcctaaagagttcacctatcccaataacaaagaaaccagacttaaatgatcctgtattaagagctaaattagctaaagggatgggacataattattacggggaacccgcatggcccaacgatcttttatatatttttccagtagtaattctaggtactattgcatgtaatgtaggtttagcggttctcgagccatcaatgattggtgaaccggcagatccgtttgcaactcctctggaaatattacccgagtggtacttctttcccgtgtttcaaatactccgtacggtacccaataagttattgggcgttcttttaatggtttctgtgccaacaggcttattgacagtaccttttctagagaatgtcaataaattccaaaatccatttcgcaaaatccatttcgccgcccagtagctacgaccgtttttttaatcggtactgtagtagctctttggttaggtattggagcaacattacccattgataaatcattaactttaggtcttttttagatattttttgattcattcaaccgtgaagtaccataggtatctaggaaatagttacttccaagtgaatcttccctagatacctaaaatccattttattatgatccatttcgcgaaaatatagattgtaccaaagatgctaaattgttttctttttattctaactcgaaaaagaagaagaaaaaaaattgcagcaatggatttaaaacgagagtttattcttaagtaaatcaattgggagatgcttctctagagtgtcccatatatgttttctatcttccatacgaaaactgtcaattctcagaagatcttcttcagtcttactcaaaaggtccaatagtgtatgtatattggccctttttagacaattatacgttctagaagtcaattctaattgatcaataaaaatagaattcaatggaattccttttttgtttttctttagattagttaatcttttttgaaaagtaaaaaggggtggagtaaacctgtttttattttcttcgaaactagcgccctcttcctccgcgtgtagaaaaggaagaaataaatcaatcaaattacgagaagcctcataaagtgcttccttaggggttaaacttccattagtccatatttctagaaaaagtatctcgtgtttttcatttccattcccacaagaaaaaatactataattcacatttcgaacaggcatggatacagcatctataggataacttccatcttgatagttctttctgagttctgtctgatatccacgatctctcttgatctgtaaatcaatacagaaatcaatgggctctgtcaagttagctataggttgtgccgtatcaacgatttctacggaaggcggtaagatgatatcttgagcagttatgtatctaggacctttgacgcaaatggatgcgtctctaactccaactccatagagattacttctcaatacaatttctttcaaatttagtaaaatttcttgtacggattcttcaatacctgctattgtagaatactcgtgcggcacgctcccaaattttgcacgtgtgatacatgttccttctatttctccaagtaaagctcttcgcaaggcaataccgacggtgtccgcttgaccttttctaagcggggacagaatgaaacgaccataataaaggcgcttactatctactcttgattcaacacacttccactgtagtgtttgagtggatcctgctacctcctctcgaaccataatagactagtattattattttatcattgaatcgtttatttctcttgaaatgaaagttgaaagcgggttaattcttttacagacgtctttttttaggcgggcgacatccattatgcggcataggtgttacatcgcgtatacaacttaatcgcacaccacttttagcaatggctcgtaatgcggcatctcttccactaccagcgccctttaccataacttctgctcgttgcaaacctactgtacgaatagcatctactgctgttctttgaccagcatagggtgatgcttttcttgagcttttgaatccacaagtaccggccgaggaccaaaaaaccacccgaccttgtgggtctgtaacagttataatggtattgttgaaactagcttgaacatgaataaccccttttgttattctacgtgcactcttccgtaaactaaaacgtgcattcctacgtaaaccaatacgcactttcttacgtgaaccaatttttggtatagcttttgccatattttattatctcataaatatgagttagaaataaaaaaaagaaaaaaagatacaaagatatccgtttcagggtaaaataaaccctttactttaattattttaaatgaaattattttatttggaattggaacatttccgcgggtacttttttttactttttagaaagtaaagttctttttcgaaagattacccctgtctttgtttatgcttcggattagagcaaatgactctaattcgtccacgcctacgaatcagtcgacattttgtacaaattttacgaacggaagctcttattttcatatttccgtatccttttttaaactatgaatctaatcttttggaaaaaataagtctcttcgcttgaattttagaacttagaatttattaccctagaaaaaaaagaaaaacctaatcctttgaatctttggtatccttcaaatcttcgctatccttcaaatcttcgctatccttcgagtcttcgatacgcttcgaatccttatggggaagtctataaattatacgtcccttgcttgaatcataacgacttacttcaattttgaccctatccccccccccccccccccccgaactagaccgtatctttcctgaaatatagcctaggatgatggtgtcattctctagccgaacgcggaacattccattgggtagggcttccgtaactaaaccttcgaaagttacttttgcttctctcgggttttttttttctctcctattttttttttctgtcatattttttttcttctcctatttttctatttttattttaaaaataggaagggcgagatagaattcaagcactataggcggggcgattaccatatataacataagacttctcccccaattctgtttagtcgagcttctcgatctgtcattattcctcgagaagtagaaagaatagcaattcccattccacccaaaactttaggaattccttgatagttggtataaattcgtaagccgggtcggctgatacgctttaaaaaggttcttgttctatatattccttttctagtctttctcttttgatgtcgcaaagttgaaaccaagaaatatctgttacgttcctgatgtttccgaacactttcaataaaaccctctcgtagaagtattttaacaatgttttcggtaatatttgtagatactactcgaactgttccttttttattcatgtccgcatttcttatagaggttagtaaatcagcaatagtgtccttgcccataagactctaattctaggttcctcctaatttttctataatcaacatgttttctttttttttttcattttggattttaaaacatatacgtaaaacacaatctactaaattaattctttggtctcaatttcgcctactagtatttataatacttcaggagctaatgaaactattttggtaaaattcaattctctcaattcctcggcaatcgcgccaaaaactcgagttccttttggattgcctttttgatcaattataaccgcagcattgtcatcatagcggattattataccgtcttcgcatttgaactctttacatgtacgtacaattacagctcgaattacttcggatctttctagaggcatttggggcaatgcgtctttgattacagcaacaataacatcaccaatacgagcatatcgctgatttaccagcagctcctatgactcgaatacacatcaattttcgagctccactattatctgctacatttaaaagggtctgaggttgaatcatattattttttattttgatttcaatttgttatttcaatgcaaaaggatgaaagaaatattgtctttccagaaagaaaaaccgggcatttttttttatcttccataccccttttagggttctatatctctaatcgaataaattgacttcgtatgggcattttactggaagctatggagatagctgctctagctacagtttcagatactccccccatttcataaagtatacgaccaggtttaacaacggatacccaatattcgggggacccctttcccgagcccatacgtgtttccgtgggtcttagtgtaaccggtttgtcgggaaatatacgtacccatatttttccaccacgacgtgcatatcgtgttattgctcttcgtcctgcttctatctgtctcgccgtgatccaagcgggttcaagtgcttgaagagcatatctaccaaaacaaatacgattgcctcggcaggattttcctttcattcttcctctatgttgtttgcgaaatctggttcttttggggttatagtcgatggttctctttcttagttccatctctacttcaaaactggacatgagagtttcttctcatccagctcctcgcgaatggaatgagaaagcatgtaaatttctctaattcataatattcaaaaatattacggtacggatagatacacattaatagataatagaaaaagttcggttttttttatattgaatttgttaaaacagaaaaatataatatatagtcaaaaaagaagatctagaatatatccagatgtgtgtgtatatttatctaaattctatatttatagataatgtaatccttcttaaaaaaatccttatttttactcttattgaatcgcggtaaagtattctaattcaataagaatttcgcgggcgaatatttactctttcctgtcttatttgttaatttataaacttaccaaataagacaatttttttggtttgttccgccatcccacccaatgaagtgttaggattcttttcaataaaatcctatggaatcataggttctgtcgttcccactgcttctccttgaatggttaggtctgaatcccgcaacggagcttccaaaaaatttctttccgagttaattttctcagttttattaacccgggcggctctttattattgctttaaatttgtagttcttgtttcaagttacaatttttaattctctattatttttattatattgatgctttatcacattgccttttatgatgtaattcatagaccatacatagtggaatcctatatcttatttatttcctcttccttctttctatcatccctccctttatccacatccctttagttttgcttcacaacctagaatcccccccttcacaacctagaatcccttttcttttttagagaaaaaattgcagttgctacaactatatgacacatctactcatttatgatagaggtatttattcatatagtgactgtttcttagttaggatctcgacaatacgaagcaataggttggttattagttaattttctataattactaagtttttttcttaaaaaaaagaaaaaaataacgagtcacacactaagcatagcaattatattaaatgatttatcaattttcattaaatcttatagaaagaggtataatttcttcttttgcagggatttcaggaaaaaagtctcttgtcattttttattctatcaatggacagaatccgaagacaagattacttattcttcgtctacgaatatccaaatttttacacctaatactccatagatagtccgaattggatagcagcaataatcaattttagcgcgaattgtttggaggggaagtctaccctttttaatagattcggcgcgtgcaatttcttttcctccgagacgacccgcaatttttacttttactccccttatatctgcttttttagttaattcaatggcttttttcattgcctttcggaatgaaactctattttttaattggaaagctatatattctgcaagaatgttaggctgtctataaggttctttcgctttttcgatagaaatattaaatctctggtttacagagttaatttccttttgtagatctttctctaattcttcgattgctccttttttctttaataaatttgggaatccaatatggattatgacgtggatcgtatcgatttctttttggatttctatatgtgtaattacttcggaacttgaacctgatctgattctatttttctattcgagccctttttcctattcttttgtatatagttcttgatacaatcccttatttttttatcttcctgtagaccttcagaataattttttggttgtgcgaaccaaaaggaatggtgtttttgggttgtaccaagtctgaaaccgagtggatttattttttgtcccatatttttctattctatatttttttttactgggaatcgaaatcttagatggatctaaaggttatttagatttctttactatatttagtacaattgttatatgacacatgcttttttttatggggaaactacgtcctcgagctcgaggtctgaatttcttcataatagtactcctactgacttcggctttagtaataaataaattcgctttgtcgaaatccctataatgagtagcatttgcggctgccgaataaaccaactttaagatgggataagatgctcgatagggcatgaggttcagtatcataacagtttcctcgtagtaacgccagcgaatctcgtcaagaactctttgtgctttgaaaacagacatagggatacgtttttgtgctttgaaaactctctcgaacttaagtagacgatcggttggaactttccttgcgagtttccttagcccacttttcttcttctttatcctagggatatactttactagtttgaaacttgtcataaataaggttattccccgcctacctttactttattttgaatcttttttttcttcttaatctttctattcagaattcagttaacgacgagatttagtatcctttcttgcattttcataactcgtgaaatgccgagtaggcacgaattcccccaatttgcgacctaccataggatttgttatgtaaataggtatatgttcctttccattatgaatcgcgattgtatggccaaccattgtgggtagaatgctagatgcccgggaccacgttactattgtttctttctcctccttcatattgaccttttctatctttgccaataaatgatgagctacaaaaggattcgttttttttcgtgtcacagctgattactccttttttcctttttaaagagtggcattctatgtccaatatctcgatcgaagtacggaggtcagaataaatagaataatgatcaatggaaaaaagcaaaaaatcctttagctggataaggggcggatgtagccaagtggatcaaggcagtggattgtgaatccaccatgcgcgggttcaattcccgtcgttcgcccatcgcattattgcaaattccaaaaatgcaattttccatattcctagttacgtatttacttacggcgacgaagaataaaactatcgctatattttttccttttcctagttcttcttccaagcgcaggataaccccaaggggttgtgggtttttttctaccaatgggagctttcccttcaccgcccccatgggggtggtccacagggttcataactacccctcttactacggggcgtttacctagccaacacttagatccggctctacccaaacttttttggttcaccccaacattacccacttgtccgactgttgctaagcagttttgggatactaaacggacctccccagatggtaatcttaaagtggccgatttaccctcttttgcaatgagtttcgctacagcacctgctgctctagctaattgcccaccccttccacgtgtgatttctatgttatgcatggccgtgcctaagggcatatcggttgaagtagggcatttcccattgatataggaacttttgtaccagaaacaatagtatctccaattatagcccctctgggatgtaaaatatatctcttctcaccatccccatagtgtatgagacaaatgtatgcatttcgattagggtcgtattctatggttacgattctaccatatatgtcttttgtatttcgtcgaaaatctattttacggtataggcgcttatgacctccccctctatgccttacggtaatgattcctctggcattacgacctttaccacaatgatgctgcccatagatcaaattatttcgtggattggatttcacttgactgtctacggctccattcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatggcccagaataggtcctattcttctaccttttccaggtagtcgatggctattcacagctaccaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaatgttcccgttcgtgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattccgagatggcaaatattcggagatgactatgaaaacacctctctggatcctcgaattgaaagagagattgagagggatcaagaatcctaattctcgctatttggaatggatccaattctattgagtctgactcatagtgatcatttctctttagcaaagaatgaccttggttatcaaaggattgaacaaccgggatccatttacttatgatacctagttggcattgataacaaggatctaatgaattatgagtttaatagatcctctttagcagaaagacgtatattccttgctcattatcagacaatcacttattcccaaacctcgtgtgggactaatcgttttcatttaccatctcatggaaaacccttttcgttccgcttagccctatcgggtattttagtgataggttctgtaggaactggacgatcctatttggtcaaatacctaacgaaaaattacgattttcctttcattaaggtacgagggcttcttattccacaagaacgaaagcaccttttcattctttcatatactaggggtttttacttggaaaagacaatgttccatactaaaggattcgggtccataaccacgagttccagtgcactagatcttgtagcacttagcaacgaagccctatccattagtattccacataagaaatccattctagaaaaaaatacaattagattagctcttcatagacaaacttggggtttgcgagccaaggtaagatcggctcgggatcatgggacccttttctatcagataggaggggctcttgtacaaaatagacttactaagtaataaccccatagaatctatctatataaagataaagaggcaatcgtgtcaggaagcgggtttttctttggccaaaaggtacttcgaacttggaacgagcatgaagagattaacgagacttctttctcttttgagtttttctggcggacctgccgcgcaagatctttggtcttcccctggaaccgatgaaaaaaagtggatcgcttcttatgtactcgctcagaatgattcttctctatctatagttcatggcctattagaagtagaaggtgctctggtgcaatccttaccgacagaaaaagattgcagtcaggttgataatagtcgagtgacattacttcgtcggtccgaactaaggaatctgttagaaatgttttgaaatggatattgttctctctttgatcagggattgctatatgaaaagaagtggagtttgaaaaagggaacggaatgctcaaaccggaactgctagaggaacgaattttcaatagcataacttgggctcctagaatatggcgcccttgggacaatctatttgattgcagggttttgttccgaagcaaagatatccgcggaggccggttcgttcgtcctattctgatattcaggaccaagaggtactggattctctttcggataggccctgaaaggagaagaaaggctgaaatgccaacggacctctgtctattctctaattcacccgatccgatagtacccgtttttggaacgtccagtgccaaagtcactgaatgggtaagtcaccaatccaatccctttgacaaatcggatgtcatattagatatcatattctatatatatagaaatatcatagatagaatagacatatagaatttttggtcggcaaattcgaaggaatcattgagtgaaaaaggagcaaagaatgacaaaagacgagactctactagtcttcactcttgtggtttcctcttcctcggtttctgttttcttattcgggatcttgcttttcatggttctcatctctgcaactcgcgattttcgcgagagaaccaaatccaagttggtgaagatcatgatttgggctggcacggggatcgtttgatcgatttccttgatttgatcgctacttaatgggcgtgcgctcaaaggatacaaacagggattcgcaaacaaaaaggggaattcgtagtcactttttcctgtcgcgtaaaaaaaaagtctttacgcgagagcaatagaggttgggatacatctatctcttctgagcaacctcttttggattcttaagaccacccttgcagtaggataccatctgctttgggttctttattatctccttcgagggatttttaggatcgttcaggctatatatatttagtctattttggcttttactgtctacttttctcagggagatggttaaggacctcagaagatagaggagagcgccaggcccagatttccggaatacttctacggggaatgctcattgaatgagcattctccatattatgccttgaagaggactcgaacctccacgctcttcagcacgagattttgagtctcgcgtgtctaccatttcaccatcaaggcatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcgatatcaaaatcaaaaagatgaaagatgtacaatccaatttctcgattcaatagaagcccaaagaggtgcatatggtacccaaataagaataggatagatatgtcaaaagcaggtctgattacacctattcctaatcctaaatagaatgtaaggacgtagggatttctatgtaaacagagtatcctatttccataggctcgaatgaccccttctcataataagaatgtgcacggtctggttcggtatggaatgaacttataatctgatgatcgagtcgattccatgattataagttcataaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgattatttttagataatagtagatagaaagaacgctcgtaaggagtcctattgaaaccaagaaatataggcctgcctgccatccacaccagaatagatagagttttccgaagaaacctgctagtggaggaaggcctcctaggg

SEQ ID NO: 929 - DNA, 7401 bp, Brassica rapa
ccctaggaggccttcctccactagcaggtttcttcggaaaactctatctattctggtgtggatggcaggcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggttatgaacttataatcatggaatcgactcgatcatcagattataagttcattccataccgaaccagaccgtgcacattcttattatgagaaggggtcattcgagcctatggaaataggatactctgtttacatagaaatccctacgtccttacattctatttaggattaggaataggtgtaatcagacctgcttttgacatatctatcctattcttatttgggtaccatatgcacctctttgggcttctattgaatcgagaaattggattgtacatctttcatctttttgattttgatatcgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatgccttgatggtgaaatggtagacacgcgagactcaaaatctcgtgctgaagagcgtggaggttcgagtcctcttcaaggcataatatggagaatgctcattcaatgagcattccccgtagaagtattccggaaatctgggcctggcgctctcctctatcttctgaggtccttaaccatctccctgagaaaagtagacagtaaaagccaaaatagactaaatatatatagcctgaacgatcctaaaaatccctcgaaggagataataaagaacccaaagcagatggtatcctactgcaagggtggtcttaagaatccaaaagaggttgctcagaagagatagatgtatcccaacctctattgctctcgcgtaaagactttttttttacgcgacaggaaaaagtgactacgaattcccctttttgtttgcgaatccctgtttgtatcctttgagcgcacgcccattaagtagcgatcaaatcaaggaaatcgatcaaacgatccccgtgccagcccaaatcatgatcttcaccaacttggatttggttctctcgcgaaaatcgcgagttgcagagatgagaaccatgaaaagcaagatcccgaataagaaaacagaaaccgaggaagaggaaaccacaagagtgaagactagtagagtctcgtcttttgtcattctttgctcctttttcactcaatgattccttcgaatttgccgaccaaaaattctatatgtctattctatctatgatatttctatatatatagaatatgatatctaatatgacatccgatttgtcaaagggattggattggtgacttacccattcagtgactttggcactggacgttccaaaaacgggtactatcggatcgggtgaattagagaatagacagaggtccgttggcatttcagcctttcttctcctttcagggcctatccgaaagagaatccagtacctcttggtcctgaatatcagaataggacgaacgaaccggcctccgcggatatctttgcttcggaacaaaaccctgcaatcaaatagattgtcccaagggcgccatattctaggagcccaagttatgctattgaaaattcgttcctctagcagttccggtttgagcattccgttccctttttcaaactccacttcttttcatatagcaatccctgatcaaagagagaacaatatccatttcaaaacatttctaacagattccttagttcggaccgacgaagtaatgtcactcgactattatcaacctgactgcaatctttttctgtcggtaaggattgcaccagagcaccttctacttctaataggccatgaactatagatagagaagaatcattctgagcgagtacataagaagcgatccactttttttcatcggttccaggggaagaccaaagatcttgcgcggcaggtccgccagaaaaactcaaaagagaaagaagtctcgttaatctcttcatgctcgttccaagttcgaagtaccttttggccaaagaaaaacccgcttcctgacacgattgcctctttatctttatatagatagattctatggggttattacttagtaagtctattttgtacaagagcccctcctatctgatagaaaagggtcccatgatcccgagccgatcttaccttggctcgcaaaccccaagtttgtctatgaagagctaatctaattgtatttttttctagaatggatttcttatgtggaatactaatggatagggcttcgttgctaagtgctacaagatctagtgcactggaactcgtggttatggacccgaatcctttagtatggaacattgtcttttccaagtaaaaacccctagtatatgaaagaatgaaaaggtgctttcgttcttgtggaataagaagccctcgtaccttaatgaaaggaaaatcgtaatttttcgttaggtatttgaccaaataggatcgtccagttcctacagaacctatcactaaaatacccgatagggctaagcggaacgaaaagggttttccatgagatggtaaatgaaaacgattagtcccacacgaggtttgggaataagtgattgtctgataatgagcaaggaatatacgtctttctgctaaagaggatctattaaactcataattcattagatccttgttatcaatgccaactaggtatcataagtaaatggatcccggttgttcaatcctttgataaccaaggtcattctttgctaaagagaaatgatcactatgagtcagactcaatagaattggatccattccaaatagcgagaattaggattcttgatccctctcaatctctctttcaattcgaggatccagagaggtgttttcatagtcatctccgaatatttgccatctcggaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacacgaacgggaacattccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtggtagctgtgaatagccatcgactacctggaaaaggtagaagaataggacctattctgggccatacaatgcattacagacgtatgatcattacccttcaaccgggttattctattccacttctagatagagaaaaaaactaaaggagaatacttaataatacggcgaaacatttatacaaaacacctatcccgagcacacgcaagggaatggagccgtagacagtcaagtgaaatccaatccacgaaataatttgatctatgggcagcatcattgtggtaaaggtcgtaatgccagaggaatcattaccgtaaggcatagagggggaggtcataagcgcctataccgtaaaatagattttcgacgaaatacaaaagacatatatggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtagccaattaggtttacggcgaagcctagaaatcgatcactgatccaatttgactacctctacgggatagacctcaacagaaaactgttgagtaacggcagcaagtgattgagttcagtagttcctcatagaaaattattggctctagagatatggtaatatggagaagacaaaattgtttgaagcacgcacagaaccgtaagcgccccttgtttcaaagagaggaggacgggttattcacatttaatttgatggtcagaggcaaattgaaagctaagcagtggtaattaagacccccgggggaaaatagggatgtctcctacgttacccataatatgtggaagtatcgacgtaatttagtcgagacattagatatgaatgctacatgaagaacataagccagatgacggaacgcagagacctaggatgtagaagatcataacatgagcgattcggcagatttggattcctttcctatatatccactcatgtggtacttcatcatatgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatgcataacatagaaatcacacgtggaaggggtgggcaattagctagagcagcaggtgctgtagcgaaactcattgcaaaagagggtaaatcggccactttaagattaccatctggggaggtccgtttagtatcccaaaactgcttagcaacagtcggacaagtgggtaatgttggggtgaaccaaaaaagtttgggtagagccggatctaagtgttggctaggtaaacgccccgtagtaagaggggtagttatgaaccctgtggaccacccccatgggggcggtgaagggaaagctcccattggtagaaaaaaacccacaaccccttggggttatcctgcgcttggaagaagaactaggaaaaggaaaaaatatagcgatagttttattcttcgtcgccgtaagtaaatacgtaactaggaatatggaaaattgcatttttggaatttgcaataatgcgatgggcgaacgacgggaattgaacccgcgcatggtggattcacaatccactgccttgatccacttggctacatccgccccttatccagctaaaggattttttgcttttttccattgatcattattctatttattctgacctccgtacttcgatcgagatattggacatagaatgccactctttaaaaaggaaaaaaggagtaatcagctgtgacacgaaaaaaaacgaatccttttgtagctcatcatttattggcaaagatagaaaaggtcaatatgaaggaggagaaagaaacaatagtaacgtggtcccgggcatctagcattctacccacaatggttggccatacaatcgcgattcataatggaaaggaacatatacctatttacataacaaatcctatggtaggtcgcaaattgggggaattcgtgcctactcggcatttcacgagttatgaaaatgcaagaaaggatactaaatctcgtcgttaactgaattctgaatagaaagattaagaagaaaaaaaagattcaaaataaagtaaaggtaggcggggaataaccttatttatgacaagtttcaaactagtaaagtatatccctaggataaagaagaagaaaagtgggctaaggaaactcgcaaggaaagttccaaccgatcgtctacttaagttcgagagagttttcaaagcacaaaaacgtatccctatgtctgttttcaaagcacaaagagttcttgacgagattcgctggcgttactacgaggaaactgttatgatactgaacctcatgccctatcgagcatcttatcccatcttaaagttggtttattcggcagccgcaaatgctactcattatagggatttcgacaaagcgaatttatttattactaaagccgaagtcagtaggagtactattatgaagaaattcagacctcgagctcgaggacgtagtttccccataaaaaaaagcatgtgtcatataacaattgtactaaatatagtaaagaaatctaaataacctttagatccatctaagatttcgattcccagtaaaaaaaaatatagaatagaaaaatatgggacaaaaaataaatccactcggtttcagacttggtacaacccaaaaacaccattccttttggttcgcacaaccaaaaaattattctgaaggtctacaggaagataaaaaaataagggattgtatcaagaactatatacaaaagaataggaaaaagggctcgaatagaaaaatagaatcagactcaagttccgaagtaattacacataatagaaaaatggactcaggttcaagttccgaagtaattacacatatagaaatccaaaaagaaatcgatacgatccacgtcataatccatattggattcccaaatttattaaagaaaaaaggagcaatcgaagaattagagaaagatctacaaaaggaaattaactctgtaaaccagagatttaatatttctatcgaaaaagcgaaagaaccttatagacagcctaacattcttgcagaatatatagctttccaattaaaaaatagagtttcattccgaaaggcaatgaaaaaagccattgaattaactaaaaaagcagatataaggggagtaaaagtaaaaattgcgggtcgtctcggaggaaaagaaattgcacgcgccgaatctattaaaaagggtagacttcccctccaaacaattcgcgctaaaattgattattgctgctatccaattcggactatctatggagtattaggtgtaaaaatttggatattcgtagacgaagaataagtaatcttgtcttcggattctgtccattgatagaataaaaaatgacaagagacttttttcctgaaatccctgcaaaagaagaaattatacctctttctataagatttaatgaaaattgataaatcatttaatataattgctatgcttagtgtgtgactc

SEQ ID NO: 930 - DNA, 1553 bp, Triticum aestivum
tcaacgcagagtacgcggggaatacgattcactttcaagatgccttgatggtgaaatggtagacacgcgagactcaaaatctcgtgctgaagagcgtggaggttcgagtcctcttcaaggcataatatggagaatgctcattcaatgagcattccccgtagaagtattccggaaatctgggcctggcgctctcctctatcttctgaggtccttaaccatctccctgagaaaagtagacagtaaaagccaaaatagactaaatatatatagcctgaacgatcctaaaaatccctcgaaggagataataaagaacccaaagcagatggtatcctactgcaagggtggtcttaagaatccaaaagaggttgctcagaagagatagatgtatcccaacctctattgctctcgcgtaaagactttttttttacgcgacaggaaaaagtgactacgaattcccctttttgtttgcgaatccctgtttgtatcctttgagcgcacgcccattaagtagcgatcaaatcaaggaaatcgatcaaacgatccccgtgccagcccaaatcatgatcttcaccaacttggatttggttctctcgcgaaaatcgcgagttgcagagatgagaaccatgaaaagcaagatcccgaataagaaaacagaaaccgaggaagaggaaaccacaagagtgaagactagtagagtctcgtcttttgtcattctttgctcctttttcactcaatgattccttcgaatttgccgaccaaaaattctatatgtctattctatctatgatatttctatatatatagaatatgatatctaatattacatccgatttgtcaaagggattggattggtgacttacccattcagtgactttggcactggacgttccaaaaacgggtactatcggatcgggtgaattagagaatagacagaggtccgttggcatttcagcctttcttctcctttcagggcctatccgaaagagaatccagtacctcttggtcctgaatatcagaataggacgaacgaaccggcctccgcggatatctttgcttcggaacaaaaccctgcaatcaaatagattgtcccaagggcgccatattctaggagcccaagttatgctattgaaaattcgttcctctagcagttccggtttgagcattccgttccctttttcaaactccacttcttttcatatagcaatccctgatcaaagagagaacaatatccatttcaaaacatttctaacagattccttagttcggaccgacgaagtaatgtcactcgactattatcaacctgactgcaatctttttctgtcggtaaggattgcaccagagcaccttctacttctaataggccatgaactatagatagagaagaatcattctgagcgagtacataagaagcgatccactttttttcatcggttccaggggaagaccaaagatcttgcgcggcaggtccgccagaaaaactcaaaagagaaagaagtctcgttaatctcttcatgctcgttccaagttcgaagtaccttttggccaaagaaaaa

SEQ ID NO: 931 - DNA, 1566 bp, Brachypodium distachyon
ggatcaatttggaatggatccaattctattgagtctgactcatagtgatcatttctctttagcaaagaatgaccttggttatcaaaggattgaacaaccgggatccatttacttatgatacctagttggcattgataacaaggatctaatgaattatgagtttaatagatcctctttagcagaaagacgtatattccttgctcattatcagacaatcacttattcccaaacctcgtgtggggctaatcgttttcatttaccatctcatggaaaacccttttcgttccgcttagccctatcgggtattttagtgataggttctataagaactggacgatcctatttggtcaaatacctaacgaaaaattacgattttcctttcattaaggtacgagggcttcttattccacaagaacgaaagcaccttttcattctttcatatactaggggtttttacttagaaaagacaatgttccatactaaaagattcgggtgcataaccacgagttccagtgcactagatcttgtagcacttagcaacgaggccctatccattagtattccacataagaaatccattatagaaaaaaatacaattagattaactcttcatagacaaacttgtggtttgcgagccaaggtaagatcggctcgggatcatgggacctttttctatcagataggaggggctcttgtacaaaatagacttataagtaataaccccatagaatcaatctatctatataaagaggcgatcgtgtcaggaagcgggtttttctttggccaaaaggtacttcgaacttggaacgagcatgaagagattaacgagacttctttctcttttgcgtttttatggcggacctgccgcgcaagatctttggtcttcccctggaaccgatgaaaaaaagtggatcgcttcttatggactcgctcagaatgattcttctctatctatagttcatggcctattagaagtagaaggtgctctggtgcaatccttaccgacagaaaaagattgcagtcaggttgataataatcgagtgccattacttcgtcggtccgaaccaaggaatccgttagaaatgttttgaaatggatattgttctctctttgatcagggattgctatatgaaaagaagtggagtttgaaaaagggaacggaatggtcaaaccggaactgctagaggaacgaattttcaatagcataacttgggctcctagaatatggcgcccttgggacaatccatttgattgcagggttttgttccgaagcaaagatatccgcggaggccagttcggtcgtcctattctgatattcaggaccaagaggtactggattctctttcggataggccctgaaaggagaagaaaggctgaaatgccaacggacctctgtctattctctaattcacccgagccgatagtacccgtttttggaacgtccagtgccaaagtcactgaatgggtaagtcaccaatccaacccctttgacaaatcgggtgtcatattagatatcatattctatatatatagaaatatcatagaatagacatatagaatttttgg

SEQ ID NO: 932 - DNA, 668 bp, Brachypodium distachyon
tgaaaaaaagtggatcgcttcttatggactcgctcagaatgattcttctctatctatagttcatggcctattagaagtagaaggtgctctggtgcaatccttaccgacagaaaaagattgcagtcaggttgataataatcgagtgccattacttcgtcggtccgaaccaaggaatctgttagaaatgttttgaaatggatattgttctctctttgatcagggattgctatatgaaaagaagtggagtttgaaaaagggaacggaatggtcaaaccggaactgctagaggaacgaattttcaatagcataacttgggctcctagaatatggcgcccttgggacaatccatttgattgcagggttttgttccgaagcaaagatatccgcggaggccagttcgttcgtcctattctgatattcaggaccaagaggtactggattctctttcggataggccctgaaaggagaagaaaggctgaaatgccaacggacctctgtctattctctaattcacccgagccgatagtacccgtttttggaacgtccagtgccaaagtcactgaatgggtaagtcaccaatccaacccctttgacaaatcgggtgtcatattagatatcatattctatatatatagaaatatcatagaatagacatatagaatttttgg

SEQ ID NO: 933 - DNA, 1312 bp, Pseudoroegneria spicata
  misc_feature (8)..(11): n is a, c, g, or t
caagcccnnnnagcagcgtaccaacacggcagcacccgccgctcgcccgccatgtcgtccgccgcgccggcgccggaagagcagccgccgcgcccggtgcgcttcggcatcatgggctgcgcctccatcgcgcgcaagctcgcgcgggccatgctgctcgccgcgcccgccgccgccgtggccgccgtcggcagccgctccgaggccaaggcgcgcctcttcgccgccgacaacggcctccccgcgggcgcgcgcctgcacggctcctacgaggcgctcctcgacgacccgggcgtcgacgctgtctacctgccgctgcccaccagcctccacgtgcagtgggccaccgccgccgccgcgcggggcaagcacgtgctcctcgagaagcccaccgcgctctgcgccgccgacctcgacgccatcctcgccgcctgcgacgccagcggcgtccagttcatggactccaccatgtggatgcaccacccccgcaccgccaagatgcgcgagctcctccccgccgacgtcggcgacgtcagagtcataaacagtctgttcagcttccgagcaaatgaagatttcctccagaatgacatcagggtaaagccagatctcgacgccctgggtgcactcggagatgccgggtggtactgcatccgtgcgatcctgtgggccgtcgactacgagctcccgaagaacgtgatcgcgctccccgaccctgtcaagaacaaagccggcgtgctcatcgcctgtggcgcgacgctctactgggctgatggcaagatcgccaccttccactgctctttcctcaccaacctcacatggacctgaccgtcatcggcacggacggcactctccatgtcactgacttcatcatcccatacgaagagaagtctggcccgttcagcgtggcgtccaggtcgaacttcgccgagctccacaccggatgggttccgcagccgagcaagcacgttgtcatgacagacctgccgcaggaggccctgatggtcaaggagttctgcagactggtgcagggcattagagacgccggcgctaaacctgagagcaagtggcctgccatcacccggaagacacaggttgtgatggatgcggtgaaagcttccattgacaatggattcaaatcggtcgatgtctccagctgaataaaatacatcaccggtcattcgggtattatttgctcagactgtacttctacgcggcatgaaactacttatgttgaaataactcgaatgattcttgtcgtgccgaggacggtattgcaggtatcaagttaaaaatgtcgtattactacgta

SEQ ID NO: 934 - DNA, 1398 bp, Leymus cinereus x Leymus triticoides
  misc_feature (222)..(222): n is a, c, g, or t
  misc_feature (440)..(440): n is a, c, g, or t
  misc_feature (740)..(740): n is a, c, g, or t
  misc_feature (943)..(943): n is a, c, g, or t
  misc_feature (1315)..(1315): n is a, c, g, or t
aaagcccacgagtcactcgtcgcactagctcctacaccacacaccccggacacaagcccacccccagcgcccctaccaacacccgccgctcgcccgccatgtcgtccgccgcaccggcgccagagcagccgccgcgcccggtgcgcttcggcatcatgggctgcgcctccatcgcgcgcaagctcgcgcgggccatgctgctggccgcgcccgccgccgccntggccgccgtcggcagccgctccgaggccaaggcgcgcctcttcgccgccgacaacggcctccccgcggacgcgcgcctgcacggctcctacgaggcgctcctcgacgacccgggcgtcgacgccgtctacctgccgctccccaccagcctccacgtccagtgggccaccgccgccgccgcgcggggcaagcacgtgctcctcgagaagcccaccgcnctctgcgccgccgacctcgacgccatccttgccgcctgcgagaacagcggcgtccagttcatggactccaccatgtggatgcaccatccccgcaccgccaagatgcgcgagctcctccccgccgacgtcggcgacgtcagagttataaacagtctgttcagctttcgagcaaatgaagatttcctccagaatgacatcagggtgaagccagacctcgacgccctgggcgcactcggcgatgccgggtggtactgtattcgcgcgatcctgtgggccgtcgactacgagcttcctaagaangtgatggcgctccctgaccctgtgaagaaccaagccggcgtgctcatcgcctgtggcgcaacgctctactgggccgatggcaagatcgccaccttccactgctctttcctcaccaacctcaccatggacctgaccatcgtcggcacagacggcactctccatgtcaccgacttcgtcatcccgtacgaagagaagtctggccngttcagcgtggcctccaggtcgaacttcgccgagctccacaccggatgggttccgcagccgagcaagcacgttgtcatgacagacctgccgcaggaggccctgatggtcaaggagttctgcagactagtgcaaggcattagagacgccggcgccaagcctgaggggaagtggccggccatcaccaggaagacacaggttgtgatggatgcggtgaaagaatccattgacaatggattcaaatccgtcgatgtcgccagctgaataaaacacatcaccggtcattccggtaatatgtttttccagaccaggcatgaaactacttactgaaattactaagtgattcttgtcgtgccaaggacggtattgcagtnatcaagtttaaaatgccgtattactacgggtttattgtttgtgatatctggggtatatggatgctttgcatgatctacgtaca

SEQ ID NO: 935 - DNA, 1324 bp, Secale cereale
tcaggtcactcgtcgcgctacctcctacgccacacacacaccggacacaggcccaccaaccagcacccgccgcccgcccgccatgtcgtccgccgcgccggcgccggaggagcaggggccgcgcccggtgcgcttcggcatcatgggctgcgcgtccatcgcgcgcaagctcgcgcgggccatgctgctggccgcgcccgcggccgccgtggccgccgtcggcagccgctccgaggccaaggcgcggctcttcgccgccgacaacggcctcccggcggacgcgcgcctgcacggctcctacgaggcgctcctcgacgacccggccgtcgacgccgtctacctgccgctccccaccagcctccacgtgcggtgggccaccgccgccgccgcgcggggcaagcacgtgctcctcgagaagcccaccgcgctctgcgccgccgacctcgacgccatcctcgccgcctgcgacgccggcggcgtccagttcatggactccaccatgtggatgcaccacccccgcaccgccaagatgcgcgacctcttccccgccgacgtcggcgacgtcagagttataaacagtctgttcagctttcgagcaaacgaagatttcctccagaatgacatcagggtaaagccagaccttgacgccctgggcgtacttggtgatgccgggtggtattgcatccgtgcgatcctgtgggccgtcgactacgagcttccgaagaacgtgatcgcgctccctgaccctgtcaagaacaaagccggcgtgctcatcgcctgtggcgcggcgctctactgggccgatggaaagatggccaccttccactgctcgttcctcgccaacctcaccatggacctgaccgtcatcggcacggacggcacgctccatgtcaccgacttcatcatcccgtacgaagagaagtccggcccgttcagcgtggcctccaggtcgaacttcgccgagctccacaccggatgggttccgcagccgagcaagcacgttgtcacgacagacctaccgcaggaggccctgatggtcagggagttctgcaggctggtgcagggcatcagagacggcggcgccaagcctgagggaaagtggccggccatcaccaggaagacacaggttgtgatggacgccgtgaaagcttccattgacaacggattcaaatcggttgatgtcgccagctgaatttaaaacacatcaccggtcatttcggcattatgtttctccagaccatggcgtaatctgctcagactgtacttctacacggcatgaaactacttatatatattgaaataactcaaatgattcttgtcagtc

SEQ ID NO: 936 - DNA, 1315 bp, Secale cereale
cgccatgtcgtccgccgcgccggcgccggaggagcagccgccacgcccggtgcgtttcggcatcatgggctgcgcctccatcgcgcgcaagctcgcgcgggccatgctgctcgccgcgcccgcctgcgccgtggccgccgtcggcagccgctccgaggccaaggcccgcctcttcgccgccgacaacggcctccccgcggaagcgcgcctgcacggctcctacgaggcgctgctcgacgacccggccgtcgacgccgtctacctgccgctccccaccagcctccacgtgcagtgggccaccgccgccgccgcgcggggcaagcacgtgctcctcgagaagcccaccgcgctctgcgccgccgacctcgacgccatcctcgccgcctgcgacgccggcggcgtccagttcatggactccaccatgtggatgcaccacccccgcaccgccaagatgcgcgacctcctccccgccgacgtcggcgacgtcagagttataaacagtatgttcagcttccgagcaaacgaagatttcctcgagaatgacatcagggtaaagccagacctcgacgccctgggcgcgctcggcgatgccgggtggtactgcatccgcgcgatcctgtgggccgtcgactacgagcttccgaagaacgtgatcgcgctctctgaccccgtcaagaaccaagccggcgtgctcatcgcctgtggcgcgacgctctactgggccgatggcaagatggccaccttccactgctcgttcctcgccaacctcaccatggacctgaccgtcgtcggcacggacggtaccctccacgtcaccgacttcatcatcccgtacgaagagaagtccggcccgttcagcgtggcctccaagtcgaacttcgccgagctctccatcggatgggttccgcagccgagcaagcacgttgtcatgacggacctgccacaggaggccctcatggtccaggagttctgcaggctggtgcggggcatcagagacgccggcgccaagcctgaggggaagtggccggccatcacccggaagacgcaggttgtgatggatgcggtcaagacttccatcgacaacggatttgggtctgtcgatgttgtgagctgaagtacaacacacagcttgtcgtatgtgttccaagccatggcgcatagctggccattccggtgatcttccaggccatggagtgtaggttgtatgtttgctcaaatcgtacttgtaacgcagcgccaaactacttatattggaataataactcgaatgattcttgccatattatgaacacacagttgaatggcatattattat

SEQ ID NO: 937 - DNA, 1443 bp, Triticum aestivum
ccacgcgtccgactagttctagatcgcgctctctgaccctgtcaagaaccaagccggcgtgctcatcgcctgtggcgcgacactctactgggccgacggcaagatggccaccttccactgctcacacacacacacaaagcccacccggcgccgaagcaacacgcgcacctgccgcttgccatgtcgtccgccgcgccggcgccggaggagcagcggccacgcccggtgcgcttcggcatcatgggatgcgcgtccatcgcgcgcaagctcgcgcgggcgatgctgctggccgcgcccgcgggcgccgtgaccgccgtcggcagccgctccgaggccaaggcgcgcctcttcgccgccgacaacggcctccccgcgaaagcgcgcctgcacggctcctacgaggcgctcctcgacgacccggccgtcgacgccgtctacctgccgctccccaccagcctccacgtgcagtgggccaccgccgccgccgcgcggggcaagcacgtgctcctcgagaagcccaccgcgctctgcgccgccgacctcgacgccatcctcgccgcctgcgacgccagcggcgtccagttcatggactccaccatgtggatgcaccacccccgcaccgccaagatgcgcgacctcctccccgccgacgtcggcgacgtcagagttataaacagtctgttcagcttccgagcaaacgaagatttcctccagaatgacatcagggtgaagccagacctcgacgcgctgggcgtactcggcgatgccgggtggtactgcatccgcgcgatcctgtgggccgtcaactacgagctcccgaagaacgtgatcgcgctccccgaccctgtcaagaaccaagccggcgtgctcatcgcctgcggcgcgacgctctactgggccgacggaaagacggccaccttccactgctcgttcctcgccaacctcaccatggacctgaccgtcgtcggcaccgacggcacgctccacgtcaccgacttcatcatcccgtacgaggagaagtccggcccgttcagcgtggcgtccaggtcgaacttcgccgagctccacaccgggtgggttccgcagcccagcaggcacgtcgtcacgactgacctgccgcaggaggccctgatggtccaggagttctgcaggctggtgcagggcatcagagacgccggcgccaagcctgagggcaagtggccggccatcaccaggaagacgcaggttgtgatggacgcggtgaaggcttccattgacaagggatttgagtctgtcgatgttgtgagctaagaaaatgcaacacgtagctggtcattctggtgatatgtcttccaagccatggtgcatacctggccattccggtgatcttcaaggccatggcgtatggattgtgcgtttgctcaaatcgtacttgtgcgcaagcgcaaaactacttatatatat

SEQ ID NO: 938 - DNA, 1310 bp, Avena sativa
cccacaccacacacccgccccaagtcccacccacagcgccgaacaccttccgctcgccgtcgccatgtcgtccgccgccgcgccggagaatccgaggccggtgcgcttcggcatcatgggctgcgcctcgatcgcgcgcaagctggcgcgcgccatgctgctggcggcccccgccgcggccgtggtcgccgtgggcagccgctccgagggcaaggcgcgcctcttcgcggccgacaacggcctcccggccgccacgcggctccacggctcctacgaggcgctcctcgacgacccagacgtcgacgcggtctacctgccgctcccgaccagcctccacgtcaagtgggccaccgccgccgccgcgcgggggaagcacgtgctgctcgagaagcccaccgcgctgtgcgccgccgaactcgacgccatcctcgccgcctgcgaggagaacggggtccagttcatggactccaccatgtggatgcaccacccccgcaccgccaagatgcgcgagctgctggatgaccggagcaccatcggcgatgtcagagttataaactcagtgttcagcttccgagcaaacgaagacttcctccacaatgacatcagggtaaagccggacctcgacgccttgggcgctctcggcgacgccggatggtactgcatccgcgccatcctgtgggctgttaactacgagctgcccaggaacgtgatcgccctctgtgaccccgtcaagaaccaagccggcgtgctcctagcctgcagcgcaaccctctactgggccgatggcaagatcgccaccttccactgctccttcctcaccaacctcaccatggacgtcaccgtcgttggcacgaacggtacgctccacgtcactgacttcatcatcccgtacgaggagaagtctggcccgttcagcgtggcgtcagagtcgaatttcgcggagctgcatactgggtgggtgccgcagccgagcaagcatgtcgtcacgacggagctgccgcaggaggccctcatggtccaggagttctgtaggctggtgcaggaaattagagatggtggtgccggggttgagaggaagtggccgggtatcaccaggaagactcagatagtgatggatgcggtgaaaacttccattgatgacgggtttgtgtctgtcgatgttaccagctaaatacaacacatggatggtcatttcggtactgccatcaagaccatggattgtggttccgtttgtgtatttcccaaaaccatatacttactgaaaatgtttcttatcatattgaggacagtattgcaattatcaagttaaa

SEQ ID NO: 939 - DNA, 1319 bp, Avena sativa
cccacaccacacacccgccccaagtcccacccacagcgccgaacaccttccgctcgccgtcgccatgtcgtccgccgccgcgccggagaatccgaggccggtgcgcttcggcatcatgggctgcgcctcgatcgcgcgcaagctggcgcgcgccatgctgctggcggcccccgccgcggccgtggtcgccgtgggcagccgctccgagggcaaggcgcgcctcttcgcggccgacaacggcctcccggccgccacgcggctccacggctcctacgaggcgctcctcgacgacccagacgtcgacgcggtctacctgccgctcccgaccagcctccacgtcaagtgggccaccgccgccgccgcgcgggggaagcacgtgctgctcgagaagcccaccgcgctgtgcgccgccgaactcgacgccatcctcgccgcctgcgaggagaacggggtccagttcatggactccaccatgtggatgcaccacccccgcaccgccaagatgcgcgagctgctggatgaccggagcaccatcggcgatgtcagagttataaactcagtgttcagcttccgagcaaacgaagacttcctccacaatgacatcagggtaaagccggacctcgacgccttgggcgctctcggcgacgccggatggtactgcatccgcgccatcctgtgggctgttaactacgagctgcccaggaacgtgatcgccctctgtgaccccgtcaagaaccaagccggcgtgctcctagcctgcagcgcaaccctctactgggccgatggcaagatcgccaccttccactgctccttcctcaccaacctcaccatggacgtcaccgtcgttggcacgaacggtacgctccacgtcactgacttcatcatcccgtacgaggagaagtctggcccgttcagcgtggcgtcagagtcgaatttcgcggagctgcatactgggtgggtgccgcagccgagcaagcatgtcgtcacgacggagctgccgcaggaggccctcatggtccaggagttctgtaggctggtgcaggaaattagagatggtggtgccggggttgagaggaagtggccgggtatcaccaggaagacgcagatagtgatggatgcggtgaaaacttccattgatgacgggtttgtgtctgtcaatgttaccagctaaatacaacacatggatggtcatttcggtactgccatcaagaccatggattgtggttccgtttgtgtatttcccaaaaccatatacttactgaaattgtttcttgtcatattgaggacagtattgcaattatcaagttaaatgttactac

SEQ ID NO: 940 - DNA, 1499 bp, Sorghum bicolor
acacgaccgcaccgagagagcccagacgcgccaagccgctaaccaaaggccacgccaaagagcaccaggccgccgtccatgtcgtccgccgcggcgccagacccagaccagccgccgcgccccgtgcgcttcggcatccttggctgcgcctccatcgcgcgcaagcttgcgcgcgccatgctgctcgcgcccggcgcagccgtcgccgccgtcgggagccgctccgaggagaaggcccgcctcttcgccgccgacaacggcctcgacgtcgcggccacccgcctccacggctcctacgaggcgatcctcgacgacccggacgtggacgccgtctacctcccgctccccaccagcctccacgtgcgctgggccaccgccgccgccgcgaggggcaagcacgtgctcctagagaagcccaccgcgctgtgcgccgccgacctcgacgccatcctcgccgcctgcgacgccgcgggggtccagttcatggactccaccatgtggatgcaccacccgcgcaccgccaggatgcgggacaccgtcgacgacaaggacgccattggggacatcgcaacgattaacagtgtgttcagctttcgagcaaacgaagatttcctccagaatgacatcagagtaaagccagatcttgatgccctgggtgcacttggtgatgctgggtggtactgcatccgtgcaatcctgtgggctgttggctatgagttgcccaagactgtgatcgcactgcgcgaccctgtaaagaaccgagctggcgtgcttcttgcgtgtggcgcgacattgtactgggcagatggcaagactgccaccttcagctgctctttcctgagcaatctcaccatggatatcaccttggttggcacgaatggaactatccatgtcactgactttgtcatcccatacgaggagaatttggcggagttccacgtggcttcgaagtcaagctttgctgagctccacattggatgggatcctctgccaagcaagcacgttatcacaacggacctgccacaggaggccctgatggtccaggaattcgcgaggctcgtgcaggagatccgggatgctgggtgtaagcctgaggggaagtggccggccatcacccggaagacgcagctggttttggatgctgtgaaagcctcgattgacaaaggatctgagccagttgaggtggctagttaaatccaacaaacgagtcacttccgatcctgggtaaggccttgtttggatgttgttggattcacctcaatccatatgtgttggagtggattggggtgaaatttagttcaagttccactccaacccatcctaacatatgtggattgatgcgaatccgactacatccaaacaaggcctttgtttacacagcatggcctggtttgtgcttgcgtgatatacacattatgtacttctgtactgtacatgaaaccagtaaaccattattcgtgataatttaaagaagtggcatcaaactcagaaaaaggttg

SEQ ID NO: 941 - DNA, 1908 bp, Sorghum bicolor
gcgaaggcaccaacaccacacgaccgcaccgagagagcccagacgcgccaagccgctaaccaaaggccacgccaaagagcaccaggccgccgtccatgtcgtccgccgcggcgccagacccagaccagccgccgcgccccgtgcgcttcggcatccttggctgcgcctccatcgcgcgcaagcttgcgcgcgccatgctgctcgcgcccggcgcagccgtcgccgccgtcgggagccgctccgaggagaaggcccgcctcttcgccgccgacaacggcctcgacgtcgcggccacccgcctccacggctcctacgaggcgatcctcgacgacccggacgtggacgccgtctacctcccgctccccaccagcctccacgtgcgctgggccaccgccgccgccgcgaggggcaagcacgtgctcctagagaagcccaccgcgctgtgcgccgccgacctcgacgccatcctcgccgcctgcgacgccgcgggggtccagttcatggactccaccatgtggatgcaccacccgcgcaccgccaggatgcgggacaccgtcgacgacaaggacgccattggggacatcgcaacgattaacagtgtgttcagctttcgagcaaacgaagatttcctccagaatgacatcagagtaaagccagatcttgatgccctgggtgcacttggtgatgctgggtggtactgcatccgtgcaatcctgtgggctgttggctatgagttgcccaagactgtgatcgcactgcgcgaccctgtaaagaaccgagctggcgtgcttcttgcgtgtggcgcgacattgtactgggcagatggcaagactgccaccttcagctgctctttcctgagcaatctcaccatggatatcaccttggttggcacgaatggaactatccatgtcactgactttgtcatcccatacgaggagaatttggcggagttccacgtggcttcgaagtcaagctttgctgagctccacattggatgggatcctctgccaagcaagcacgttatcacaacggacctgccacaggaggccctgatggtccaggaattcgcgaggctcgtgcaggagatccgggatgctgggtgtaagcctgaggggaagtggccggccatcacccggaagacgcagctggttttggatgctgtgaaagcctcgattgacaaaggatctgagccagttgaggtggctagttaaatccaacaaacgagtcacttccgatcctgggtaaggccttgtttggatgttgttggattcacctcaatccatatgtgttggagtggattggggtgaaatttagttcaagttccactccaacccatcctaacatatgtggattgatgcgaatccgactacatccaaacaaggcctttgtttacacagcatggcctggtttgtgcttgcgtgatatacacattatgtacttctgtactgtacatgaaaccagtaaaccattattcgtgataatttaaagaagtggcatcaaactcagaaaaaggttgaagtgtataagtcggatgatatttctactggttgttctagtatatgggcagacggaagcatcaccatcaataatcaaccgatggttgcccggcaaaaggaggaatacagcaggaagttctaagattgaagaaaaaaaacaatgttgagggcttccgttgtgatgttcttggtcatgaacatcctggacaggttcaggttgtgcaacatttccagcatgatcagttagcactgttagacaactagattgtaccgtgtaacaactagattagattgagtcaagagtttgttgtaactaatctccactttgtatggccacgcagggggcttttccttgtctatttaacacgtaccgagagacccagatagggtcatctcgttccctcattttcta

SEQ ID NO: 942 - DNA, 1360 bp, Zea mays
cccgtttggccatctctacccacaccaccgcaccgagagagcacagacgcgccgagccgccaaccagggccacgcaaaacagcagtacatcacccgccggctgccaccaatgtcgtccgccgcggtgccagaccagtcgccgcggcccgtgcgcttcggtatcctgggctgcgccgccatcgcgcgaaagctggcacgcgccatgctgctcgcgcccggcgcagccgtcgccgccgtcgggagccgctccgaagtgaaggcccgcctcttcgccgccgacaacggcctcgacgtcgccaccacccgcctccacggctcgtacgatgcgctcctcgacgacccggacatcgacgccgtctacatgccgctccccaccagcctccacgtgcgctgggctaccgcagccgccgcacgtggcaagcacgtgctcctagagaagcccacggcgctgtgcgccgccgacctcgacaccatcctcgcggcttgcgacaccgcgggggtccagttcatggactccaccatgtggatgcaccacccgcgcaccgccaagatgcgggagaccgtcgacaacaaggacgccatcggggacatcagaacgattaacagtgtgttcagctttcgagcaaacgaagatttcctccagaatgatatcagagtaaagccaggtcttgatgccctgggtgctcttggtgatgctgggtggtactgcatccgtgcaatcctgtgggctgttgactacgagttgcccaagactgtgatcgcactgcgtgaccctgtaaagaaccaagctggagtgcttcttgcctgcggcgcgacattgtactggtcggacggcaagactgccaccttcagctgctctttcctcaccaatctcaccatggacatcaccttagttggcacaaacggaactgtctatgtcactgactttgtcatcccatacgaagagaagtcggcggagttcccggtggcttcgaagtcgaacttcgctgagctccacgttgggtgggatcctctgccaagcaagcacgtcgtggcaacagacctgccacaggaggcccttatggtccaggaattcgcgaggcttgtgcagaacatccgggatgctgggggcaagcctgagggcaagtggccggccatcaccaggaagacgcagctggttttggatgctgtgaaagcctccattgacaaagggtctgcgccagttgaggtggctagctaaatgcaacaaacgagtcgcttccgattctgaaggttttagctttagtttttacaccatggcgtggtttgtgcttgcttgatatatttacacatgctaaacttctgtattgtacatgaagtcagtaaaccgctaattctggta

SEQ ID NO: 943 - DNA, 1302 bp, Panicum virgatum
  misc_feature (5)..(5): n is a, c, g, or t
  misc_feature (13)..(13): n is a, c, g, or t
  misc_feature (18)..(18): n is a, c, g, or t
  misc_feature (20)..(21): n is a, c, g, or t
  misc_feature (23)..(25): n is a, c, g, or t
  misc_feature (33)..(37): n is a, c, g, or t
  misc_feature (45)..(45): n is a, c, g, or t
  misc_feature (48)..(49): n is a, c, g, or t
  misc_feature (51)..(53): n is a, c, g, or t
  misc_feature (57)..(57): n is a, c, g, or t
  misc_feature (59)..(60): n is a, c, g, or t
  misc_feature (62)..(64): n is a, c, g, or t
  misc_feature (270)..(270): n is a, c, g, or t
  misc_feature (281)..(281): n is a, c, g, or t
  misc_feature (1277)..(1277): n is a, c, g, or t
cacangtgacccncgcgncnncnnngagagagnnnnncccggccnccnncnnngcgncnncnnngtcgtcccaccagccgccgcgccccgtgcgcttcggcatcctgggctgcgcctccatcgcgcgcaagctcgcgcgcgccatgctgctggcccccggcgccgccgtcgccgccgtggggagccgctccgaggagaaggcccgcctcttcgccgccgacaacggcctcgacgtcgccaccacccgcctccacgggacctacgaggcgntcctcgacganccggatgtcgacgtcgtctacctcccgctccccaccagcctccacgtgcgctgggccaccgccgccgccgcgcggggcaagcacctgctcctcgagaagcctaccgcgctctgcgccgccgacctcgacgccatcctcgccgcctgcgacgccgcgggggtccagttcatggactccaccatgtggatgcaccacccgcgcaccgccaagatgcgggagctcgtcgacgacaaggacgccatcggcgacatcaaagtgataaacagcgtgttttgctttcgagcaaatgaggatttcctccagaatgacatcagggtaaagccagacctcgatgccctgggggcactcggtgatgtcgggtggtactgcatccgtgcaatcttgtgggctgttgactacgagctgcccaagactgtgattgcactgcgtgatcctgtcaagaaccaatctggtgtgctacttgcctgtggtgcgacattgtactgggcggatggcaagaccgccaccttcagctgctcctttctcaccaatctcaccatggacatcaccttagttggcacgaatggcactctccatgtcactgactttgtcatcccgtatgaagaaaagtctgcagagttcagtgtggcctcgaagtcaaactttgctcaactacacatcggatgggatccacttccaagcaagcacgtcgtcacgacggacctgccgcaggaggccctcatggtgcaggaattcgcgaggcttgtgcagaacatccgggatgctggtggcaagcctgaggggaagtggccggctatcaccaggaagacgcaggtggtgttggatgcagtgaaagcttcgattgacaaggggtctgagccagttgagattgccaactaaatgacacaaacagctgctcgtcctggtgaaaattctgtacgcaatggcttgcacttgatatatatttactctacttatatgatttatcccacacgagaccattacttgtaataatcngtcaaagaaaacgttgcaacgtatc

SEQ ID NO: 944 - DNA, 1449 bp, Triticum aestivum
ttaaattttgcgttggatctagagcctgccagtctttgattcggctcaacaatggagatggtcctcgccgccgcagcaaactgtaccggtgccttgtcgtccaaccaccccaaaacgttcctcaaatcgcgtcgatcctcgctccaaatgcgggcctgcagatcgggccccgccgcgccgctcgccgtgtcgtccgccgccgcgccggaggagccgcgcccggtgcgcctgggcatcatgggctgcggctccatcgcgcgcaaggtcgcgcgctcaatgctgctcgtccccgccgccgacgtggccgccgtcgccagccgctccgagggcaaggcgcgcctcttcgccgccgacaacggcctccggagcggcacgcgcatccacggctcctacgaggcgctcctcgacgacccggacgtcgacgccgtctacatgccgctccccaccagcctccacgtcaagtgggcgaccgccgccgccgagcggggcaagcacctgctcctcgagaagcccaccgcgccctgcgccgccgacctcgagcccatcctcgccgcctgcgaggccaacggcgtgcagttcatggactccaccatgtggatgcaccacccccgcactgccaagatgcgtcagctcgtcgccgatcaggacacaatcggagacgtcagatttataaacaccatggtcagctttctagcaaacgaagatttcctccagaatgacatcagggtaaagccagaccttgatggcctgggtgtgcttggtgatatcgggtggtactgcatccgtggaatcctgtgggctgttgactatgagctgcccaagaacgtggttgctctccatcaccccgtcaagaaccaagccggtgtgctccttgcttgcggtgcgtcgctctactgggccgacggcaaggtcgccaccttccactgttctttccttaccaacctgaccatggacctcaccgtcgtcggcacaaatggtactattcatgtcaccgacttggtcatcccgtacgaagagaagtctgctccgttcagcgtcgactccaagacgaactttgccgaactctctaccggatgggatccacatccgagcaagcatgttgtcaccacggacctaccccaggaggggctcatggtgcaggagttctgtaggctggtgcagggcatcagagatgccggtgtcaagcctgaggggaagtggccgggcatcacccgaaagacacagattgtcgtggatgcagtcaaggcttctattgacaacggatttgagtccgtcgatgttgccagctaaatacaacacataactggtgttcccacgttgtatcttccagaccatgataaatctatttactgaaataatttgaacgattcttgtcatattgagaactatattgcgatgatcaagtaagggttactaaaaaaaaaaaaaagggcgggcgctctcgcataa

SEQ ID NO: 945 - DNA, 1493 bp, Brachypodium distachyon
cgcgtgtgcaggccaaagttaaacgacaccagtctccactctccagtcctccaccacacagtccccacaaaacccactccgccgttgaaaccaaacgtcgaacacctgccgctcgctatgtcgtccgccatgccggaggagccacggccggtgcgcttcggcatcatgggctgcgccaccatcgcgcgcaaggtggctcgcgccatgctgcttgcgcccgccgccaacgtcgccgccgtcggtagccgctctgaggagaaggcacgcgccttcgcggcagacaacggcctccccgccggtgtccgcctccacggctcttacgaggggctagtcgacgaccccgaccttgacgccgtctacatcccgctccccaccagccttcacgtcaagtgggccgccgcggccgccgcgcggggcaagcacgtgctcctcgagaagcccaccgctctctgcgccgccgacctcgatgccatcctcgccgcctgcgagtccaaccgcgtccagttcatggactctaccatgtggatgcaccacccccgcaccgccaagatgcgcgagctcgtcgccaacaagggcaccatcggcgacgtcagagtgataaacaccgtgttcagctttcaagcagatgaagattttctccacaatgacatcagggtaaagccagaccttgatgccctcggtgcacttggcgatgtcgggtggtactgcatccgtgcaatcttgtgggctgttgactatgagctgcccaagagtgtggccgctttccgtaacccagtgaagaaccaagctggcgtgctccttgcctgtggcgcaacgctctactgggccgatggcaagattgccaccttccactgttctttccttaccaacctcaccatggacatcaccgtcgttggcacaaacggtaatcttcatgtcactgatttcgtcatcccatatgaagagaaatctgccccattcagcgtggcctccaagtcaagctttgccgaactacatactggatgggatccacatccaagcaagcatgttgtcacgacagacctgccacaggaggcactcatggtccaggagttctctaggctggtgcagagcgtccgagatgctggtagcaagcctgagaggaactggccagccatcacccggaagacacagattgtgatggatgcagtgaaaacttctattgacagtgaaagtgagccggttaatgttgccagctaaatacagaacacaactggctatttcgatgacatgtcttcgagagcatggccgctcttatatttgctcaaatactttatgctgcacgaaacaattcatcattctgatcatactgaggacaatgttacaatcataaaataaaatgttaccacgaataaattatgtatatgtaagctttggtattggtcatcacttgttcttctaaactttccaaaccaaaccagcatggtggttttgcgatcaatcatcgcagacactatgtccaaaccaaatccaat

SEQ ID NO: 946 - DNA, 1291 bp, Leymus cinereus x Leymus triticoides
gcgtcgatcctcggtccaaatgccggtctgcctatcgggccccgacgcgccgctcgccatgtcgtccgccgccgcgccggaggagccgcgcccggtgcgcctgggcatcatgggctgcggctccatcgcgcgcaaggtcgcgcgctcgatgctgctcgtccccgccgccgacgtggccgccgtcgccagccgctccgagggcaaggcgcgtctcttcgccgcggacaacggcctccagagcggcacgcgcatccacggctcctacgaggcgctcctcgacgacccggacatcgacgccgtctacatgccgctccccaccagcctccacgtcaagtgggcgaccaccgccgccgagcggggcaagcacctgctcctcgagaagcccaccgcgccctgcgccgccgacctcgagcccatcctcaccgcctgcgaggccaacggcgtccagttcatggactccaccatgtggatgcaccacccccgcactgccaagatgcgtcagctcgtcgccgatcaggacaccatcggagacgtcagatttgtaaacaccatggtcagctttctagcaaacgaagatttcctccaaaatgacatcagggtaaagccagaccttgatggcctgggtgtgcttggtgatatcgggtggtactgcatccgtggaatcctgtgggctgttgactatgagctgcccaagaatgtggttgctctccgtcaccctgtcaagaaccaagccggtgtgctccttgcttgcggcgcgtcgctctactgggccgacggcaaggtcgccaccttccactgttctttccttaccaacctcaccatggacctcaccgtcgtcggcacaaatggtactattcatgtcaccgacttggtcatcccgtacgaagagaattctgctccgttcagcgtcgcctccaagacgaacttcgccgaactctctaccggatgggatccacatccgagcaagcatgttgtcaccacggacctaccccaggaggccctcatggtccaggagttctgtaggctggtgcagagcatcagagatgccggtgtcaagcctgaggggaagtggccgggcatcacccgaaagacacagattgtcgtggatgcagtgaagacttctattgacaacggatttgagtcggtcgatgttgccagctaaatacaacacaaaactggtgttcccacgttgtatcttccagaccatgataaatctatttacggaaataatttgaacgattcttgtcatattgaggacaatattgcaatgatcaagtaagagttactacga

SEQ ID NO: 947 - DNA, 1579 bp, Secale cereale
ccggtacgtggcgagcgagcgtccgctggtgtgaatgcttcagttcttataaacgcagggactccacttccactccacagggcgtctatctatacgtctcgactggtaaattttgcgttggatctgcctcccgctttgattcggctcaacaacaatggagatggtcctcgccgcagcaaactgtaccggtgccttctcgtccaaccacccaaaaaagttcctcaaatcgcgtcgatcctcggtccaaatgccggcctgcagatcgggccccgacgcgcccctcgccgtgtcgtccgccgccgcgccggaggagccgcgcccggtgcgcctgggcatcatgggctgcggctccatcgcgcgcaaggtcgcgcgctcaatgctgctcgtccccgccgccgacgtggccgccgtcgccagccgctccgagggcaaggcgcgcctcttcgccgcggacaacggcctccggagcggcacgcgcatccacggctcctaccaggcgctcctcgacgacccggacatcgacgccgtctacatgccgctccccaccagcctccacatcaagtgggcgaccgccgccgccgagcggggcaagcacctgctcctcgagaagcccaccgcgccctgcgccaccgaccttgagcccatcctcgccgcctgcgaggccaacggcgtccagttcatggactccaccatgtggatgcaccacccccgcactgccaggatgcgccagctcgtcgccgatcaggacaccgtcggagacgtcagatttataaacaccatggtaagctttctagcaaacgaagaattcctccagaatgacatcagggtgaagccagaccttgatggcctgggtgtgcttggtgatatcgggtggtactgcatccgtggaatcctgtgggccgttgactatgagctgcccaagaatgtggttgctctccgtcaacctgtcaagaaccaagccggcgtgctcctcgcttgtggcgcgtcgctctactgggccgacggcaaggtcgccaccttccactgttctttccttaccaacctcaccatggacctcaccgtcgtcggcaccaatggtactattcatgtcaccgacttggtcatcccgtacgaagagaagtctgctccgttcagcgtcgcctccaagacgaacttcgccgaactctctaccggatgggatccacatccgagcaagcatgttgtcaccacggagctaccgcaggaggccctcatggtccaggagttctgtaggctggtgcagggcatcagagatgccggtgtcaaacctgaggggaagtggccgggcatcacccgaaagacacagattgtcgtggatgcagtgaaggcttctattgacaacggatttgagtcggtcgatgttgccagctaaatacaacacataactcgtcgttcccatgttgtatcttccagaccatgacaaatctatttattgaaataatttgaacgattcctctcatcttgaggacaatattgcaatgatcaagtaagagttactgcgaatttttgttgtgtataatacatggggaatatggatgctttgagttatactaaaaaagtc

SEQ ID NO: 948 - DNA, 1313 bp, Brachypodium distachyon
caaacgtcgaacacctgccgctcgctatgtcgtccgccatgccggaggagccacggccggtgcgcttcggcatcatgggctgcgccaccatcgcgcgcaaggtggctcgcgccatgctgcttgcgcccgccgccaacgtcgccgccgtcggtagccgctctgaggagaaggcacgcgccttcgcggcagacaacggcctccccgccggtgtccgcctccacggctcttacgaggggctagtcgacgaccccgaccttgacgccgtctacatcccgctccccaccagccttcacgtcaagtgggccgccgcggccgccgcgcggggcaagcacgtgctcctcgagaagcccaccgctctctgcgccgccgacctcgatgccatcctcgccgcctgcgagtccaaccgcgtccagttcatggactctaccatgtggatgcaccacccccgcaccgccaagatgcgcgagctcgtcgccaacaagggcaccatcggcgacgtcagagtgataaacaccgtgttcagctttcaagcagatgaagattttctccacaatgacatcagggtaaagccagaccttgatgccctcggtgcacttggcgatgtcgggtggtactgcatccgtgcaatcttgtgggctgttgactatgagctgcccaagagtgtggccgctttccgtaacccagtgaagaaccaagctggcgtgctccttgcctgtggcgcaacgctctactgggccgatggcaagattgccaccttccactgttctttccttaccaacctcaccatggacatcaccgtcgttggcacaaacggtaatcttcatgtcactgatttcgtcatcccatatgaagagaaatctgccccattcagcgtggcctccaagtcaagctttgccgaactacatactggatgggatccacatccaagcaagcatgttgtcacgacagacctgccacaggaggcactcatggtccaggagttctctaggctggtgcagagcgtccgagatgctggtagcaagcctgagaggaactggccagccatcacccggaagacacagattgtgatggatgcagtgaaaacttctattgacagtgaaagtgagccggttaatgttgccagctaaatacagaacacaactggctatttcgatgacatgtcttcgagagcatggccgctcttatatttgctcaaatactttatgctgcacgaaacaattcatcattctgatcatactgaggacaatgttacaatcataaaataaaatgttaccacgaataaattatgtatatgtaagctttggtattggtca

SEQ ID NO: 949 - DNA, 1091 bp, Secale cereale
gcagccgctcccaggccaaggcccgccgcttcgccgccgcaacggctccccgccggaagcgcgccctgcacggctcctaccgaggcgctcctcgacgacccggccgtcgacgccgtctaccctgcccggtccccaccagcctccacgtgcagtgggccaccgccgccgccgcgcggggcaagcacgtgctcctcgagaagcccaccgcgctctgcgccgccgacctcgacgccatcctcgccgcctgcgacgccggcggcgtccagttcatggactccaccatgtggatgcacacccccgcaccgccgagatgcgcgacctctccccgccgacgtcggcgacgtcagaggttataaacagtctgttcagctttcgagcaaacgaagatttccttcagaatgacatcagggtaaagccagacctcgacgccctgggcgtactcggtgatgccgggtggtactgcatccgcgcgatcctgtgggccgtcgactacgagcttccgaagaacgtgattgcgctccctgaccctgtcaagaacaaagccggcgtgctcattgcctgtggcgcgacgctctactgggccgatggaaagatggccaccttccactgctcgttcctcgccaacctcaccatggacctgaccgtcatcggcacggacggcacgctccatgtcaccgacttcatcatcccgtacgaagagaagtccggcccgttcagcgtggcctccaggtcgaacttcgccgagctccacaccggatgggttccgcagccgagcaagcacgtcgtcacgacagacctgccgcaggaggccctgatggtcaaggagttctgcaggctggtgcagcgcatcagagacgccggcgccaagcctgaggggaagtggccggccatcaccaggaagacacaggttgtgatggacgccgtgaaagcttccattgacaacggattcaaatcggtcgatgtcgccagctgaataaaacacatcaccggtcatttcggcattatgtttctccagaccatggcaaaatctgctcagactgtacttctacacggcatgaaactacttatatatattgaaataactccaatga

SEQ ID NO: 950 - DNA, 2073 bp, Oryza sativa
actattgtaagctcctccaccactcgctccctccctccccagctaggcccagcgtcgaacaccttccccccgccaccacccatgtcgtccccgtcctccgccgcgtcgccgccgccgccgccgccggcggagcagcgccgcccggacccggtgcgcttcggcatcatggggtgcgcctccatcgcgcggaagctggcccgcgccatgctcctcgccccgggcgccgccgtggccgccgtcgggagccgctccgaggcgaaggcccgcgcgttcgccgaggagaccggcctgctcctccgccacgccccgcgcctgcacggctcctacgaggccctcctcgccgacccgggcgtcgacgccgtctacctcccgctccccaccagcctccacgtccgctgggccaccgccgccgccgccgcggggaagcacgtcctcctcgagaagcccaccgcgctctgcgccgccgacctcgacgccatcctcgccgcctgcgacgccgcgggcgtccagttcatggacgccaccatgtggatgcaccacccgcgcaccgccaagatgcgggagctcgtcgccgacgaggccaccaccggcgacgtcagggtgataaatagcctgttcagctttcgggcaaacgaagaattcctccaaaatgatatcagggtaaagccagaccttgatgccctgggtacgctaggcgatgctgggtggtacagcatccgtgcaattttgtgggctgttgactatgagcttcccaagactgtgatcgccctgcgcaaccctgttaggaaccaagctggcgtgctccttgcctgcggagcaacattgtactgggctgatggaaagattgccaccttcaactgttctttcctcaccaacctcaccatggacatgaccatcgttggaacaaacggtacgcttcacgtcaccgactttgtcatcccatatgaagagaagtacgcggcattcaacatggcgtccaagtcaaagtttgctgaactccacatcggatgggatccactgccgagcaagcatgtcgtctctacagacctgccacaggaagccctcatggtccaggaattctcaaggttagtgcagaacatccgagacgcaggtggcaaacctgagggaaagtggccagccatcacccggaagactcaggttgtgatggatgcggttaaaacctccattgacaaccgatttgggccagtggatatttctagctgaaggggtaagcaagtgtgctttctgacgatctctgaagtccatgatatttctgtatcctaccagaaagaaccacctattcaaataattggaagaattgcagtcaaattcactacaatattgtagatgtatcaagcaagatgatgttataaataaatagaatttgaaacatggaacctctgtttgacccatggaaagctaaccattgggacatatatattcccatatgaaattcatctgttcctaatgaggttcatagttcaaattcttggttttctctgcatactctgtcagggcaatcacattacaaatttccatcctcaaagctcaagaggcacacctggccaagttggagaagacattttcaagacttcaacaatcaacatcacaacctttgtccctgctgacatttttgccagttctgaaaaatttctgaacatatgttgtcgatggcaatgaaggacacatgcatgcttcaactactgctgctgtaaggtgaccgaatgcttaaaacgaaagctgtgttttctgacggtgccgactgctgacacgttgttttcgtagtagcaagtagttgttgttgatgccggcctgtctctccagaggactgtatgatagctcagctgttacttaagtttgttcattttatataacttactatctctgttctataatgtaataacttttaacgatatatttggacttatccttatccttccagagataaagtcaaaagttgttatatgtttggggacggaggttgtttggttgatagccataagttaccacactttgccacaatttaggttagacaagtttgattatgttaagtgagtgttcggttggctccca

SEQ ID NO: 951 - DNA, 549 bp, Secale cereale
acacaccgcgctgtagcggatccccttccaccccgccagggccaatccgccgcccttctacgacccccgccgccgccggtgccgtagaggacgcgcacgggcctcctaccaccgacgccaggggtctaccgaggtctgttcgagccacgttttccgcactgcatctcagctgctgacgaagaactccctccagccacaaatcccagcggaagatgcaggcgaagaagctgacgctgctgcagacggtggctgccgccggagtcttctcagccgtctccttctggtacggcttcatgtttgggagggagtccgcgcggcgcgagcttggtggcatcattgacgaccttcgcagcggctccacggccacctccgccgcgccttcctccgactcccacgctcaccccaaaccatagtgcggtaaccgatcctgctctacagtgtcaaggaggtgggtattagaagagttgccaagcagttctggtaaaaaagaaacattttcagatgaagatctaagcaattagtagacctatgtttagctaggtttctttt

SEQ ID NO: 952 - DNA, 560 bp, Triticum aestivum
ccgccgccgccgacgacacgtacgggcctcctaccacgagccagggttggccaaggtctgtccgagccaaggtttccgcactgcatctcagctgctgacgaagaactcccatcagccccaaatcccagcggaagatgcaggccaagaagctgacgctgctgcagacggtggctgccgccggagtcttctcagccgtctccttctggtacggcttcatgttcggtagggagtctgcgcggcgcgagcttggtggcatcatcgacgaccttcgcagcggctccacggccacctctgccgcgccctcctccgactcccacgctcaccccaaaccatagtgcgatcctgctctacagtgtcaaggaggtgggtattagaagagttaccaagcagttctggtaaaaaagaaacattttcagatgaagatctaagcaattagtagacctatgtttagcaggtttccttttgtgcttttctttcgcaaacaaattatgctacagtgtgatttggtcatcaattcttccattgtataacaatggtgtacattcgctctaaaaaaaaaa

SEQ ID NO: 953 - DNA, 746 bp, Triticum aestivum
ggccggttctcctttcctctcctccttcgactccctccgccgccgccgccgccgccgacacgtacgggccagggtccaacccccgaagccagggctagccgaggcctgtctgagcaacggttttccgcactgctgcttatccgctgacgaagaactcccaccagccccaaatcccagcggaagatgcaggccaagaagctgacgctcctgcagacggtggctgccgccggagtcttctcagccgtctccttctggtacggcttcatgtttgggagggagtctgcgcggcgcgagcttggcggcatcatcgacgaccttcgcagcggctccacggccacctctgccgcgccctcccccgactcccacgctcaccccaaaccatagtgcgatcctgctctaaggaggtgggtattagaagagttgccaaacagttctggtaaaaaagaaacattttcagatgaagtctaagcaattagtagacctatgtttagcaggtttccttttgtgcttttcttacgcaaacaaattatgttacagtgtgatttggtcatcaattcttccactgtataacaatggtgtacattcgctctcctggcgcacctaagctggaaagtggcagtggataatccgaaatatccgatatccgtatgcgggaaaatgactatccgtatctgaaatatctgcacccgaattaaaatgtaaatgaaggtatccggatcattttattacaaataccaacacaaata

SEQ ID NO: 954 - DNA, 590 bp, Secale cereale
cctctctcctccaggcgccgccggttctcctttcctctcctccttcgaccccctccgccgccgccgccgccgacgacgacgacgacacgtacgggccagggtccaaccaccgaatccacggttatccgaggcctgtctgagcaacggttttccgcactgctgcttatccgctgacggagaactcccaccagccccaaatcccagcggaagatgcagtcgaagagctgacgctgctgcagacggtggctgccgccggagtcttctcagccgtctccttctggtacggcttcatgtttgggagggagtctgcacggcgcgatcttggcggcatcatcgacgaccttcgcagcggctccacggccacctccgccgcgccctcctccgactcccacgctcaccccaaaccatagtgcgatcctgctctacagtgtcaaggaggtgggtattagaagagttgccaagcagttctggtaaaaaagaacattctcagatgaaggtctaagcaagtagtagacctatgtttagcaggttttttttgtgcttttcttacgcaaacaaattatgctacagtgtgatttggtcatcaattc

SEQ ID NO: 955 - DNA, 577 bp, Lolium multiflorum
  misc_feature (374)..(374): n is a, c, g, or t
  misc_feature (382)..(382): n is a, c, g, or t
  misc_feature (393)..(393): n is a, c, g, or t
cgaaagatgcaggcgcaagcaagctgactctgctgcagcacggtggccgctgcaggagttttctcggccgtctcctgctggtacggcttcatgtttggtagggagtctgcccggcgtgagcttggtggcatcattgacgacctccgtagcagctccacgacgccctctgctgcgtcccctgactcccacactccctccaaaccctagtgtgatcctcctctacactgtcaagaacaagaatggtcatcataaatgacgaggtgaggtattcagcaagcagtttaccaagtagtgacattgtcagattctggtaaaaaaagaaacattgtccagatgaagatttaacgcaattagtggacctgtttagcaggttntccttttntgtgtattttngcacaaaagaattatgctaccagttctgattgggttgtccaattacttttcttacccctgcaaataaccaattgttgtactcgggcggcagaaccacgctaattcgaaattcccggggccgccatgggcggcgggagccatgcgaagttcgggcccattcgcctatagtgaagttcgtttacaa

SEQ ID NO: 956 - DNA, 992 bp, Sorghum bicolor
aatccatagatattttgcggagtggaacttgatagtagatactacttaaactccccatctacgaaaatgccagtaaataaaaagcccaaaggctcagcccaaccattcatcctagtcgctctccatcccatgggccgtgggctcggctagaactgcaagtccgcaagccttcgtcggccgccgccggcacctccccgatctgctgctaccttgccggcgaaggtcgtctcgtgccggcaccggtaggtggcagccttcctccaatcctccgtccctctccttccccaaccatcgccgccttcggtcgcctcgtcttccccaactacacctcgcggtggcacagcaaaacggagctagcggctgacccgactcccatctttcccaattctcagcgggcgatgcaggcgaagaagctgaccctgcttgagacggtggcagctgcgggagtcttctccgccgtctccttctggtatggcttcatgtttggaagggagtccgcgcggcgtgagcttggtggcatcatagacgacctccgcagcaacaagcccaccaccactgctgccgcttcctcggatactgatgctcatcccaagccatagtgggggtagtagatggaataactagtcttggagatgtgatccccccaccccacacacaccataatgtgttaacgagtgtacagattgaacatcaatttttagactggaaaacacaactcgcctactgcacaagactgaagaaacaagccaaagatgcctttttccttcgtaatgtgcttgttttgttttcaataatatgtgtcgatgaggacacatcatttcattttactctttgagatgggcatgcttattattataatatcatgcctagacaatctagtgaggtccctggaagcaaatctctggctggcttattgccctgttttgaagccatggcaggcaggattcactgccacattgcctattcagaaccaattgatataatctcacact

SEQ ID NO: 957 - DNA, 769 bp, Brachypodium distachyon
gttcgagaactggcccactccactctacggaaagaagaatactggatccccttgtacctgctcctgtgcttccgcctccaggaacctccccttccttcgtcgactctcgccgccgccggtgcccggtgctcctagacgaagcttctgggaccacgaagccagggtttaccggggtctgggccagggtttgcgcaccgcagctagctgctgctgacaaactccctacggtaccgaatcctagcgaaagatggcggcgaagaagctaacgctgctgcagacggtggcggctgcaggagtcttctcagccgtctcctgctggtacggcttcatgtttgggagggagtctgccaggcgcgagcttggtggcatcattgacgacctccgcaacagctcttcgactggctctgctgcgtctcctgactcccacactccatccaaacgctagtgtgatctacaatgtcaagaacaaaaagggtcatcataaatacgaggtcagctattagcagagtttaccaagtagtggcattgtcaaatgaagatctaagcaactagtacacttgtgtttagtacgtttcctttttgtggctattttaatgcaaatgaattatgctacagtttggtatgggtcatcaaaaccttttcttgccatgtataaaaatgttgtacatgctctcttcaggtgtaccagaattaccgatgcattgtactgctgaccatgatcagatttacacaccatgaaattaatgaactcctggttctgccagtttga

SEQ ID NO: 958 - DNA, 828 bp, Brachypodium distachyon
tatctttggtgttcgagaactggcccactccactctacggaaagaagaatactggatccccttgtacctgctcctgtgcttccgcctccaggaacctccccttccttcgtcgactctcgccgccgccggtgcccggtgctcctagacgaagcttctgggaccacgaagccagggtttaccggggtctgggccagggtttgcgcaccgcagctagctgctgctgacaaactccctacggtaccgaatcctagcgaaagatggcggcgaagaagctaacgctgctgcagacggtggcggctgcaggagtcttctcagccgtctcctgctggtacggcttcatgtttgggagggagtctgccaggcgcgagcttggtggcatcattgacgacctccgcaacagctcttcgactggctctgctgcgtctcctgactcccacactccatccaaacgctagtgtgatctacaatgtcaagaacaaaaagggtcatcataaatacgaggtcagctattagcagagtttaccaagtagtggcattgtcaaatgaagatctaagcaactagtacacttgtgtttagtacgtttcctttttgtggctattttaatgcaaatgaattatgctacagtttggtatgggtcatcaaaaccttttcttgccatgtataaaaatgttgtacatgctctcttcaggtgtaccagaattaccgatgcattgtactgctgaccatgatcagatttacacaccatgaaattaatgaactcctggttctgccagtttgatcatatggctttggcttacctcatcttccgaaaaacttgatgacaatat

SEQ ID NO: 959 - DNA, 765 bp, Sorghum bicolor
ccaaaggctcagcccaaccattcatcctagtcgctctccatcccatgggccgtgggctcggctagaactgcaagtccgcaagccttcgtcggccgccgccggcacctccccgatctgctgctaccttgccggcgaaggtcgtctcgtgccggcaccggtaggtggcagccttcctccaatcctccgtccctctccttccccaaccatcgccgccttcggtcgcctcgtcttccccaactacacctcgcggtggcacagcaaaacggagcgggcgatgcaggcgaagaagctgaccctgcttgagacggtggcagctgcgggagtcttctccgccgtctccttctggtatggcttcatgtttggaagggagtccgcgcggcgtgagcttggtggcatcatagacgacctccgcagcaacaagcccaccaccactgctgccgcttcctcggatactgatgctcatcccaagccatagtgggggtccaggtctgcaatgcgaagaacaagaatgtagaactaatctggttagctattagaagtgttcaacaaggagaaatattgttagaggaaggccaaagcagcccgacctatattttgtaggtttctgttttagggagactgccttttgaattcaaagaaacgagagatgatatcatttgatatgtggcgtgacagccagttatcatccgaatctatcagtcattcaacagtgtttctctcacaataaattagcgaacaggactttgttctctgactttttcagcc

SEQ ID NO: 960 - DNA, 634 bp, Setaria italica
atcccatgggccgtgggcttggctagaaccgcaagaaagccctcctcgtcggcggcggccgctaccccaaatctgccgtgccggcgaagaagactttccgagcatcgccgcctccggtcgcctcgcgctcgcggcggagcttcacgtgcgcgtcgggttggcagcgtggtgcgtggagagctcactgcggacgcttgtggccctcctcgcacagcaaacggcggctccccaaatcccggcgggcgatgcaggcgaagaagctgacgctgctgcagacggtggctgccgcgggagtcttctctgccgtctcgtgctggtatggcttcatgtttggaagggagtccgcgcggcgtgagcttggtggcatcatagacgacctccgcaagtccaccacaaccgcttcctctgaacccgatgctaattccaagccatagtacggtatgctaatttttcgccctctaaatgtggtcagtttgtttctgtggatctggattgtctaagctaaatgcaagaaccagtcctggagatgtttttgtcaccctccaaaatgtgtatcactgtattcagcttgaacatctacttatttagaacgacaaacgagttaaaatgttttttggttagggggatattggta

SEQ ID NO: 961 - DNA, 1682 bp, Triticum aestivum
gggcagccaaccgctggtactagtccccgtcccgcccccctcccgattctccggggagtccgagcgagctcacgaacatcaacactagtcggctcgctcgctctcactctcccctccggcgcccgtagacgcagccggcagatccaagcaatggatttgagggcgttcttcgggggcaagaagcaggagccggagcagaacgggcacgccaacggggcggcgcccaacgggggcgtcaagaagaggaccgccgatttggccatctacgagcagtacgagcagcaggccaggcagccggagatgcgcgccgcggcaattcgcgatgggaatgctgatgtgatccagaagcctctcctacctcaatttgagtcagctgaaatgcgtaacttagcagagacattgttgcgggatattatccgtgggagccctgatgtgcaatgggaaagcatcaagggactagagactgcaaaacgtctcctaaaagaagcagtcgtcatgcccataaagtacccaaaatacttcactggtctactatcaccgtggaaaggcatcttactttttggtcctcctggaacagggaagacaatgctggcaaaagcagttgctactgagtgcaatactacattcttcaacatttcggcttcatcaattgtcagcaaatggcgtggagattctgagaagctagtcaaagttctttttgagcttgcaagacatcatgcaccatcaacaatatttcttgatgagattgatgctattattagtcagcgtggtgaagctcgtagtgagcatgaagctagtcgacgcttgaagactgagctacttattcagatggatggcttgacaaaaacgaacgacttagtatttgtgcttgcagcaacaaatctaccatgggaattagatgcagctatgctccgtcggcttgagaagcggattcttgtaccacttcctgaagctgaagcaaggcatgccatgtttaaggaacttttgccagcaatgacctcaaatctagaggtcccatatgatatcctggtcgaaaagactgaagggtactctggttcagacatccgtctcgtgtgcaaagaagctgccatgcagccactgagacgtctcatgtcagttcttgaggccagtgatgagctggtgccagaggaagagctgcctgaggttggccctctcaaacctgaagacgtcgaacttgctttgagcaacacaaggccgtcagcccatctccaagcacatcgttatgaaaaatttaaccaggactatgggagccatattctttcttaagagcaaaccacgatcagcttctcaggtttgccaagtgatgcacggtggtggttcatttgaacatgtactggtacaaagctatcttgccctacaaggccacaccaatcaaaatggccttgtcgcaccgttatatttatcctttgacagtcgtcaagcaggatgcaaaaattgttgctaaatacattagactggtttaagttgggatgcaatcattgggcatctgatttttctgcggcagctctgcttgactagactggaatattaccctgtaatgatcatactccaaaataattaacaaatgattcattgagtaggatttatgaagaaagaaataaatgttagtcatgttgaatggaacattacagtccagttctttgcgcttcacaaaaaaaaaa

SEQ ID NO: 962 - DNA, 1614 bp, Saccharum officinarum
acactcgtcgactccagtcgctcgctcgctctcccccgaggtcccagaagagacaggcagccggcgaagcgcgccgccgcgaagcaatggatttcaaggggttctgggagtccagattcgggggcaagaaggagccggagcagcagaacgggcacgccaacggggaagccaacgggagcgtgcggaagaggacctccgatttggcggtctacgagcagttcgagcagcaggccaggcagacccaggtccgagccgccgcgattcgcgacggaaacgctgatgtgatccagaagccccttctaccttcatttgagtcagctgaaatgcgtaatctcgcagagacattgttgagggatattattcgcgggagcccagatgtgaaatgggagagcatcaaaggactggaaaatgcaaaacgccttctaaaagaggctgttgtcatgcctataaagtacccaaaatacttcactggtctcctttctccatggaaaggcatcttactttttgggcccccggggacaggaaagacaatgctggcaaaagcggttgcaactgagtgcaaaaccaccttcttcaacatttcagcatcgtcaattgtcagcaaatggcgtggagattcagagaagcttgtcaaagttctgtttgagctcgctaggcatcatgcaccatccacaatatttcttgatgaaatagatgccattatcagccagcgtggtgaagctcgtagtgagcatgaagctagtcgtcgcttgaagactgaactacttattcagatggatggtttgacaaagacaaacgacttggtatttgtacttgcagctacaaatcttccctgggaattggatgcagctatgctccgccggcttgagaagcggattcttgtaccgcttcctgaagctgaagcaaggcaagcaatgtttgaggaacttctgccagcgactacatcaaagttagaggttccgtacaacatactagttgaaaagactgaaggctactctggttcagatattcgtcttgtgtgtaaagaagctgccatgcaaccactgagacgtctcatgtcagttcttgaagccagtgatgagttggtgccggaggaagaactgcctgaggttggtcctctgaaacctgaagatattgaacttgcattaaggaacactaggccatcagcgcatctccatgcacatcgctacgaaaagttcaaccaggactatggtagccaggtcctttgttcagagttggcatgatcttattatcaggttgatgttccattcaatcatggaactagagcgtagctaatatatcctgctccggcacatcagtttgtttcgcatgttgatggggtgccgtgttgtcaaaatggttgctctggtaacgaggctccaagcagattgcaatttccctctggctgcagtatcttgcataggttgaagtgcgaggtgcaggtgctgactgctaggatctctgtagctcttctcatgcaggctgagattttcacgaaacctcgaacttacagcaaaaaaaaattgattcgttgtctagttacgtgtctaataaatgcggtaccctgcagaaaagtacactctggttatattgaacggaaagcgagccagagag

SEQ ID NO: 963 - DNA, 1694 bp, Secale cereale
gggggtcaaccaaccgctggtactagtccctgtcccgcccccctcccgattctccggggagtctgagcgagctcacgaacagcacaccagtcgactcgctcgctctcactctcccctccggcgcccgtggacgcagccggcagatccgagcaatggatttgagggcattcttcgggggcaagaagcaggagccggagcagaacgggcacgccaacggggcggcgcccaacgggagcgtcaagaagaggacccccgagttggccatctacgagcagtacgagcagcaggccaggcagccggagatgcgcgccgcggcgattcgcgatgggaatgctgatgtgatccagaagcctctcctacctcaattcgagtcagctgaaatgcgtaacttagcagagacattgttgcgggatattatccgtgggagccctgatgtgcaatgggaaagcatcaagggactagagactgcaaaacgtctcctaaaagaagcagtcgtcatgcccataaaatacccaaaatacttcactggcctactatcaccgtggaaaggcatcttactttttggtcctcctggaacagggaagacaatgctggcaaaagcagttgctaccgagtgcaatactacattcttcaacatttcagcttcatcaattgtcagcaaatggcgtggagattctgagaagctagtgaaagttctttttgagcttgcaagacatcatgcaccatcaactatatttcttgatgagattgatgctattattagtcagcgtggtgaagctcgtagtgagcatgaagctagtcgacgcttgaagactgagctacttattcagatggatggcttgacaaaaacgaacgacttagtatttgtgcttgcagcaacaaatctaccatgggaattagatgcagctatgctccgtcggcttgagaaacggattcttgtaccacttcctgaagctgaagcaaggcatgccatgtttaaggaacttttgccagcaatgacctcaaatctagaggtcccatatgatatcctggtcgaaaagactgaagggtactctggttcagacatccgtctcgtgtgcaaagaagctgccatgcagccactgagacgtctcatgtcagttcttgaggccagtgatgagctggtgccagaggaagacctgcctgaggttggccctctcaaacctgaagacgtcgaacttgctttgagcaacacaaggccgtcagcccatctccaagcacatcgttatgaaaaatttaaccaggactatgggagccatattctttcttaagagtgaaccacgatcagcttctcaggtttgccaagtgatgcacggttgtggttcatttgaacatgtaccggtacaaagctatcttgccctacaaggccacaccaatcaaaatggcattgtcgcacaattatatttatcatttgacagtcaagcaggatgcaaaaattgttgctaaatgcattagattgatttaagttgcgatgcaatcattgggcatctgatttttctgcgtcagctctgcttgactagactgaaatattacctgtaatgatcatactccaaaataattaacaaatgattcgttgagtaggatttatgatgaaataaataaatgttaggcatgttgaataaggaaaacaaaaaaaaaaaactaagaagactagacaagacacacaggagagcccc

SEQ ID NO: 964 - DNA, 1688 bp, Secale cereale
ggggcatgggtggcatctcgacaaatcgaggcgggacccacccgccgatctccggcaaccaaccgctggtactagtccctgtcccgcccccctcccgattctccggggagtctgagcgagctcacgaacagcacaccagtcgactcgctcgctctcactctcccctccggcgcccgtggacgcagccggcagatccgagcaatggatttgagggcgttcttcgggggcaagaagcaggagccggagcagaacgggcacgccaacggggcggcgcccaacgggagcgtcaagaagaggacccccgagttggccatctacgagcagtacgagcagcaggccaggcagccggagatgcgcgccgcggcgattcgcgatgggaatgctgatgtgatccagaagcctctcctacctcaattcgagtcagctgaaatgcgtaacttagcagagacattgttgcgggatattatccgtgggagccctgatgtgcaatgggaaagcatcaagggactagagactgcaaaacgtctcctaaaagaagcagtcgtcatgcccataaagtacccaaaatacttcactggtctactatcaccgtggaaaggcatcttactttttggtcctcctggaacagggaagacaatgctggcaaaagcagttgctactgagtgcaatactacattcttcaacatttcggcttcatcaattgtcagcaaatggcgtggagattctgagaagctagtcaaagttctttttgagcttgcaagacatcatgcaccatcaactatatttcttgatgagattgatgctattattagtcagcgtggtgaagctcgtagtgagcatgaagctagtcgacgcttgaagactgagctacttattcagatggatggcttgacaaaaacgaacgacttagtatttgtgcttgcagcaacaaatctaccttgggaattagatgcagctatgctccgtcggcttgagaagcggattcttgtaccacttcctgaagctgaagcaaggcatgccatgtttaaagaacttttgccagcaatgacctcaaatctagaggtcccatatgatatcctggtcgaaaagactgaagggtactctggttcagacatccgtctcgtgtgcaaagaagctgccatgcagccactgagacgtctcatgtctgttcttgaggccaatgatgagttggtgccagaggaagagctgcctgaggttggccctctcaaacctgaagacgtcgaacttgctttgagcaacacaaggccgtcagcccatctccaagcacatcgttatgaaaaatttaaccaggactatgggagccatattctttcttaagagcaaaccacaatcagcttctcaggtttgccaagtgatgcacggtggtggttcatttgaacatgtaccggtacaaagctatcttgccctacaaggccacaccaatgaaaatggcattgtctcacaattatatttatcatttgacagtcaagcaggatgcaaaaattgttgctaaatgcattggattgatttaagttgcgatgcagtcattgggcatctgatttttctgcgtcagctctgcttgactagactgaaatattacctgtaatgatcatactccaaaataattaacaaatgattcactgagtaggatttatgatgaaataaataaatgttaggcatgttgaatg

SEQ ID NO: 965 - DNA, 1559 bp, Hordeum vulgare
gcacaccatccgactcgctcgctctcactctcccctccggcgcccgcagacgccgccggcagatccaagcaatggatttgagggcgttcttcgggggcaagaagcaggagccggagcagaacgggcacgccaacgggggcgtcaagaagaggaccgccgatttggccatctacgagcagtacgagcagcaggccaggcagccggagatgcgcgccgcggcgattcgcgatgggaatgctgatgttattcagaagcctctcctacctcagtttgagtcagctgaaatgcgtaatttagcagagacattgttgcgggatattatccgagggagcccagatgtgcaatgggaaagcatcaagggactagagacagcaaaacgcctcctaaaagaggcagttgtcatgcccataaagtacccaaaatacttcactggtctactatcaccgtggaaaggcatcttactttttggtcctccaggaacagggaagaccatgttggccaaagcggtcgctactgagtgcaatactacattcttcaacatttcggcttcatcaattgtcagcaaatggcgtggagattctgagaagctagtcaaagttctttttgagcttgcaagacatcatgcaccatccacaatatttcttgatgagattgatgctattattagtcagcgtggtgaagctcgtagcgagcatgaagctagtcgacgcttgaagactgaactacttattcagatggatggcttgacaaaaaccaaagacttagtatttgtgcttgcagcaacaaatctaccatgggaattggatgcagctatgctccgtcggcttgagaagcggattcttgtaccacttcctgaagctgaagcaaggcattccatgtttaaggaacttctgcccgcaatgacctcaaatctagaggtcccatatgatattttagttgaaaagactgaagggtactctggttcggatattcgtcttgtgtgcaaagaggctgctatgcagccattgaggcgtctcatgtcagttctcgaagccagtgatgagctggtgccagaggaagagttgcctgaggttggccctctcaaacctgacgacgtggaacttgctttgagcaacacaaggccgtcagcacatctccaagcacatcggtatgaaaaatttaaccaggactacgggagccatattctttcttaataagatcaacaaagcacggtcagcttctcaggtttgccaagcggatgcgcgttggtggttcatttgaacatgtaccggtacaaagctatcttgccctacaaggccacgccaatcgaaatggccttgttgctccattatatttatcattggactgtcgccaagcaggatgcaaaaaactcttgatgtgtctcttctagcgggactatactgctttggagatcctgtgagccagagtggtcttaggaatagtttcttgcctgatgtaacgtctttttttttgaattgtttggattgcttatcacatgttctcgcttgtagtaactttgttatcagaaataaaagtgcatggaagaaaaaaaaaaaaaa

SEQ ID NO: 966 - DNA, 3264 bp, Oryza sativa
tgtgaattgtgggcaggtttgcatcgctggtccagcagctttgaacacaagcacggagacgcaattctggcatcctgcggggaggaaaatgcagcggcggtgcagtactctccccggatccgcatccagatcctcccccgatctcgatggcatctggacaaaactcccgcgggccccaccaactgatgccggccccaccaactgatctcccactgtgtaccagtcgctgtgcccgctagctcccccagtctccggggagaccgaccgtgcgagatcgcgaccacgtagtgcggcgctcgctctcgctctcccccgcggcagagtcaggcgccgcccggcgaagcgcgaggcccgcggagcaatggatttcaaggggttctgggagtccagattcgggggcaagaaggagcaggagccggagcagaacgggcacgccaatggggtggcgaacgggagcgtcaggaagaggacgtccgatttggcggtctacgagcagttcgagcagcaggccaggcagacggaggtgcgcgccgcggcgattcgcgatgggaatgctgatgcgatccagaagcccctcctaccttcgtttgagtcagctgaaatgcgtaatcttgcagagacattgttgcgggacattattcgcggcagtccagatgtgaaatgggaaagcatcaaaggactggagaatgccaaacgccttctaaaagaggcagttgtcatgcccataaagtatcccaaatacttcactggtctcttgtcaccatggaaaggcattttactttttggtcccccaggaactgggaagacaatgctggcaaaggctgttgctactgagtgtaaaactacattcttcaacatttcagcatcatcaattgttagcaaatggcgtggggattcagagaagctagttaaagttctgtttgagcttgctagacatcatgcaccatcgacaatatttcttgatgaaattgatgctattatcagccaacgtggtgaagctcgcagtgagcatgaagctagtcgacgcttgaagactgagctactcattcagatggatggcttgacaaagacgaacgacttggtatttgtacttgcagcaacaaatttaccttgggaactggacgcagctatgctccgccggcttgagaaacggattctcgtacctcttcctgaggctgaagcaaggcatgctatgtttgaggaacttttgccatcaactacctcaaagctagaggttccatatgatactttagttgagaagactgaagggtactctggttcagatatccgtcttgtgtgcaaagaagctgccatgcaaccactaagacgtcttatgtcagttcttgaagccagagatgagctggtgcctgaggaagaattgcccgaggttggtcctctcaaacctgaagacatcgaagttgctttgaggaacacaaggccgtctgcgcatctccatgcacatcgctatgagaagtttaaccaggattacggaagccagatccttagtcaggagcaagcctgaacttctcaaagttcagacataccattttcaggacgcaacattttttctgcagcagtttaagttgtgaggcgaacgttacaaacggatgttgctgctgcagcagttatgaaataaatagcatcatgaatatcgaacgcaattgcctccttttatatgtgctccgcatcgtcgaagcagaaggctggatcctatgctgccagttttcctttgcaccggctaataccactagtatggtacgaccaacgtccacatgatccatcccatttataacggacgaccagcgatggagcgcgcaaacaacatgacatcgcaaaagcggccattggcacataatcattccattaaaggctgatcacacgcagaagtgataatatcacacgagaagatgttttcttcacaaatgaacaggcccggcgtgaccgatttccagttcgttacatgcaaaataagataaccaagtgcattcaatcacaacgaactggctcagcagagccaacgcttcgggcaaactcaaggtaatcccctcactgaatcggccgtcttcccagaccttgcatcagaccaggccttggctattgtgcgcttcatgtcttcgtcaccttcctcatacatgttctgcagacataagtagcacaacagtcagaacaggatttccagactaattgttcaagtctgaagtcatgactcatcattatgacgggtaggtgtttaccttcatcaaatccataattccagacattggatccttctccttagccatgcttggcttgaactgtcagcaaattaaagttagcacatctatatatcattatcagtaccataaccaattattttaggagccaaacaaattctacatgtaggtgttatccaacttgcccagacagactattgaaatgaccaattttattttcaaaagaaaaactgaacaaagtaacttggagcaatgattgaccaatgaccagcagaaatagtgcaagacaagtggatacagaaacttcaaacaattggtcagcaatgagattatcggtttaatcattgcacaaaagcacgaataatactgaagtgccataacataaagttaattatgttagttgtgattgagaacatacgagcatatgatttatcatggcaacagaaggatcaagggtaaattagcatagtgagctttcagtgcttcctcattgatatacatgtacgtaagtacataaaatgccacatggagaactaactcaattcacgaatgtacactctggtcaccagttggcatcaccgctaccataaattatttacactggagaatccaatatttttggaagtatgttctttggtgttcaggttaagaaaatgcattaaagcaacaatcattgtgcattagaacaaaaacaaataaatagcttggcatatcaactagacaattaccttatcctccttgaaatgcaagtctaaccagttgcctttggaagctttgtaaagcgtcacaataatctttgtaggcttgactaaaaccttgcatttctcaggaacaatttctttgtgcagcttaggtatggcacatcggtagttcttgcccttcacatcatggaattttgtatctactgacataggcttaaaagtagtctccaccttatcttgctcaacaccctccaggaaaacataaatctgaagatggacaaagctagattattatctcaatgctcataaagtctccacatgcaaatgccacaggatttgattaataaaca

SEQ ID NO: 967 - DNA, 2321 bp, Oryza sativa
cgctggtccagcagctttgaacacaagcacggagacgcaattctggcatcctgcggggaggaaaatgcagcggcggtgcagtactctccccggatccgcatccagatcctcccccgatctcgatggcatctggacaaaactcccgcgggccccaccaactgatgccggccccaccaactgatctcccactgtgtaccagtcgctgtgcccgctagctcccccagtctccggggagaccgaccgtgcgagatcgcgaccacgtagtgcggcgctcgctctcgctctcccccgcggcagagtcaggcgccgcccggcgaagcgcgaggcccgcggagcaatggatttcaaggggttctgggagtccagattcgggggcaagaaggagcaggagccggagcagaacgggcacgccaatggggtggcgaacgggagcgtcaggaagaggacgtccgatttggcggtctacgagcagttcgagcagcaggccaggcagacggaggtgcgcgccgcggcgattcgcgatgggaatgctgatgcgatccagaagcccctcctaccttcgtttgagtcagctgaaatgcgtaatcttgcagagacattgttgcgggacattattcgcggcagtccagatgtgaaatgggaaagcatcaaaggactggagaatgccaaacgccttctaaaagaggcagttgtcatgcccataaagtatcccaaatacttcactggtctcttgtcaccatggaaaggcattttactttttggtcccccaggaactgggaagacaatgctggcaaaggctgttgctactgagtgtaaaactacattcttcaacatttcagcatcatcaattgttagcaaatggcgtggggattcagagaagctagttaaagttctgtttgagcttgctagacatcatgcaccatcgacaatatttcttgatgaaattgatgctattatcagccaacgtggtgaagctcgcagtgagcatgaagctagtcgacgcttgaagactgagctactcattcagatggatggcttgacaaagacgaacgacttggtatttgtacttgcagcaacaaatttaccttgggaactggacgcagctatgctccgccggcttgagaaacggattctcgtacctcttcctgaggctgaagcaaggcatgctatgtttgaggaacttttgccatcaactacctcaaagctagaggttccatatgatactttagttgagaagactgaagggtactctggttcagatatccgtcttgtgtgcaaagaagctgccatgcaaccactaagacgtcttatgtcagttcttgaagccagagatgagctggtgcctgaggaagaattgcccgaggttggtcctctcaaacctgaagacatcgaagttgctttgaggaacacaaggccgtctgcgcatctccatgcacatcgctatgagaagtttaaccaggattacggaagccagatccttagtcaggagcaagcctgaacttctcaaagttcagacataccattttcaggacgcaacattttttctgcagcagtttaagttgtgaggcgaacgttacaaacggatgttgctgctgcagcagttatgaaataaatagcatcatgaatatcgaacgcaattgcctccttttatatgtgctccgcatcgtcgaagcagaaggctggatcctatgctgccagttttcctttgcaccggctaataccactagtatggtacgaccaacgtccacatgatccatcccatttataacggacgaccagcgatggagcgcgcaaacaacatgacatcgcaaaagcggccattggcacataatcattccattaaaggctgatcacacgcagaagtgataatatcacacgagaagatgttttcttcacaaatgaacaggcccggcgtgaccgatttccagttcgttacatgcaaaataagataaccaagtgcattcaatcacaacgaactggctcagcagagccaacgcttcgggcaaactcaaggtaatcccctcactgaatcggcggtcttcccagaccttgcatcagaccaggccttggctattgtgcgcttcatgtcttcgtcaccttcctcatacatgttctgcagacataagtagcacaacagtcagaacaggatttccagactaattgttcaagtctgaagtcatgactcatcattatgacgggtaggtgtttaccttcatcaaatccataattccagacattggatccttctccttagccatgcttggcttgaactgtcagcaaattaaagttagcacatctatatatcattatcagtaccataa

SEQ ID NO: 968 - DNA, 1625 bp, Sorghum bicolor
gtcccccctctccccctagtctccggggagagtacactcgtcgactccagtcgctcgctcgctctctccctcccccgaggtaccggggacaggcagccgccgaagcgcgccgccggccgtgaatcaatggatttcaaggggttctgggagtccagattcgggggcaagaaggagccggaggagcagaacgggcacgccaacgggagcgtgccgaagaggacctccgatttggcggtctacgagcagttcgagcagcaggccaggcagacccaggtccgagccgccgcgattcgcgatggaaacgctgatgtgatccagaagccccttctaccttcatttgagtcagctgaaatgcgtaatcttgcagagacattgttgagggatattattcgcgggagcccagatgtgaaatgggagagcatcaaaggactggaaaatgcaaaacgccttctaaaagaagctgttgtcatgcccataaagtacccaaaatacttcactggtcttctttctccctggaaaggcatcttactttttggccccccagggacaggaaagacaatgctggcaaaagcggttgctactgagtgcaaaaccaccttcttcaacatttcagcttcatcaattgtcagcaaatggcgtggagattcagagaagcttgtcaaagttctgtttgagcttgctaggcatcatgcaccatccacaatatttcttgatgaaatagatgccattatcagccagcgtggtgaagctcgtagtgagcatgaagctagtcgtcgcttgaagactgaactacttattcagatggatggtttgacaaagacaaacgacttggtatttgtacttgcagctacaaatcttccatgggaattggatgcagctatgctccgcaggcttgagaagcgaattcttgtaccgcttcctgaagctgaagcaaggcaagcaatgtttgaggaacttctgccagcgactacctcaaagttagaggttccgtacaacatactagttgaaaagactgaaggttactctggttcagatatccgtcttgtgtgcaaagaagctgccatgcaaccactcagacgtctcatgtcagttcttgaagccagtgatgagttggtgccagaggaagaactgcctgaggttggtcctctgaaacctgaagatattgaacttgcattaaggaacactaggccgtcagcccatctccatgcacatcgctatgagaagttcaaccaggactatggtagccaggtcctttgttcagagtcagcatgatcttgttatcaggttgatgttccattgaatcacggaactagagcgtaggttgatgattgtcccgtgttgtcaaaatggttgctctggtaacgaggctcccagtcccagcagattgcaatttccctctggctgcagtacgcataggttgaagtgcgaggtgcaggtgcttgctgctcagatctctgtggctcttctcatgcaggctgagattttcccgaagccttgaacttacagcaaaaaaaaaaattgattcgttgtctagttacgtgtcaaataaatgttaggtaccctgcagaaaagtacactctggttatattgaacggaaagcgagccagagagctggtctaagtttc

SEQ ID NO: 969 - DNA, 1760 bp, Sorghum bicolor
tgaataaatgaataaacaagtctcacacatgtgccacgcgacgtatgggccggatctgggcgagtgtgacctcgttggcacctcgacaaagtttggcgggtcccacccccggatccctgcccggtactagttcccgtcccccctctccccctagtctccggggagagtacactcgtcgactccagtcgctcgctcgctctctccctcccccgaggtaccggggacaggcagccgccgaagcgcgccgccggccgtgaatcaatggatttcaaggggttctgggagtccagattcgggggcaagaaggagccggaggagcagaacgggcacgccaacgggagcgtgccgaagaggacctccgatttggcggtctacgagcagttcgagcagcaggccaggcagacccaggtccgagccgccgcgattcgcgatggaaacgctgatgtgatccagaagccccttctaccttcatttgagtcagctgaaatgcgtaatcttgcagagacattgttgagggatattattcgcgggagcccagatgtgaaatgggagagcatcaaaggactggaaaatgcaaaacgccttctaaaagaagctgttgtcatgcccataaagtacccaaaatacttcactggtcttctttctccctggaaaggcatcttactttttggccccccagggacaggaaagacaatgctggcaaaagcggttgctactgagtgcaaaaccaccttcttcaacatttcagcttcatcaattgtcagcaaatggcgtggagattcagagaagcttgtcaaagttctgtttgagcttgctaggcatcatgcaccatccacaatatttcttgatgaaatagatgccattatcagccagcgtggtgaagctcgtagtgagcatgaagctagtcgtcgcttgaagactgaactacttattcagatggatggtttgacaaagacaaacgacttggtatttgtacttgcagctacaaatcttccatgggaattggatgcagctatgctccgcaggcttgagaagcgaattcttgtaccgcttcctgaagctgaagcaaggcaagcaatgtttgaggaacttctgccagcgactacctcaaagttagaggttccgtacaacatactagttgaaaagactgaaggttactctggttcagatatccgtcttgtgtgcaaagaagctgccatgcaaccactcagacgtctcatgtcagttcttgaagccagtgatgagttggtgccagaggaagaactgcctgaggttggtcctctgaaacctgaagatattgaacttgcattaaggaacactaggccgtcagcccatctccatgcacatcgctatgagaagttcaaccaggactatggtagccaggtcctttgttcagagtcagcatgatcttgttatcaggttgatgttccattgaatcacggaactagagcgtaggttgatgattgtcccgtgttgtcaaaatggttgctctggtaacgaggctcccagtcccagcagattgcaatttccctctggctgcagtacgcataggttgaagtgcgaggtgcaggtgcttgctgctcagatctctgtggctcttctcatgcaggctgagattttcccgaagccttgaacttacagcaaaaaaaaaaattgattcgttgtctagttacgtgtcaaataaatgttaggtaccctgcagaaaagtacactctggttatattgaacggaaagcgagccagagagctggtctaagtttc

SEQ ID NO: 970 - DNA, 1645 bp, Panicum virgatum
gaggaccgagcgagaggacagtaggacaccactcgtcggctccgctccgtctcgctcgctgtgtcccccaggccccagaggcaggcagccggcgaacggccgaagcgcgccgccgcggagcaatggatttcaaggggttctgggagtccagattcgggggcaagaaggagcgggagccggagcagaacgggagcgccaacggcgaagccaacgggagcgccccgaagaggaccgccgatctggcggtctacgagcagttcgagcagcaggccaggcagacccaggtccgagctgccgcgatccgcgatggggctgccgatgtgatccagaagccccttcttccaccattcgagtcagctgaaatgcgtaatctcgcggagacattgttgagggatattattcgtgggagtccagatgtgaaatgggagagcatcaaaggattagagaatgcgaaacgccttctaaaagaggcagttgtcatgcccataaagtacccaaaatacttcactggtctcctttctccatggaaaggcatcttactttttgggcccccagggacaggaaagacaatgctggcaaaagcggtcgctactgagtgcaaaaccaccttcttcaacatttcagcatcatcaattgtcagcaaatggcgtggagattcagagaagcttgtcaaagttctgtttgagcttgctaggcatcatgcaccatccacaatatttctagatgaaatagatgccattatcagccagcgtggtgaagcccgtagtgagcatgaagctagtcgtcgcttgaagactgaactgcttattcagatggatggtttgacaaagacaaacgacttggtatttgtacttgcagctacaaatctaccatgggaattggatgccgctatgctgcgccggcttgagaagcggattcttgtaccgcttcctgaagctgaagcaaggcaagcaatgtttgaggaacttctgccagcaactacctcaaagctagaggtcccgtataatgtactagttgagaagactgaaggttactctggttcagatattcgtcttgtgtgcaaagaagctgccatgcaaccactgagacgtctcatgtcagttcttgaagccagtgatgagttggtgccggaggaagaactgcctgaggttggtcctctgaaacctgaagatatagaaattgctttaaggaacactagaccatcagcccatctccatgcacatcgctacgaaaagttcaaccaggactatgggagccaggttctatgttcagagcatgcttgattatcaggttgatgttccattcagccatggtagtggaatggacctatgctccccgtgcacatcagttagttcacatgttgacgggggtcacattgtgtcaaaatggttggaccggtaactaggttcctcggtagattgcaatttcaccatcattgattgaagtgttggctgcggtcacatctttttatgcatgtctctttagccaggcttagattttcacgaagcctctgatcttggagcagaacgttgattcgatgtttggttgcgtgtccaaataaatgtttggtaccttcagagatgtaccctggttaatagctatactgaactgaatgcgagcaggtctagattttcttgttcttatt

SEQ ID NO: 971 - DNA, 1690 bp, Pennisetum glaucum
ggtcctactactagttcgtactccattcccgtccccccttgcctcctgagtctccggggaggacctcgtcgactccgcccgctctcgctcgagctgttcctcctccaacggccccagaggaggcaggcagccggcgaagcacgccgccgcggagcaatggatttcaaggggttctgggagtccagattcgggggcaagaaggagccggagcagaacgggcacgccaacggagaaagcaacgggagcgccccgaagaggaccgccgatttggcggtctacgagcagttcgagcagcaggccaggcagacacaggtcgtccgagccgccgcgatccgcgatgggaatgctgatgtcatccagaaaccccttctgcctccatttgagtcagctgaaatgcgtaatctcgcagagacgttattgagagatattattcgtgggagtccagatgtgaaatgggagagcatcaaaggactagagaatgcaaaacgccttctgaaagaggcagttgtcatgcccataaagtacccaaaatacttcactggtctcctttctccatggaaaggcatcttactttttggacctccggggacaggaaagacaatgttggcaaaagcggttgctactgagtgcaaaaccaccttcttcaacatttcagcatcatcaattgtcagcaaatggcgtggagattcagagaagcttgtcaaagttctgtttgagcttgctaggcatcatgcaccatccacaatatttcttgatgaaatagatgccattatcagccagcgtggtgaagctcgtagtgagcacgaggctagtcgccgcttgaagactgaactacttattcagatggatggcttgacaaagacaaacgacttggtatttgtccttgcagctacaaatttaccatgggaattggatgctgctatgctgcgccggcttgagaagcggattcttgtaccgcttcctgaagctgaagcaaggcaagcaatgtttgaggaacttctgccagaaactacctcaaagctggaggtcccgtatgacgtactagttgaaaagacggacggttactctggttcagatattcggcttgtgtgcaaagaagctgccatgcaaccactgagacgtctcatgtcagttcttgaagccagcgatgagttagtgccagaggaagaactgcctgaggttggtcctctgaaacctgaagatatcgaaattgctttaaggaacactaggccatctgctcatctccatgcacatcgctacgaaaagttcaaccaggactatggaagccatgttctttgctcagagcaagcttgattaggttggcatggaactggaagggagctaatgtgcccctggacatgatgctaatcagtttgtttgcgtgttgatggggtcccattgtatcaaagtggttgcaccagtaactaggctcctcagtaaattgcaatttgcccaacattggctgaattgtgaagttgctggcagtggcaacgctcgtcatatgtttctgggggactttttagccaggctgagatcttttgcgaaaccttacatcaaaaaattggttcattgtagtttcttccctactttttggcctggttgtatcttgttttccctactttcttgtttctctttaggcttttgtaggttcttctcactgttttcctctcctgtcttgtgttttccctgg

SEQ ID NO: 972 - DNA, 2505 bp, Zea mays
cctgcgaccacaacgatgtttcctgcgacagcaacgatgtttgttgggttggtgaagcgagggagttcgaataatcagtcctcagttcctcacgcatgtggcacgcgatgggccggatctgaggttgagacgttgagtgtgcgatcccgttggcatctcgacaaagtttggtgggtcccaccgcagatcccggcccggtaggtactagttccgccgtcccccctccctagtctccggggaggaccgtctcggccgagagagtgcgctcgtcgactccactcagctctctcgctcactctcctcccccaaggtcctagagacaggcagccggcgaggcgcgccgccgcgaagcaatggatttcaaggggttctgggagtccagattcggtggcaagaaggaacccgagccggagcagaacgggcacgccaacggggtccagaaccagaagaggacctccgatctggcggtctacgagcagttcgagcagcaggccaggcagacccaggtccgagccgccgcgattcgcgacggagacgctgatgtcatccagaagccccttctaccttcatttgagtcagctgaaatgcgtaatctcgcagagacattgttgagggatattattcgcgggagcccagatgtgaaatgggagagcatcaaaggactggaaaatgcaaaacgccttctaaaagaggctgttgtcatgcccataaagtacccaaaatacttcactggtctcctttctccatggaaaggcatcttactttttggccccccagggacaggaaagacaatgctggcaaaagcggtcgctactgagtgcaaaaccaccttcttcaacatttcagcatcatcaattgtcagcaaatggcgtggagattcagagaagcttgtcaaagttctgtttgagcttgctaggcatcatgcaccatccacaatattccttgatgaaatagatgctatcatcagccagcgtggtgaagctcgcagtgagcatgaagctagtcgtcgcttgaagactgagctacttattcagatggatggtttgacaaagacaaacgacttggtatttgtacttgcagctacaaatcttccctgggaattggatgcagccatgctccgccggcttgagaagcggattcttgtaccgcttcctgaaggtgaagcaaggcaagcgatgtttgaggaacttctgccagcaactacctcaaagttagaaatcccgtacgacatactagttgaaaagactgaaggttactctggttcagatattcgtctcgtgtgcaaagaagctgccatgcaaccactgagacgtctcatgtcagttcttgaagccagtgacgagttggttccggaggaagaactgcctgaggttggccctctgaaacctgatgatattgaacttgcattaaggaacactaggccgtcagcacatctccatgcgcatcgctatgagaagttcaaccaggactacggtagccatgtcgtttgttcagagctagcatgatcttattatcgggttgatgtttcgttcaatcatggaaccagagcagagctaatatatgtcctgctccggcgcatcagtttgttggcatgttgatgggggtcgcgtgttgtcaaaacggttgctgcgctggtaacgcgactcccaacatattgcagtttccctctggccgcagtaccttgcattttgcatgggttaaagtgcgaggtgcaggtgcttgctgctcagatctatgtgggcatgtggctttgttcatgcaatctgagattttcccgaatccttgaactcagaaaaaaaagattcgttctctagttacgtgtctaataaatgttagttaccctgcagaaaagtacactctggtttatatttaaaggaaaacgagccagagagcttgtataagtttcttctgattgttggtgtaattacccagctcgttaaaccaagctttaacaacaaattcttgcatgttgtggtcaactgctatccaatgtccagtgtggcttgttgctcttggctagtcagcgaagcatcccgtgcgccgccacgtccagtgcctttcaagtttcaacacccctgcagtcgctttcttcccagttccaggcgagagcctcgctttcctgtttgacatcggccgtggcagacgagcaatctgcgtatactcgagcgctcattctcaaccggagcctggtatcaccaccaggtagactggcagagcgtcgcttgaaagaggcctggggctgcttgtgcccgccgccaagggtcacggagccgttcgatttatctggctagccggtaatcagtggtggccggttttgtgttaccgatttttatagtttgaatttagaatattttgtaaattttgataaaataaataatgtcagtttttgtataaatactatggattatttgatgactttctaaaaaaccaaaatttaaaatcgcaacaaaatgaaactaaaaaccaaacaagttttgtaaaatttaaaaataaaaaagaaaactc

SEQ ID NO: 973 - DNA, 1609 bp, Cenchrus ciliaris
  misc_feature (191)..(191): n is a, c, g, or t
  misc_feature (197)..(198): n is a, c, g, or t
  misc_feature (316)..(316): n is a, c, g, or t
  misc_feature (320)..(320): n is a, c, g, or t
  misc_feature (334)..(334): n is a, c, g, or t
  misc_feature (373)..(373): n is a, c, g, or t
  misc_feature (730)..(730): n is a, c, g, or t
  misc_feature (754)..(754): n is a, c, g, or t
  misc_feature (766)..(766): n is a, c, g, or t
  misc_feature (769)..(769): n is a, c, g, or t
  misc_feature (814)..(814): n is a, c, g, or t
ttcccgtgccctccctcccgagtctcccggggaggaccgggcgagagagtacacctcccgtcgtcgactccgcacactctcgctcgctctgtcccccacggccccagaggcaggcagccgccgcgccgaagcacgccgccgttgtgcaatggatttcaaggggttctgggagtccagattcgggggcaagnaggagnnggagcagaacggccatgccaacgggaacggggacgccaacgggagcgccccgaagaggaccgccgatttggcggtctacgagcagttcgagcagcaggccaggcagacccaggtccgngccnccgcgatccgcgangggaatgctgatgtgatccagaagccccttctgcctccntttgagtcagctgaaatgcgtaatctcgcggagacattattgagggatattattcgcgggagtccagatgtgaaatgggagagcatcaaaggactagagaatgcaaaacgccttcttaaagaggcagttgtcatgcccataaagtacccaaaatacttcactggtctcctttctccatggaaaggcatcttactttttggcccgccagggacaggaaagacaatgttggcaaaagcggttgctactgagtgcaaaacaaccttcttcaacatttcagcatcatcaattgtcagcaaatggcgtggagattcagagaagcttgtcaaagttctgtttgagcttgctaggcatcatgcnccatccacaatatttcttgatganatagatgccatnatnagccagcgtggtgaagctcgtagtgagcacgaagctagtcgccgnttgaagactgaactacttattcagatggatggcttgacaaagacaaacgacttggtatttgtccttgcagctacaaatttaccatgggaattggattctgctatgctgcgccggcttgagaagcggattcttgtaccgcttcctgaagctgaagcaaggcaagcaatgtttgaggaacttctgccagaaactacctcaaagctagaggtcccgtacgacgtactagttgagaagacagagggttactctggttcagatattcggcttgtgtgcaaagaagctgccatgcaaccactgagacgtctcatgtcagttcttgaagccagcaatgagttagcgccagaggaagaactacctgaggttggtcctctgaaacctgaagatatcgaaattgctttaaggaacactaggccatctgctcatctccatgcacatcgctacgaaaagttcaaccaggactatggaagccatgttctttgctcagagcaagcttgatcagttaaggttgccatggaactggaagggaagggagctaatctgcccctggacatgatgcacatcagtttgtttgccggggtcccattgtatcaaaatggttgcatcagtaactaggctcctcagtagattgcaatttgcccaacattggctgaattgtgaagttgctggcagtggcagcgctcgtcgtatgtttctggggggactttttagccaggctgagatcttttgcgaaaccttacttcaaaaaattgattcattgttgactcatatgtcggaataaatgttttggtgccctca

SEQ ID NO: 974 - DNA, 1704 bp, Panicum virgatum
tttcccggaccggtactagtccccgtacccctccttcccgagtctccggggaggatcgggcgagaggacaggacaccactcgtcggctccgctctctctcgctcgctctgtcccccaggccccagaggcaaggcagccggcgagcgagcgaagcgcgccgccgcggagcaatggacttcaaggggttctgggagtccagattcgggggcaggaaggagcgggagccggagcagaacgggagcgccccgaagaggaccgccgatctggcggtctacgagcagttcgagcagcaggccaggcagacccaggtccgagccgccgcgattagagatggggctgccaatgtgatccagaagccccttctacctccattcgagtcagctgaaatgcgtaatctcgcggagacattgttgagggatattattcgtgggagtccagatgtgaaatgggaaagcatcaaaggattagagaatgcaaaacgccttctaaaagaggcagttgtcatgccaataaagtacccaaaatacttcactggcctcctgtctccatggaaaggaatcttactttttgggcccccagggacaggaaagacaatgctagcaaaagcggtcgctactgagtgcaaaaccaccttcttcaacatttcagcatcgtcaattgtcagcaaatggcgtggagattcagagaagctcgttaaagttctgtttgagcttgccaggcatcatgcaccatccacaatatttcttgatgaaatagatgccattatcagccagcgtggtgaagctcgtagtgagcacgaagctagtcgtcgcttgaagactgaactacttattcagatggatggtttgacaaagacaaacgacttggtatttgtactagcagctacaaatctaccatgggaattggatgccgctatgctgcgccggcttgagaagcggattcttgtaccacttcctgaagctgaagcaaggcaggcaatgtttgaggaacttctgccagcaattacctcaaagctagaggtcccgtatgatgtactagttgagaagactgaaggttactccggttcagatattcgtcttgtgtgcaaagaagctgccatgcaaccactcagacgtctcatgtcggttcttgaagccagtgatgagttggtgccggaggaagaactgccggaggttggtcctctgaaacctgaagatatagaaattgctttaaggaacactaggccatcagcccatctccatgcacatcgctacgaaaagttcaaccaggactatgggagccaggttctatgttcagagcaagcttgattatcaggttgatgttccattcaaccatgggagtgtggagtggagctagttcatttgttgatggggggtcacattgtgtcgaaatggttggactagtaactaggctccacggcagattgcaattgcccatcattggttgaagtgttggctgcgctcgtatctttctgcaggcgcctttagccaggctgagattttcacgaagcctctgatcttgcaacaaaaggtcgattcgttgtttggttgcgtgtcaaaataaatgcttggtaccttcagagatgtagactggttaatagttattgaatgcgagcaggtctagatttttttttattattgttgacgatatccaagcatccaactcgttaaccaagtcttttttataacaaccaagctttaagat

SEQ ID NO: 975 - DNA, 1189 bp, Setaria italica
gccaattcgtcttcccaggatttcaaggggttctgggagtccagattcgggggcaagaaggagccggaacagaacgggagcgctaacggggacgccaacggggccgccccaaagaggaccgccgatttggcggtctacgagcagttcgagcagcaggccaggcagacacaggtccgagctgctgcgatccgcgatgggaacgctgatgtgatccagaagccccttctgcctccatttgagtcagctgaaatgcgtaatctcgcggagacattattgagggatattattcgtgggagtccagatgtgaaatgggagagcatcaaaggactagagaatgcaaaacgccttctaaaagaggcagttgtcatgcccataaagtacccaaaatacttcactggtctcctttctccatggaaaggcatcttactttttggccccccagggacaggaaagacaatgttggcaaaagcagtcgctactgagtgcaaaaccaccttcttcaacatttcagcatcatcaattgtcagcaaatggcgtggagattcagagaagcttgtcaaagttctgtttgagcttgctaggcatcatgcaccatccacaatatttcttgatgaaatagatgccattattagccagcgtggtgaagctcgtagtgagcacgaagctagtcgtcgcttgaagactgaactacttattcagatggatggtttgacaaagacaaacgacttggtatttgtccttgcagctacaaatttaccatgggaattggatgctgctatgctgcgccggcttgagaagcggattcttgtaccgcttcctgaagccgaagcaaggcaagcaatgtttgaggaacttctgccagaaactacctcaaagctagaggtcgcgtacgacgtactagttgaaaagactgaaggttactctggttcagatattcggcttgtgtgcaaagaagctgccatgcaaccactgagacgtctcatgtccgttcttgaagccagcaatgagttagtgccagaggaagaactgcctgaggttggtcctctgaagcctgaagatatcgaacttgctttaaggaacactaggccatcagctcatctccatgcacatcgctacgacaagttcaaccaggactatggaagccaggttctttgctcagagcaagcttgatcaggtttgcacgaaattt

SEQ ID NO: 976 - DNA, 1488 bp, Setaria italica
cgacgatggccgccccccgctgcgcggatccgacccactgtccggccgacccgccgtgtcacgcgccaacgggggcgcggacctcgctgtcttcgagcagttcgagcggatggagaggaaggtggagatgcgcaatggggctatagaggacgggccgccgcagaaacctctgcttccttcatttgaatccgcagaaacgcgcaacttagccgagacattgttgagggatataattcgtgggagcccagatgtcaaatgggaaagcataaaaggtctggagaatgcaaagcggcttctcaaagaagcagttgtcatgcccatcaaatatcccaagtacttcacaggcctattatcaccttggaaaggtatactactatttggtccacctgggacaggaaagacgatgctagcaaaagctgtggctactgaatgcaaaactacctttttcaatatttctgcctcatcaattgtgagcaagtggcgtggtgactcggagaaactagtgaaagtcttatttgagcttgcaaggcatcatgcaccatctaccattttccttgatgagattgatgctataattagtcaacgtggtgaagctcgtagtgaacatgaagctagccgacgattgaaaactgagctgttaatacagatggacgggttgactaagacagatgagcttgtttttgttctagcggccacaaatttaccatgggagctggatgcagcaatgctgcgtcggctggagaagcgtattcttgtaccattgccagagccagatgctagacatgctatgtttgaagagctcctgccatctactactggcacaatggagattccctacgatgttcttgtggagaaaactgaaggatattctggctctgatattcgccttgtatgcaaggaggcagcaatgcagcccctaagacggttaatgacagttctcgaacgcaatcaagaggttcctgaagatgagttgcctgaagttggtccagtaacgacagaagatattgaacttgctttgaggaatacaaggccgtctgctcatcttcatgcacatagatatgagaagttcaaccaagattatggcagtcatgtccatggctgaaggagactgttgtaagatatttgtattcagtacggaacttgtgcatgggctgatagataatgtggaatttccatcgatggaatgaaggtatccttgtaaacactatgcttatccttgtatgctgtacattatcattcatttgatgagtaataagctcttgggtaatttagtccctggaataagcagaaactaggactctatgcctacatttggctcgatttacctatttctctggcgttactcttaattcctgtttcatgatccatttcttgagtttcttccactgggcagattgcgccccttcctattgagaaagtcaatccattaatctctttcatgaccctttatagcagcggtgccagaggaaacacagaatattgagggca

SEQ ID NO: 977 - DNA, 2328 bp, Secale cereale
ctcgttcccgtagcttcgccgtgccgcaacgaggagacgaggcctcgcaggggaagctcgccaccatgatctccgcggagaggagccagtcgcagagcccgcggtcgcccggggcggcggccggggcgcctttcctgtcgatctgcgtcacggatcccgtcaagatgggcaccggcgtccagtcctacatctcctaccgcgtcatcaccaagactaacctacctgaattcgagggagcagagaaaattgttatccggcgctatagtgattttgagtggctgcatgatcggctagctgagaagtacaaaggcatttttgtacctcctcttccagagaagaatgctgttgagaaattccggtttagcaaagaattcattgaattgaggcgccaagctctggacctattcatcaacagactagcttcacaccctgaacttaagcaaagcgaagatttgaggacgtttttgcaggcagatgaagagaaaatggatagagcaaggtcttatgagactggtatatttaagaagccgggagatttcatacagatgtttaaggatgtacagtcaaaagtcagtgatgttgttctgggaaaagaaaagccagtggaagagtctactcctgaatatgagaagcttaaacattacatatttgagctagaaaatcatctagcagaggcccagaaacaagcatttcgccttgtaaaaaggcacagagaacttgggcaatctttggcggactttgggaaagcgattaagcttttaggcgtctgcgaaggggattcattggagaaggtgttttctgaagttggttcaaagtcagaaatgttgtcaataaagctgcaaagagaggcagacaaccttctctttaattttgaagaacctttgaaagattatgtgcgtgctgtgcagtcaataaaggccactatgcttgatcgagccaatgcttttaggcagcactttgacttggaccaggagaggaagtataaagagcttaaccttgaaaaaatgaagttgatgaaccccgacaagttttccgagtcggaaaccgagttcagtgagttgaaagcagccagtgaagaggctacgaagaggtacgagcacatagttagtgtaatgaacgacgagcttgcacgattccaggagcagaaaacagctgatattggacttgcgttccatgagtttgccaaagggcaagcaaagttagctaaagatattgctgatgcgtggcgcagcgtcctcccaaagctagaggcgtgttccacttcataatcgaagctgtgtttgccccccgtgtttgatatagtggttggccctttgagttttaggctgtttttttccagcccaatttgacagtggttcatatgtatacttaaaagtgatgattgacaatgctccagttgttttatattgacttcttttcttacagtgtgagcgtgtactctgtaactcaaattttcgaccaattagtctaactattgaagttcttggggaagtatgaataaagagagaaaagtagtggacagtggagaacttgtatctttattttggaagagaacataagaggagaacttgaaaatagggtttacaaattacaagtcgtgtcaacaggagaatggcaatcctgctgcatcatgttccttctttactgtcaaacttgcacaatttagcagacttgtcgaatttgcagaatctgaaacaggcttgtcaaacttgcgcaatctgaatggacttctggagcgccatgaggaggctcctcatgatcctgggctccccaggcggctccatgtccttcatagcaccgttcctgattgctcggaacacaaacccggagccgtctgtcgccggagacaccaggcagtcgatgtaggccagcagcgaggtcgcgccgtcgtcgatcccgatgaaccctagcctgatcccgccctccaccttgtccaccttgataggcactggcagtggcaacatggcgccttggcagagactgttcccccactgaaagagcaacccctcgaaccgagcgacgtcgatgttggcgggcagcttcacggtgccgaggctgaccccgtcgtcgtcggccggcacaatgccgccctttcccggcacggcgcgcggcggtttcgccgacaccctcgccctgaaactggggagcttctcggccttgttgaagcacctggagctgtaagcagagaggccatggctgctggaggtgtgcttggggagcgtccctgaggagcaggaggaagtgatcctgtggaccaacagctgccttgcgatcgcagccgccatgttcttttccttctgagggaggcaggatggatggagattcagg

SEQ ID NO: 978 - DNA, 853 bp, Triticum aestivum
caggaattcggcacgaggccggccctggtattgcactctctcaagcctgaacctccatcctgccttccaccccagaaagaaaagaacatggcagctgcgactgcaaggcagctgttggtccacaggatcacttcctcctgctcctcagggacgcttcccaagcacagttccagcagccatggccgctctgcttacagctccatgtgcttcaacaaggccgagaagctccccagtttcagagcgagggtgtccgtgaagccgccgcacgccgtgccggggaagggcggcattgtgccggccgacgacgacggggtcagcctcggcaccgtgaagctgcccgccaacatcgacgtcgctcggttcgaggggttgctctttcagtgggggaacagtctctgccaaggcgccatgttgccactgccagtgcctatcaaggtggacaaggtggagggtgggatcaggctagggttcattgggatcgacgacggcgcgacctcgctgctggcctacatcgactgcttggtgtctccggcgaccgatggctctgggtttgtgttccgagcaatcaggaacggtgctatgaaggacatggagccgcctggggagcccaggatcatgaggagcctcctcatggcgcttcagaagtccattcagattgcgcaagtttgacaagcctgttcagattgcgcacatttgacaagtctgttaaattgtgcaagtctgccagtgaagaaggaacatgatgcagcaggagtttcattctctgttgatacaactttgtaatccctagttttcaaaggtctcctttcatgttctcttccaagatgaagatataaattccattagaggaagt

SEQ ID NO: 979 - DNA, 800 bp, Hordeum vulgare
gcctgcctccctccctcctcctcagaaagagaaaacacatggcggctgcgactgcaaggcagctgttggtccacaggatcacttcctcctgctcctcggggacgcttcccaagcacgcttccagcagccatggcatctctgcttacagctccaggtgcttccacaaggccgagaagctccccggtttcagggcgagggtgcccgtgaagccgccgcgcgccgtgccggggaaggccggcattgtgccggccgacgatgatggggtcagcctcggcaccgtcaagctgcccgccaacatcgacgtcgctcggttcgaggggctgctctttcagtggggaaacagtctatgccaaggcgccatgttgccactaccagtgcctatcaaggtggacaaggtggagggtgggatcaggctagggttcattgggatcgacgacggcgcgacctcgctgctggcctacatcgactgcttggtgtctccagcgaccgacggctccgggtttgtgttccgagcaaccaggaacggtgctatgaaggacatggagccgcctggggagcccaggatcatgaggagcctcctcatggcgcttcagaagtccatccagattgcgcaagtttgacaagcctcttcagattgtgcaaatttgacaagtctgctaaacagtaattaaggaaattgatgaagcaggattgctgttctctgttgatacgacttgtaaaccctctacttttcaaggtttcctttcatgttctcttacaaaataaagatacaaattccattagaggaagtatataaaagc

SEQ ID NO: 980 - DNA, 765 bp, Avena sativa
ttctcatctcaagtctgaaatctgagtctccattctgcattgccatcccacctgcagagcccaaaagcatggctgctgcaactgcacggcagcttctggtccacaggatcacctcctcctgttcttcagggactcttccaaagcacactttcaacagtcatggcttccatgccacctccagctgcttcaaggccgagaagctcccaagtttcagggcaaggctggccatcgcaccgccgcgtgccgtgccggggaagggcggcattgtgccggccaacgacgacggggtcagcctcggcacggtgaagctgcctggcaacatcgacgtggctcggttcgaggcattgctatttcagtgggggaacagcctctgccaaggcgcaatgttgccgctaccagtgcctatcaaggtggataaggtggagggcgggatcaggctagggttcatcggaatcgatgacggcgcgacatcgctcctggcctacatcgactgcctggtgtcgcaggcgcccgacggctccggactggtgttccaagcaatcaggaacggtgctatgaagaacatggaaccacctggggagccaaggatcatgaggagcctcctccaggcccttcaaacgtctattcgtctgtcgcaagtttgacactgaacaaggaacatgatgcagcaggctttgctattctctgtcgatacgacttgtaaaccctgttttccaggtctcgtttcatgtactcttccaaacaaatgaagatatacattcagtt

SEQ ID NO: 981 - DNA, 7187 bp, Oryza sativa
caaaacctccgctctcttttggtccgttaactctttcttcgcccatccctcctcgcctcgccttttgcagctgtagctcactgccactaatactaccgatttctcctccgcctccgcctcgccgccgccaaatctagggtttccgcctccatgcatgcgcctcacccgaggccgaggtgttgcagaggaggagatttgatttgatttgagattccgatggcggcgcccggcggcgccaggaggcccgacttctcctccgcggcctcgccctctccctcgccggcgggggcagccgggaggaggctgctccgcacccagaccgtcggcaacttgggcgagtccatcttcgacagtgaggtcgtcccctcctcgctcgtcgagatcgcccccatcctccgtgtcgccaacgaggtcgaggccaccaacccacgcgtcgcctacctatgccgtttctatgctttcgagaaggctcatcgcctcgaccccacctccaatggccgtggtgttcgtcaattcaaaaccgcgcttctgcagaggcttgaaagggaaaatgatccaacattgaagggaagggttcaccagagtgacgctcgagagatgcaacgtttctaccgtgaatactacaagaagtacatccaggcacttcaaaatgctgccgacaaggctgaccgtgctctgctcactaaggcataccaaactgctgctgtcttgttcgaggtcttgaaagccgtcaatgtttcccaatctgttgaagtcgatcaagcgattctggatacacacaacaaagttgaggaaaagaaaaagctctatgttccttacaatattctgccactcgatcctgagagtacttatcaacctattatgcaatatccagagattcaagcagctgttaatgcgctaaggaatattagaggcctgccgtggcccaaggaacatgaaaagaagcctgatgaaaagaagactggcaaagaccttcttgattggcttcaggccatgtttgggtttcagaaagataatgtgtccaaccaaagagaacatctaatactgttacttgcaaatgtgcacataaggcagtctcctaagactgagcaacaagcaaagttggacgacagagctctagatgctgtaatgaagaagctatttaagaattataagaagtggtgcaagtaccttggccgcaaaagcagtttatggttgccaactatccagcaggaagttcagcagcgtaagcttctctacatgggtctctatttgctaatttggggtgaggcggctaacttgaggttcatgccagagtgtctttgctacatctaccatcatatggcttttgaactctatggcatgttggctggaaacgtgagtccaatgactggtgaaaatgttaaaccagcgtatggtggtgatgaagaggccttcctgatgaaagtagtgactccaatttacaaagttatagagaaggaagctgaacggagcaagaccataaagtcaaaacactcacattggaggaactatgatgatttaaatgagtatttttggtcagtggattgttttcggctaggatggcctatgagagcagatgctgattttttcaaaactcctgaagatgcttaccctagtcgtcttaatggagagaacagatccgcaggtaatgtccattggatgggaaagattaattttgtcgagatccgttcattctggcacatatttcgtagtttcgacagaatgtggatcttcttgatattatccttacaggccatgattattattgcctggaatggtggcacaccaagtgatatattcgacgttggagtatttaagcaggttttgagcatatttataacggctgcagttttgaagttagggcaagcaattctggacattgtatttggctggaaagcaagaagaagcatgtcatttgcagtcaagctgcgatatgtcttgaagttaatttcatcatctgcatgggttgtgattttgcctgtgacttatgcatatacctgggacagtcctacaggtcttgcaagaataattaaaagttggcttggcaatggtcagaatcagccatcactgtatattttggctgttgtgatatatttggcaccaaacatgcttgctgctatgctgtttcttttcccgttcctcagaaggtttcttgagagttcaaatgttaaggtcataacattcatcatgtggtggtctcagcctcgactatttgttggcagaggaatgcatgaaggcgcattttccctcttcaagtataccatgttctgggtcctccttttagcaatgaaattgacagtaagcttctatatagagatcaagcctctggtacagccaaccaaagatataatgaaagagccgatccgggatttccagtggcatgaatttttccctcgtgctaacaataacattggtgttgttattgcgctgtgggctccaataattcttgtctacttcatggacacccaaatttggtatgcacttttctctacattgatcggtggtatctatggggcttatcgtcgtcttggtgagatacggacattaggaatgttgagatctcgttttgaatctctgcctgaggccttcaatgagcacttgattccttctgattcacacaagagtaaaggtttgcgtgctgcctttactggtaaaccttctaagacttctggtgatgagcaagagaaagagaaaatagccgcaagatttgctcaaatgtggaacctaattatcacaagtttccgtgaggaagatcttatagataacagggagatggacttgctacttgtcccatactgtaaagaccgtgaattgaatatattccagtggccacctttcctacttgctagcaagattccaatagcattggatatggcggcagacagtggaggaaaagatcgtgatctgaagaagagaatgggatcagatccgtatttttcctatgctatcagagagtgctatggttcattcaaaaacatcatcaatactttagtgtttggtcaacgtgagaaaatagtaatacagcagatttttacaattgttgatgaacacatagaagggggaagtctaataaaggatttgaacatgaggagccttcctgccctgagcaagaagttcattgaactacttgaattactgcaaaagaataaggaagaagacttgggccaagttgtcattttattccaagatatgcttgaggtggtcacaagggatataatggatgagcaagaccagctaggcggactattggattctgtacatggtggaaatagaaaacacgaaggaatgacttcacttgatcaacaagatcagttgttcactaaagctattaggttccccgtggaggaatcaaatgcatggacggaaaagataaagaggcttcaccttcttctcactgtgaaagagtctgctatggatgtccctacgaaccttgatgctaggagacggatatcgttctttgcaaattctctttttatggagatgcctaatgctccaaaagtgcggcatatgttgcccttctctgtcttgactccttattacaaggaagatgttcttttctcctctcataatctggaagagccaaatgaggatggggtttccatacttttctacttacaaaaaatctacccagatgaatggaaaaatttccttgatagggtggaccgcaagagcgaggaggagctccgtgaggatgaaacattggaagaggagcttcgcctttgggcatcatataggggacagacattgacaagaactgtgagaggaatgatgtactaccgaaaagcgttggagcttcaggctttccttgacatggccaaagatgatgatcttatggaaggttacagagcaactgaactgatgtctgaggactcgcaattgatgactcaatgcaaagctatagctgacatgaaatttacatatgttgtctcgtgccagcaatatggaatccagaaacgttctggtgaagcctgtgcgcatgatattttgaggctaatgacagtatatccatcacttcgagttgcttatattgatgaggttgaagcacctagccaagatagaaacaagaagactgacaaagtttactactcagcattggtgaaagcttccgttacaaaacctaatgaaccaggacaaagtcttgatcaggtcatatacaagataaaacttccaggtaatgctattttaggtgaaggaaaaccagaaaatcagaatcatgcaattatttttactcgtggtgaatgcctccaaactatagatatgaatcaggagcattatatggaggaggctttgaaaatgagaaatctgctggatgagtttctgaagaaacatgatggtgtgagatatccatcaatacttggagtaagagagcatatatttactggcagtgtttcatcccttgcatggttcatgtcaaatcaggagaccagttttgtgactattggacagcgtgtgcttgccaaccccctgagggttcgattccactatggccatcctgatatctttgatcgtcttttccacctcacaaggggtggtgtaagtaaagcatccaaaattatcaatcttagtgaagatatatttgccggtttcaattcaacattgcgtgaaggcaatgtcactcatcatgagtacatgcaagttggcaagggaagagatgtgggtctcaaccaaattgctctgtttgaggcaaagatagcaaatggtaatggtgaacaaacactgagccgtgacatttatcgactagggcaccggtttgatttcttcagaatgctgtcatgctattacacaacaattggcttctactttagtacaatgattacagtatggactgtatatgttttcctctatgggcgcttatatcttgtcctcagtggactggaccaagcactagccactggaaagaagtttgtgcataatgcacccctccaagttgctcttgcatcagagtcttttgttcaacttggatttttgatggcgttgcccatgatgatggaaattggtctggagaggggattcagaacagcactaagcgactttgtacttatgcaacttcagttggcatctgttttctttacattttcacttgggaccaaaactcattattacggaaggacattactccacggaggagctgaatatagagccactgggcgtggatttgtggtgtttcatgccaagtttgctgacaactaccgactttattctcgcagccattttgtcaagggtattgagctgatgattttgctggttgtgtatgaaatctttgggcaatcatacagaggggctatcacatacattttcatcactgtttccatgtggtttatggtgggcacctggctctttgcaccattcctattcaatccttctggatttgagtggcagaagattgtggatgactggactgattggaataagtggatcagcaaccgtggaggtattggagtagcaccaacaaaaagttgggaatcatggtgggaaaaagagcaggagcctcttcgatactctggaaagcgtggtactattcttgaaattctgctcgcgttgcgcttctttgtctaccaatatgggcttgtgtatcatttgaatataaccaagcatactcgcagtgtactggtttattgcttttcatgggttgtgattttcgtaattttacttgtcatgaagactgtttcagtcggtaggaggaggttcagtgcggagttccagcttgtcttccggttgatcaagggccttatattcataacatttgtcgccattgttgtgatattaattgccatccctcacatgacagttcttgatatcttcgtttgcatccttgctttcatgccaactggatggggcttgcttctgattgcgcaagccatcaaacctgctgtccaggctattgggctttggggatcaatcaaggctcttgcccggggctatgagatcctaatgggactcctgttattcacacccatagcgttccttgcttggtttcctttcgtgtccgagttccagaccaggatgctcttcaaccaggccttcagcagaggtctgcagatctcccgtatccttggcgggcacaagaaagaccgatcaacccggaacaaggagtagactgagcggcgagggctccccccaaaccaattgttgtagtagtatgcattatcctagtaggagtatccgcccccagttttgcgtgtgctctgattgtcaccagattcagagaccgggggaggcgtacgctaagctagcgtatcagcatgtttcagtgtatctgcagattcacaacattcgcacctctccattatgtaaatctctatcgctcattagcaaatcggagcatctaatttagagatgtcttctgggttagtagtaatatatctggtgaacagagttgattgaatgtttgtgggagcaaatcatgttttaaagatcctgctcttgcatctcttaaggcatcagagcagtttttgatgttcttgtggtgtgcacgatgctcatgtgttccagggaaaaaagaaagagagcaaagctactattaagctataaagtggagtatgctcctgggcaacggcttgtgacttgtgagcatggatcattggcaggcagatgcatgtgtctcccctccaagaaaagaagaaaaaggaaatgcacatactaagttttcaggtgatacagacaaatgggaaagctgtttgcttgagtgggtggtaatgtacgcggcgattgctgaccaagtatgcatagcatacatgttctttttctgctttgatgaagtgcaccaaccaccgaacccacaactccaactaacaccgctaaattgctacagccctacgctgatgacggtatggttactaaaccgcctgttttgactgctcttactgctcaatacatgcatgtttggagctaagtggtggtgacttatttgctaaaaaaaatggagaagcataaatgttagtgtaagcacattacagaaattcacgttccactggtggaaggacagggcatgcttggttaatgcatgggttttaccattaaaaaaagttttaatctgaaccatccatctttttcctgaccttctatttattgtaacccattatccaaaacgcctgatgttcacacctacgcaaaatggaagaaacattagatcatagtagacacaaactataattagaaaaaaagagatcaaaatagtaaaagaacaa

SEQ ID NO: 982 - DNA, 6499 bp, Sorghum bicolor
tgctgctgctgcggactgaggtgaggtgacgcgggagcgggatggcggcgccggggcggaggacggccgacgtgtcctcgtcctcgccggccccctcgccgtccccggccgccccttcctccaccggcaggcgtctcctgcgcacccagacagtcggcaacctcggcgagtccatcttcgacagtgaggtcgtcccgtcctcgctcgtcgagatcgcacccatcctccgtgtcgccaacgaggtcgaggccaccaacccgcgcgtcgcctacctctgtcgcttctacgctttcgagaaggctcaccgcctcgacccgacttccagtggccgtggtgttcgtcagttcaagaccgcacttctgcagaggcttgagagggaaaatgatcccaccttgaagggaagggtgcatcagagcgatgctagggagatgcagcgcttctaccgtgaatactacaagaagtatattcaggcactgcaaaatgctgctgataaggctgaccgtgcactgctcactaaggcataccaaacagctgctgtcttgtttgaggtcttgagggccgttaatgtttcgcagtctgttgaagtcgatcaagcgattttggatacacacaataaggtcgaagaaaagaaaaagttgtttttaccttgtaacattcttccgcttgatcctgaaagtactggtcaagccattatgctatatccagagattcaagctgctgtttatgctctgcgcaatactagaggcctgccatggccaaaggaccaagacaagaagcctgatgagaagaatactggtaaagaccttcttgattggcttcaggctatgtttgggtttcagaaagacaacgtgtccaaccaaagggaacatttgatactgttgcttgcaaatgttcatataaggaaaatacccaaggctgacctacaaccaaagttggacgacaaagctctggatgatgtaatgaagaagctatttaagaattataagaagtggtgcaagtacctcggccgcaaaagcagtttatggttaccaaccatccagcaggaagtgcagcagcgtaagcttctttatatgggcctctacttgctgatttggggtgaggcggctaacttgagattcatgccagagtgtatttgttacatctaccatcatatggcttttgaactctacggtatgctggctggaaatgtgagcccaatgaccggtgaaaatgttaaaccagcatatggtggtgatgaagaagcctttttgatgaaagtcgtgactccaatatacaaagttatagagaaggaagctgaaaggagcaagaccatgaaatcaaagcactcacattggagaaactatgatgatctgaatgagtacttttggtcagttgattgtttccgtctaggatggcctatgagagctgatgctgactttttcaaaactccgaaagacgcttatccgaatcttttgaatggagagaacaggtctgcaggcaatgtccattggatgggaaaagttaattttgtggagatacgttcattttggcacatattccgtagtttcgacaggatgtggatcttcttaatattgtccttgcaggccatgataattattgcttggaatggtggaacaccaagtgatatctttgatgctggagtatttaagaaggttttgagcatatttattactgctgcaattttgaagttgggtcaagcaatcctagacctcgtatttggctggaaagcaagaagaagcatgtcatttgcagtcaagctacgatatgtcttgaagttaatatctgctgctgcatgggttgtgattttacctgtgacttacgcgtacacttgggagaatcctactggtctcgcaagaacaataaaaagctggcttggtgatggtcagaatcagccatctttgtatatattggccatagtgatatatatggcaccaaacatacttgcttctatgctatttcttttcccatttatgagaagattcctagagagttcaaatgttaaggtcataacgatcatgatgtggtggtctcagcctcggttatttgttggcagagggatgcatgaaggtgcattctccctcttcaagtataccatgttctggattattcttttagcaatgaagttgatagtaagcttctatattgagatcaaacctctggtacagccaaccaaagatataatgagagaacctatcaggacattccagtggcacgagtttttccctcatggaactaacaatattggtgttgttatatcactctgggctccaataatcctggtatatttcatggacacccaaatttggtatgcactgttctctactctgattggtggcatctacggggcttatcgtcgtcttggtgagatacggacattaggaatgttgagatctcgctttgaatctttgcctgaggccttcaatgaacgcttgattccttctgatgcaaataagagtaaaggtctccgtgctgcttttttgagtagacccaaggttcctggtgacgaaagagagagagagaaaagagctgcaaggtttgctcaaatgtggaacgttattattacaagcttccgtgaagaagacctcattgacaatagggagatggatctgctactggttccatactgtaaagaccgtgaacttgatatattccaatggccgcctttcctacttgctagcaagatcccaatagcactggatatggcagcagacagtggtggtaaagaccgtgatctgacgaagaggataaaatcagatccatacttttccttcgctatcagagaatgctatgcttcattcaagaacatcatcaataccttagtgtttggtcagcgggagaaggatgtcctagcaaagatttttacagttgttgatgagcatatagaagatggaactctgataaaggatctcaacatgaggaaccttcctgcactgagcaagaagtttgttgaattacttgagttactgcaaaaaaacaaggaagaagacttgggtcaggtagtcattttgttccaagatatgctcgaggtggtcacaagggatataatggaggaacaggatcagctcagcacactgttggattccatacatggtgcccatagtagaaaacatgaagggattacaccgctagatcagcaagatcagttgtttgctaaagctattaagttccctgtggaggaatcaaatgcatggactgaaaagataaagaggcttcaccttctgttaactgtgaaggagtctgctatggatgttcctactaatcttgatgctaggcggcggatatcgttctttgcaaattctctatttatggatatgcccaatgctccaaaagttcggaacatgttgcccttctctatcttgactccttattacaaggaagatgttctgttctcattacaaaatctggaagagccaaatgaggatggagtttccattcttttctacttacaaaaaatttacccagatgaatggaaaaatttcctcgaaagggtgggctgcaagaatgaagaggaactccgtgaagatgaagaactggaagagaagcttcgtctttgggcatcatatagggggcagacattaacaagaactgtaagagggatgatgtactatcgaaaagctttggagcttcaggcttttcttgatatggccaaagatgatgatcttatggaaggctacagagcaacagaagtaatgcctgaggactcacaattaatgactcaatgcaaggctatagctgacatgaagtttacatatgttgtctcatgccaacaatatggaattcagaagcgttctaatgagccttgtgcacatgatattttgagactaatgacggagtatccatcacttcgggttgcctatattgatgaagttgaagcgcccagccaagatagaaacaagaagattgaaaaggtttactactccgtgttagtcaaggcttctgttacaaaacctaatgagcctggtcagagccttgatcaggtcatctacaagataaaactaccaggtaatgccattttaggtgaaggaaagccagaaaatcagaaccatgcaataatattcacccgcggcgaatgtctccaaactatagatatgaatcaggagcactatatggaggaggctttgaaaatgagaaatctgctgcaagagtttcagaagaaacatgatggagtgagatatccatcaatacttggagtcagagaacacatatttacgggcagtgtgtcatcccttgcatggttcatgtcaaatcaggaaactagttttgtgacaattggacaacgagtgcttgccaatccgttgagggttcggtttcattatggtcatcctgatgtttttgatcgccttttccacgttacgaggggtggtgtgagtaaagcatccaaaattatcaatcttagtgaggacatatttgcaggattcaattccacattgcgtgaaggcaatgttactcaccatgaatacatgcaagttggcaagggaagggatgtgggtctcaatcaaatatctctgtttgaggcaaagatagcaaatggaaatggcgaacagacgctgagccgtgacatctaccggctaggtcatcgctttgatttcttcaggatgctgtcttgttactacacaacaattggtttctacttcagtacaatgattacagtatggactgtatatgttttcctctacgggcggctatatcttgtacttagtggacttgatgaagcactggctactggaaggaggtttgtgcgcaatgcacccctccaggttgcgcttgcatcagagtcttttgtgcaacttgggtttttgatggcgctacccatgatgatggaaatcggtttggagagaggattcagaactgcattgagtgactttatactgatgcaacttcagttggcctctgttttcttcacattctcattgggaacaaaaactcactactacggaaggacgttactccatggaggagctgaatacagagccactggacgtgggtttgtggtgttccatgccaaatttgctgacaactatcgactttattcccgtagccattttgtgaagggcatcgagctgatgattctactggttgtgtatgaaatatttggtcagtcatatagaggggctataacttacatcttcatcaccgtatccatgtggttcatggtgggcacttggctctttgcacccttcctgttcaatccttctggatttgagtggcaaaagattgtggatgactggactgattggcacaagtggatcagcaatcgtggaggtattggtgtagcaccagagaaaagctgggagtcatggtgggaaaaagagcaagagccccttcggtactctgggaagcgtggtactattgtcgaaatactgcttgcattgcgtttctttatttaccaatatggacttgtgtatcatctgaacataacgaagaagataaccaaggataaccagagtgtgctggtttattgcttctcatgggttgtaatttttgtcattttactggttatgaagaccgtatcagtgggcaggaggaggttcagtgcagagttccagctcgtgttccggttgatcaagggtctcatatttataacttttacagccatcgtggtaatcttaatagcaatccctggcatgacggttctggacatctttgtttgcatccttgctttcatgcccactggatggggtttgctcctgattgcccaagcgatcaggcctgtgattcaaaagattgggctgtgggggtcaatcaaggctcttgcccggggctacgagatcttgatgggacttctcctgttcacgcccattgccttccttgcctggttcccgttcgtgtccgaattccagaccaggatgctgttcaaccaggccttcagcagaggtctgcagatctcccgtatcctcggaggccacaagaaagaccgagggacccggaacaaggagtagttacgggatgctgattgaaggttacggcggacgccggcgccggtagtcctggaacaatcaggttcagagagtagagggcggctgggagcatgatgcagtagcctgcctagctagtaggagtatatgtcaagccgtattgtgtgttgtgttgcacctagtactagtagtagtatgtaaatctgtggctctgtgcatgctgaggtttgctttgtatggtcttgtggatcggaggcatctgagatttgctagtagtgcaatggccagtatctgatctgatattcaatcgtgcatggcaggcgtcatatctgagctgatgttggtctagctggggttgagccatgctgacaagtgagaatgattactatctgggatgaggacaaccaggaaaatggaggcaaaatatgtagtacgtagttggtggcatagccgattgagattggcaatgactttgggcttgtggttgataactgattgctgaccaagtaacaatatcgaccgaactactaacacgcaacagagaaccatgccaacttaaacatctagtaccaattttttaatgt

SEQ ID NO: 983 - DNA, 7062 bp, Sorghum bicolor
cgttacctcctcctcctccatttcactggcggctgctcttctctgctcatcccactccactccctccctctccatcccccctccatttcactggcccgcctcgccgtcgcccgccgccaaatccgatctagggttccattccacctccacgcgccgtccacccaaaaggcaaagctagctcggccgcattacctgctgctgctgcggactgaggtgaggtgacgcgggagcgggatggcggcgccggggcggaggacggccgacgtgtcctcgtcctcgccggccccctcgccgtccccggccgccccttcctccaccggcaggcgtctcctgcgcacccagacagtcggcaacctcggcgagtccatcttcgacagtgaggtcgtcccgtcctcgctcgtcgagatcgcacccatcctccgtgtcgccaacgaggtcgaggccaccaacccgcgcgtcgcctacctctgtcgcttctacgctttcgagaaggctcaccgcctcgacccgacttccagtggccgtggtgttcgtcagttcaagaccgcacttctgcagaggcttgagagggaaaatgatcccaccttgaagggaagggtgcatcagagcgatgctagggagatgcagcgcttctaccgtgaatactacaagaagtatattcaggcactgcaaaatgctgctgataaggctgaccgtgcactgctcactaaggcataccaaacagctgctgtcttgtttgaggtcttgagggccgttaatgtttcgcagtctgttgaagtcgatcaagcgattttggatacacacaataaggtcgaagaaaagaaaaagttgtttttaccttgtaacattcttccgcttgatcctgaaagtactggtcaagccattatgctatatccagagattcaagctgctgtttatgctctgcgcaatactagaggcctgccatggccaaaggaccaagacaagaagcctgatgagaagaatactggtaaagaccttcttgattggcttcaggctatgtttgggtttcagaaagacaacgtgtccaaccaaagggaacatttgatactgttgcttgcaaatgttcatataaggaaaatacccaaggctgacctacaaccaaagttggacgacaaagctctggatgatgtaatgaagaagctatttaagaattataagaagtggtgcaagtacctcggccgcaaaagcagtttatggttaccaaccatccagcaggaagtgcagcagcgtaagcttctttatatgggcctctacttgctgatttggggtgaggcggctaacttgagattcatgccagagtgtatttgttacatctaccatcatatggcttttgaactctacggtatgctggctggaaatgtgagcccaatgaccggtgaaaatgttaaaccagcatatggtggtgatgaagaagcctttttgatgaaagtcgtgactccaatatacaaagttatagagaaggaagctgaaaggagcaagaccatgaaatcaaagcactcacattggagaaactatgatgatctgaatgagtacttttggtcagttgattgtttccgtctaggatggcctatgagagctgatgctgactttttcaaaactccgaaagacgcttatccgaatcttttgaatggagagaacaggtctgcaggcaatgtccattggatgggaaaagttaattttgtggagatacgttcattttggcacatattccgtagtttcgacaggatgtggatcttcttaatattgtccttgcaggccatgataattattgcttggaatggtggaacaccaagtgatatctttgatgctggagtatttaagaaggttttgagcatatttattactgctgcaattttgaagttgggtcaagcaatcctagacctcgtatttggctggaaagcaagaagaagcatgtcatttgcagtcaagctacgatatgtcttgaagttaatatctgctgctgcatgggttgtgattttacctgtgacttacgcgtacacttgggagaatcctactggtctcgcaagaacaataaaaagctggcttggtgatggtcagaatcagccatctttgtatatattggccatagtgatatatatggcaccaaacatacttgcttctatgctatttcttttcccatttatgagaagattcctagagagttcaaatgttaaggtcataacgatcatgatgtggtggtctcagcctcggttatttgttggcagagggatgcatgaaggtgcattctccctcttcaagtataccatgttctggattattcttttagcaatgaagttgatagtaagcttctatattgagatcaaacctctggtacagccaaccaaagatataatgagagaacctatcaggacattccagtggcacgagtttttccctcatggaactaacaatattggtgttgttatatcactctgggctccaataatcctggtatatttcatggacacccaaatttggtatgcactgttctctactctgattggtggcatctacggggcttatcgtcgtcttggtgagatacggacattaggaatgttgagatctcgctttgaatctttgcctgaggccttcaatgaacgcttgattccttctgatgcaaataagagtaaaggtctccgtgctgcttttttgagtagacccaaggttcctggtgacgaaagagagagagagaaaagagctgcaaggtttgctcaaatgtggaacgttattattacaagcttccgtgaagaagacctcattgacaatagggagatggatctgctactggttccatactgtaaagaccgtgaacttgatatattccaatggccgcctttcctacttgctagcaagatcccaatagcactggatatggcagcagacagtggtggtaaagaccgtgatctgacgaagaggataaaatcagatccatacttttccttcgctatcagagaatgctatgcttcattcaagaacatcatcaataccttagtgtttggtcagcgggagaaggatgtcctagcaaagatttttacagttgttgatgagcatatagaagatggaactctgataaaggatctcaacatgaggaaccttcctgcactgagcaagaagtttgttgaattacttgagttactgcaaaaaaacaaggaagaagacttgggtcaggtagtcattttgttccaagatatgctcgaggtggtcacaagggatataatggaggaacaggatcagctcagcacactgttggattccatacatggtgcccatagtagaaaacatgaagggattacaccgctagatcagcaagatcagttgtttgctaaagctattaagttccctgtggaggaatcaaatgcatggactgaaaagataaagaggcttcaccttctgttaactgtgaaggagtctgctatggatgttcctactaatcttgatgctaggcggcggatatcgttctttgcaaattctctatttatggatatgcccaatgctccaaaagttcggaacatgttgcccttctctatcttgactccttattacaaggaagatgttctgttctcattacaaaatctggaagagccaaatgaggatggagtttccattcttttctacttacaaaaaatttacccagatgaatggaaaaatttcctcgaaagggtgggctgcaagaatgaagaggaactccgtgaagatgaagaactggaagagaagcttcgtctttgggcatcatatagggggcagacattaacaagaactgtaagagggatgatgtactatcgaaaagctttggagcttcaggcttttcttgatatggccaaagatgatgatcttatggaaggctacagagcaacagaagtaatgcctgaggactcacaattaatgactcaatgcaaggctatagctgacatgaagtttacatatgttgtctcatgccaacaatatggaattcagaagcgttctaatgagccttgtgcacatgatattttgagactaatgacggagtatccatcacttcgggttgcctatattgatgaagttgaagcgcccagccaagatagaaacaagaagattgaaaaggtttactactccgtgttagtcaaggcttctgttacaaaacctaatgagcctggtcagagccttgatcaggtcatctacaagataaaactaccaggtaatgccattttaggtgaaggaaagccagaaaatcagaaccatgcaataatattcacccgcggcgaatgtctccaaactatagatatgaatcaggagcactatatggaggaggctttgaaaatgagaaatctgctgcaagagtttcagaagaaacatgatggagtgagatatccatcaatacttggagtcagagaacacatatttacgggcagtgtgtcatcccttgcatggttcatgtcaaatcaggaaactagttttgtgacaattggacaacgagtgcttgccaatccgttgagggttcggtttcattatggtcatcctgatgtttttgatcgccttttccacgttacgaggggtggtgtgagtaaagcatccaaaattatcaatcttagtgaggacatatttgcaggattcaattccacattgcgtgaaggcaatgttactcaccatgaatacatgcaagttggcaagggaagggatgtgggtctcaatcaaatatctctgtttgaggcaaagatagcaaatggaaatggcgaacagacgctgagccgtgacatctaccggctaggtcatcgctttgatttcttcaggatgctgtcttgttactacacaacaattggtttctacttcagtacaatgattacagtatggactgtatatgttttcctctacgggcggctatatcttgtacttagtggacttgatgaagcactggctactggaaggaggtttgtgcgcaatgcacccctccaggttgcgcttgcatcagagtcttttgtgcaacttgggtttttgatggcgctacccatgatgatggaaatcggtttggagagaggattcagaactgcattgagtgactttatactgatgcaacttcagttggcctctgttttcttcacattctcattgggaacaaaaactcactactacggaaggacgttactccatggaggagctgaatacagagccactggacgtgggtttgtggtgttccatgccaaatttgctgacaactatcgactttattcccgtagccattttgtgaagggcatcgagctgatgattctactggttgtgtatgaaatatttggtcagtcatatagaggggctataacttacatcttcatcaccgtatccatgtggttcatggtgggcacttggctctttgcacccttcctgttcaatccttctggatttgagtggcaaaagattgtggatgactggactgattggcacaagtggatcagcaatcgtggaggtattggtgtagcaccagagaaaagctgggagtcatggtgggaaaaagagcaagagccccttcggtactctgggaagcgtggtactattgtcgaaatactgcttgcattgcgtttctttatttaccaatatggacttgtgtatcatctgaacataacgaagaagataaccaaggataaccagagtgtgctggtttattgcttctcatgggttgtaatttttgtcattttactggttatgaagaccgtatcagtgggcaggaggaggttcagtgcagagttccagctcgtgttccggttgatcaagggtctcatatttataacttttacagccatcgtggtaatcttaatagcaatccctggcatgacggttctggacatctttgtttgcatccttgctttcatgcccactggatggggtttgctcctgattgcccaagcgatcaggcctgtgattcaaaagattgggctgtgggggtcaatcaaggctcttgcccggggctacgagatcttgatgggacttctcctgttcacgcccattgccttccttgcctggttcccgttcgtgtccgaattccagaccaggatgctgttcaaccaggccttcagcagaggtctgcagatctcccgtatcctcggaggccacaagaaagaccgagggacccggaacaaggagtagttacgggatgctgattgaaggttacggcggacgccggcgccggtagtcctggaacaatcaggttcagagagtagagggcggctgggagcatgatgcagtagcctgcctagctagtaggagtatatgtcaagccgtattgtgtgttgtgttgcacctagtactagtagtagtatgtaaatctgtggctctgtgcatgctgaggtttgctttgtatggtcttgtggatcggaggcatctgagatttgctagtagtgcaatggccagtatctgatctgatattcaatcgtgcatggcaggcgtcatatctgagctgatgttggtctagctggggttgagccatgctgacaagtgagaatgattactatctgggatgaggacaaccaggaaaatggaggcaaaatatgtagtacgtagttggtggcatagccgattgagattggcaatgactttgggcttgtggttgataactgattgctgaccaagtaacaatatcgaccgaactactaacacgcaacagagaaccatgccaacttaaacatctagtaccaattttttaatgtataatatatacatgttgagctttaacaggtaacacaatgttgatgtacgtatattataaacattattatataagtgccgtatgcacgggtgatgcagaattttagattagaaggctgggactctacctacaaaacaaggaaggtggcaacattgaaaaaaaggatcgctcttgtaaaaatgttagaatacactgtctgcgaaatggtgaacgtagttgatcagtggactttcttttgcaaatttttgacagcaattaatcaaaattgtgtgttagttaatttaggacatactactgtaaaacctgaacttctattgtgttcaaagtgtgtttgatatttatttttagcaattcactgaggaactaaagag

SEQ ID NO: 984 - DNA, 6316 bp, Zea mays
ggcaagcttatctgcggagggagtgagctgacgcattcccgtgctggcgagggacagccagacccagacggggagatccgatccgattccgtgctagctgctgcggagtgagtgaggtgacgcgggagcgggatggcggcgccggggcggaggacggcggacgtgtcctcgtcctcgcccgccccctcgccgtccccttccaccggtaggcgcctcctgcgcacgcagaccgtcggcaacctcggcgagtccatcttcgacagcgaggtcgtgccgtcctcgctcgtcgagatcgcacccatcctccgcgtcgccaacgaggtcgaggccaccaacccgcgcgtcgcctacctctgtcgcttctacgctttcgagaaggctcaccgcctcgacccgacatccagtggccgtggtgttcgtcagtttaagaccgcacttctgcagaggcttgagagggaaaatgatcccacgctcaagggaagggtccaccagagcgatgctcgggagatgcagcgcttctaccgcgaatactacaagaagtacatccaggcactgcagcatgctgctgataaggctgaccgagcactgctcactaaagcgtaccagacagctgctgtcttgtttgaggtcttgagggccgttaatgtctcgcagtccgttgaagtcgatcaagcgattttggatacacacaataaggttgaagaaaagaaaaagttgtacgtaccttataacattctcccgcttgatcctgaaagtactggtcaagccattatgcgatatccagagattcaagctgctgtttatgctcttcgcaatactagaggtctgccatggccaaaggaccaagacaagaagcctggcgagaagaatactgggaaagaccttctcgattggcttcaggctatgtttgggtttcagaaagacaacgtgtccaaccaaagggaacatttggtactgttgcttgcaaatgttcatataatgaaagtacccaaggttgaccaacaaccgaagttggatgacaaagctctggatgctgtaatgaagaagctgtttaagaattataagaagtggtgcaagtaccttggccgcaaaagcagcttatggttgccaaccatccagcaggaagtgcagcagcgtaagcttctttatatgggcctctacctgctgatttggggtgaggcggctaacttgagattcatgccagagtgtatttgttacatctaccatcatatggcttttgaactctacggcatgctggctggaaatgtgagcccaatgacgggtgaaaatgttaaaccagcatatggtggtgatgaagaagcctttttgattaaagttgtgactccaatatacaaagttatagagaaggaagctgaaaggagcaagaccatgaaatcaaagcactcccattggagaaactatgatgatctgaatgagtacttttggtcagttgattgtttccggctaggatggcctatgagagctgatgctgactttttcaaaactccaaaagatgcttatctgaatcttttgaatggagagaacagatctgcaggtaatacccattggatgggaaaagttaattttgtggagatacgttcattttggcacatattccgtagtttcgacagaatgtggatcttcttaatattgtccttacaggccatgataattattgcttggaatggtggaacaccaagtgatatttttgatgctggagtatttaagaaggttttgagcatatttattactgctgcaattttgaagttgggtcaagcaatcctagacctcatatttggttggaaagcaagaagaaacatgtcatttgcagtcaagctgcgatatatcttgaagttaatatgtgctgctgcatgggttgtgattttacctgtgacttacgcgtacacttgggagaatcctactggacttgcaagaacaataaaaagttggcttggtgatggtcagaatcagccatctttgtacatattggccatagtgatatatatggcaccaaacatagttgcttctatgctatttcttttcccatttatgagaagattcttagagagttcaaatgttaaggtcataacgatcataatgtggtggtctcagccccggttatttgttggcagagggatgcatgaaggtgcattctccctcttcaagtataccatgttctgggttcttcttttagcaacgaagctgactgtaagcttctatattgagatcaaacctctggtacagccaaccatagatataatgagggaacctatcaggactttccagtggcacgaatttttccctcatggaactaacaatattggtgttgttatatcactgtgggctccaataattctagtatatttcatggacacccaaatttggtatgcactgttctcgacattaattggtggtatctatggggcttatcgtcgtcttggtgagatacggacattaggaatgttgagatctcgctttgaatctttgcccgaggccttcaatgaacgcttgattccttctgatgcaaataagagtaaaggtcttcgtgctgccttttcaagtagacccaaggcttctggtgacgaaagacagaaagagaaaagagctgcaaggtttgctcaaatgtggaatgtcattattacaagtttccgtgaagaagacctcatagacaatagggagatggatctgctactggttccatactgtaaagaccgtgagctcgatatatttcaatggccacctttcttacttgctagcaagatcccaatagcactggatatggcagcagacagtggcggaaaagaccgtgatctgacgaagaggataaaatcagatccatacttttcctttgctatcagagaatgctatgcttcattcaagaacatcatcaatactttagtgtttggtcagcgggagaaagatgtcctagcacagattttcgcagttgtggatcagcatatagaagatgaaactctgataaaggatctcaatatgaggaaccttcctgcactgagcaagaagtttgttgaattacttgaattactgcaaaaaaacaaggaggaagacttgggtcaggtagtcattttgttccaagatatgcttgaggtggtcacaagggatataatggaggaacaggaccagctcggcacactgttggaatctgcacatggtgcaaatagtagaaaacatgaaggaattacaccgctagatcagcaagaccagttgtttgctaaagctattaagttccctgtggatgaatcaattgcatggactgaaaagataaagaggcttcatcttctgttaactgtgaaggagtctgctatggatgttcctactaatcttgatgctaggcggcggatatcattctttgcaaattctttatttatggatatgcccaatgctccaaaagttcggaacatgttggccttctctatcttgactccttattacaaggaagatgttctgttctcattacaaaatctagaagagccaaatgaggatggagtttccattcttttctacttacaaaaaatttacccagatgaatggaaaaatttcctcgaaagggttggctgcaagaatgaagagggactccgtgaagatgaagaactagaagagaagcttcgtctttgggcgtcgtatagggggcagacattaacaagaactgtaagagggatgatgtactatcgaaaagctttggagcttcaggcttttcttgatatggcggaagatgatgatcttatggaaggttacagagcaacagaagtaatgcccgaggactcgcaattaatgactcaatgcaaggctatagctgacatgaagtttacatatgttgtctcatgccaacaatatggaattcagaagcgttctaatgagccttgcgcacatgatattttgagactaatgacggaatatccatcacttcgggtcgcctatattgatgaagttgaagcgcctagccaagatagaaacaagaagattgaaaaggtttactactcagtgttggtgaaggcttctgttacaaaacctgatgagcctggtcagagccttgatcaggtcatctacaagataaagctaccaggtaatgccattttaggtgaaggaaagccagaaaatcagaaccatgcaataatattcaccagaggcgaatgcctccaaactatagatatgaatcaggagcactatatggaggaggctttgaaaatgagaaatctgctgcaagagtttgagaagaaacatggagtgagatatccatcgatacttggagtcagagaacacatatttacgggcagtgtgtcatcccttgcatggttcatgtcaaatcaggaaactagtttcgtaacaattggacaacgagtgcttgccaatccgttgagggttcgttttcattatggtcatcctgatatcttcgatcgccttttccacattacgaggggtggtgtgagtaaagcatccaaaattatcaatctcagtgaggacatatttgcaggattcaattccacattgcgtgaaggcaatgttactcaccacgagtacatgcaagttggcaagggaagggatgtgggtctcaatcaaatatctctgtttgaggcaaagatagcaaatggcaatggcgaacagacgctgagccgtgacatctaccggctgggtcatcgctttgatttcttcagaatgctatcttgctactatacaacaattggtttctacttcagtacaatgattacagtgtggactgtatatgttttcctctatgggcggttatatcttgtacttagtggacttgatgaagcgctggctactggaaggaggtttgtgcacaatgcacctctccaggttgcgcttgcatcggagtcttttgtgcagcttgggtttttgatggcgctacccatgatgatggaaatcggtttggagagaggattcagaacagcattgagtgacttcatactgatgcagcttcagttggcctcagttttcttcacgttctcattgggaacaaaaactcattactacggaaggacattactccatggaggagctgaatacagagccactggacgtgggtttgtggtgttccatgcgaaatttgctgacaactatcgactctattcccgtagccattttgtcaagggcattgagctgatgattctactagttgtgtatgaaatatttagccagccatatagaggggctgtaacttacatcttcatcaccgtgtccatgtggttcatggtgggcacttggctctttgcaccattcctgttcaatccttctggatttgagtggcagaagattgtggacgactggaccgattggcacaagtggatcagcaatcgtggaggtatcggtgtagcaccagagaaaagctgggagtcatggtgggaaaaggagcaagagccccttcgatactccgggaagcgcggtactgttgttgaaatactgcttgcgctgcgtttctttatctaccagtacggacttgtgtatcatctgaatataacgaagaagataactaaggacaaccagagtgtgctggtttattgcttctcatgggttgtaatttttgtgattttgctcgttatgaagaccgtatcagtgggcaggagaaggttcagtgcagagttccagctagtgttccggttgatcaagggtctgatatttataacatttacagccatcgtggtaatcctaatagcgatccctggcatgacggtgctggacatatttgtttgcatccttgctttcatgcccactggatggggtttgctgctgattgcccaagcgatccggcctgtgatccacaagactgggctctggggctcgatcaaggctcttgcccggggctacgagatcctgatgggacttctcctgttcacgcccatcgccttcctcgcctggttcccgttcgtgtcggaattccagaccaggatgctgttcaaccaggcgttcagcagaggtctgcagatctcccgtatcctgggaggacacaagaaagaccgagggacccggaacaaagaatagggctgggctgctgctgattcaaggtttgtgtgcgccactagtatttatgtgtgaatgggtgggtagcatatggctcgagagtatctcctgaatggagattgattgatcctgaagagtagaagagactcgagtgatgtaagatgctgcaggcttgttgctttgttacctaggcgttaggcagaacagatgttttcaggatctctggcctgttaaccacatcttcccctgttcagagtgaattaattcctaatggaaactgatttgtgaattacttcctaatagaggagtgcttccaaactga

SEQ ID NO: 985 - DNA, 6496 bp, Setaria italica
aatctgcaaggtgtgctgtgctccactccactccactcgagcagcagcagcagcagcagtggcggcattgcgcccgagccgccgccaaatctagggtttccttccatgcgccttcccttctcccaaggtaaataaataacaaagaccccgccggcacgggatggcggcgccggggcggaggcccgacatgtcctcctcctcgccctcgccctcgccggccgccccgccatcctccgggaggcgcctcctccgcacgcagaccgtcggcaacctcggcgagtccatcttcgacagcgaggtcgtaccctcctcgctcgtcgagatcgcgcccatcctaagggtggccaacgaggtcgaggccaccaacccgcgcgtcgcatacctctgtcgcttctacgccttcgagaaggctcaccgcctcgaccctacttccagtggccgtggtgttcgtcagttcaaaacagcacttcttcagaggcttgagagggagaatgatcccacattgaagggaagggtgcaccagagcgatgccagggagatgcagcgtttctaccgtgaatactacaagaagtacatccaggcgcttcaaaacgccgccgacaaggctgaccgtgccctgctcaccaaagcataccaaacagctgctgtcttgttcgaggtcttgagagccgttaacgtctcacagtctgtcgaagtcgatcaagcgattttggatacacacaacaaagttgaagagaagaaaaagctctatgttccctacaatattcttcctcttgatcctgagagtaccaatcaagctattatgcgttacccagagattcaagcagctgtgtacgctctccgaaacattagaggcctgccatggccaaaggaccatgagaagaagcctgatgacaagaacactggtaaagaccttcttgactggctccagggcatgtttgggttccagaaagataatgtgtccaaccaacgggaacatctcatactgttacttgcaaatgtgcacgtaaggaaaataccaaaagctgaacaacagccaaagttagatgaccaagctctggatgctgtaatgaagaagctatttaagaattataagaagtggtgcaagtaccttggccgcaaaagcagtttatggttgccaactatccaacaggaagtacagcagcgtaagcttctttatatgggtctctacctgctgatttggggtgaggcggctaatttgagattcatgccagaatgtctttgttacatctaccatcatatggcttttgaactctatggcatgttggccggaaatgtgagcccaatgactggtgaaaatgttaagccagcatatggtggtgatgaagaagccttcttgatgaaagttgtgactccaatatacaaagttatagagaaggaagcagaaaggagcaagactataaaatcaaaacactcgcattggagaaactatgatgatctaaatgagtacttttggtcagtagattgtttccggctagggtggcctatgagggctgatgctgattttttcaagactcccaaggatgcctatcctaatcgtctgaatggggagaacacttctgtgggtagcgttcattggatgggaaaggttaatttcgtggagatacgttcattttggcacatattccgtagtttcgacagaatgtggatcttcttgatactatccttacaggccatgattatacttgcttggaatggtggcacaccaagtgatatctttgacacaaaagtgtttaagcaggttttgagcatatttattactgctgcagttttgaagttgggtcaagctctcctggacatcatatttggctggaaagcaagaagaagcatgtcatttgcagtgaagctgcgatatgtcttgaagttaatatcagctgctgcttgggttgtgattttacctgtaacttatgcatatacctgggagaatcctactggtcttgcaagaacaataaaaagctggcttggtggtggtcagaatcaaccatctttatacattttggctgttgtggtatacttggctccaaacatgcttgcctccatgctatttcttttcccattcctcagaaggtacctagaaagttcaaatgttaaggtcataacgttcatgatgtggtggtctcagccacgtttatttgttggcagaggaatgcatgaaggcgcattctccctcttcaagtataccatgttctgggtccttcttttagcaatgaagttgacagtaagcttctatatcgagatcaagcctctggtacagccgaccaaagatataatgagagaaccaatcaggacattccagtggcatgagtttttccctcatggaagtaacaatattggtgttgttattgcactttgggctccaataattctggtatatttcatggacacacaaatttggtatgcacttttctctacactgattggtggtatctacggggcttatcgtcgtcttggcgagataaggacactaggaatgttgagatctcgctttgaatctttgcctgtggccttcaatgagcgcttgatcccttctgatgcaaacaagaggaaaggtttgcgggctgctttttccaggaaacccaaggcttctgatgatgagaaagaggaagagaaaagagctgcaagatttgctcaaatgtggaacctaattatcacaagttttcgtgaagaagatctcatagataacagggagatggatttactacttgttccatattgtaaagatcgtgaattgaatatattccagtggccgccattcctacttgctagcaagattccaatagcgttggatatggcggcagacagtggtggaaaggaccgtgatttgacaaagagaatgggatccgatccatacttttcctatgctatcagagaatgctatgcttccttcaaaaacatcatcaatactttagtgtttggacagcgtgagaaacttgtcataaaagagatttttgatgttgtggataagcacatagcagaggaaaccctgataagggatctaactatgaggagccttcctgcactgagcaagaagtttattgacttacttgagttactgcaaaagaataaagaagaagacttgggtcaggtcgtcattttgtttcaagatatgcttgaggtggtcacaagggacataatggaggaagagcagcttggaggaatgttggaatccatacatggtggacataatagaagacatgaaggaattacaccactagatcagcaagatcagttgtttgctaaagctattaggttccccatggaggaatcggatgcatggactgaaaagataaagaggcttcaccttctgctaactgtgaaggagtctgctatggatgtccctacaaaccttgatgccagaaggcgaatatcgttctttgcaaattctctgtttatggagatgccaaatgctcctaaagtgcggaatatgttacccttctctgtcttgactccttattacaaggaagatgttctgttctcctcacaaaatctagaagagccaaatgaggatggagtttccatccttttctacctacagaagatttacccagatgaatggaaaaatttccttgaaagagtggaccgaaagagtgaggaggagctccgtgaggacgaagaattggaagaggagcttcgtctttgggcatcatataggggacagacattgacaagaactgtaagagggatgatgtactaccgaaaagctttggagcttcaggcttttcttgatatggcccaagatgatgatcttatggaaggttacagagcaactgaactgatgtccgaggactcacaattaatgacacagtgcaaggccatagctgacatgaagtttacatatgttgtctcgtgtcagcaatatggaatccagaaacggtctggcgaaccttgtgcacatgacatattgaggctaatgacaacgtgaatatccatcgctgcgggttgcctatattgatgaagttgaagcgcctagtcaggataggaacaagaaggttgaaaaggtttactactcggcattggtgaaggcttctgttacaaaacctaatgagcctggccagagtcttgatcaggtcatctacaagataaaactgccaggtaatgctattttaggtgaaggaaagccagaaaatcagaaccatgcaatcatattcactcgaggcgagtgtctccaaactattgatatgaatcaggtacagctctgtgcaatttgaggttttaggaaattatttttgcattcttgttcatttgcttatgttagatgcattgggagaaacgtgttaaccagtgatttttgctaaattttgtgcagtgtttcatcccttgcttggttcatgtcaaatcaggagactagttttgtgactattggacaacgtgtgcttgccaatccgctgagggttcgatttcactatggccatcctgatatcttcgatcgtcttttccaccttacaaggggtggtgtgagtaaagcatccaaaattatcaatcttagcgaggacatatttgcagggtttaattccacactgcgtgaaggaaacgttactcatcatgaatacatgcaagttggcaagggaagggatgtgggtcttaatcaaatatctctatttgaggcaaagatagcaaatggaaatggcgaacagacactgagccgtgacatctatcggctgggtcaccgctttgatttcttcagaatgctgtcttgttactatacaacaattggtttctacttcagtacaatgattacagtgtggaccgtatatgttttcctctatgggcggttatatcttgtcctaagtggacttgatgaagcactggctactggaaggaggtttgtgcacaatacgcctctccaggttgctcttgcatcagagtcttttgtgcaacttggatttttgatggcgctacccatgatgatggaaattggcctggagagaggattcagaacagctttgagtgactttgtactaatgcaactccaattggcatctgttttcttcacattttcacttgggaccaaaactcattactatggaaagacattgctccatggaggagctgagtatagagccactggacgtggatttgtggtgttccatgccaaatttgctgacaactatcggctttattcccgaagccattttgtcaagggtattgagctgatgattttgctagtcgtgtttgaaatatttgggcagtcatatagaggggctataacatacatcttcatcaccatctccatgtggttcatggtgggcacgtggctctttgcgccattcttgttcaatccttctggatttgagtggcagaagattgtggatgactggactgattggcacaagtggatcagtaatcgtggaggtattggtgtagcaccagagaaaagctgggaatcatggtgggacaaagaacaggagcctcttcggcactctgggaagcgtggtacaattgttgagatactgcttgcattgcgtttcttcatctaccaatatgggcttgtgtatcatttgaatataacaaagaagataaccaaggatacccacagtgtgctggtctattgcttctcatgggttgtaatttttgttatcttgctcgttatgaagactgtttcagtgggcaggaggaggttcagtgcagagttccagcttgtgttccggttgatcaagggtctcatatttataacatttacatccattgtgataatcttgatagcaatccctggcatgacagttctggacatctttgtgtgcatccttgctttcatgccgaccggatggggtttgctcctgattgcccaagcgatcaggcctgtgattcaaaagatcgggctctggggatccatcaaggctcttgcccggggctatgagatcctgatggggctcctcctgttcacacccatcgccttccttgcttggttcccgttcgtgtccgaattccagacgaggatgctgttcaaccaggccttcagcagaggtctgcagatctcccgtatccttggagggcacaagaaagaccgagcgaccaggaacaaggagtagaggtggaagctatctaagattgtgcaccccgaaattttgtcgtgcgctctgatggtgtcagagaattgggtggtggggagcatggtgcagtaggctagcaagcatttttcagactggagtgtatgtacctgtaggatcagaagtgttgcacctaatgctagtagtatgtaaagctgtatcgctgctaagcaaggtgcctctggattagtaggcagctgtatctgatatttcgatggtgaccatagaacctaagcagatgttgattgtccagatggggtcagatttgcaacccatgttatgtagcgtgcactcatagtatctgggaaggaaggaggtgggaaggaaaatcagttgttggttgctagggtgggttggcaatggcatggattgatcgctgaccaggtaacaacagcctctggcattggcatgagatgaggtgcttcaac

SEQ ID NO: 986 - DNA, 5883 bp, Secale cereale
aggctcgagagggagaacgacccgacactcaaggggagggtgcaccagagcgacgcgcgcgagatgcagcgcttctaccgcgagtactacaagaagtacatccaggcgctccagaacgctgccgacaaggccgaccgtgccctgctcacaaaagcgtaccagactgccgcggtcctgttcgaggtcttgaaagctgttaacgtgtcgcagtccgttgaagtcgatcaggcgattctggacacgcacaacaaaatcgaggagaagaagaagctctatgtgccttacaatatcctgcctcttgatcccgaaagtaccgatcaagctataatgcaaaaccccgagattcaagccgctgtctacgctcttcgcaatataagaggcctgccatggcccaaggacaaggagcaggagaagaagcaggaaaagaagcctgatgagaagaagaccgatagagatcttcttgactggcttcagtctatgtttgggtttcagaaagacaatgtagccaaccaaagggaacatctcatcctgttacttgcaaatgtgcacataaggcagataccaaagcctgaacagcaatctaagttggatgacagagctctggatactgtaatgaagaagctatttaagagttataagatgtggtgcaagtaccttggccgcaaaagcagtttatggttgccaactatccaacaagaagttcagcaacgcaagcttctctatatgggtctctaccttttgatttggggcgaggcggctaacttgagattcatgccagagtgtctttgctacatataccatcatatggcttttgaactctatggtatgttggctggaaacgtgagcccaatgactggtgaaaatgttaaaccagcttatggcggtgatgaagaggcattcttgatgaaagttgtgactccaatatacagggttatagaggaggaagctctcaggagcaagacaatgaaatcaaaacactcacactggaggaattacgatgatctaaatgagtacttttggaaagttgactgcttccggcttggatggcccatgagagccgatgcagattttttcaaaactcccaaatttgcttatcctaatcgtctgaatggagaggaaagatctgctggcagtgtccattggatgggaaagattaattttgtcgagatacgttcattttggcacatattccgtagttttgatagaatgtggatcttcttaattttatccctgcaggctatgattattattgcatggaatggtggcacaccaagtgatatctttgatgctggggttttcaaacaggttttgagcatatttataactgctgctgttttaaagttgggtcaagccaccctggacattgtatttggctggaaagcaagaagaagcatgtcgtttgcaagaaagctgcgatatgtcctgaagttagtatcagctgctgcatgggttgtgattctacctgtgacttatgcatatacctggtctaatccttcgggtctttcaagaataataaaaagttggcttggcaacggtcagaatcagccatcattatacattttggctgttgttatatatttggcgccaaatattcttgcagctacgctatttcttttcccatgtatcagaaggaggcttgagagttcaaatgttaaggtcataacattcatgatgtggtggtcccagcctcgattatttgttggcagaggaatgcatgagggtccattctccctcttcaagtataccatgttctgggttctccttttagcgatgaagttgatagtgagcttctatattgagatcaagcctctggtacaaccaacaaaagatataatgagagaaccgattcggaatttccagtggcatgagtttttccctaatgcaagtaacaatattggtgttgtcatcgcactttgggctccaataattcttgtctatttcatggacacccaaatttggtacgcagttttctcaacattgattggtggtatctatggggcttgtcgtcgacttggtgagatacggactttaggcatgttaagatctcgctttgaatctttgccttgggccttcaataaattgttgataccttctgatcaacacaagaggaaaggtttccgggctgctttttccactaaacttgctaagccttctggtaatgaacaagagagagagaaaatagctgcaagatttgcccaaatgtggaacctaattatcacaagtttccgtgaagaagatctcatagataacagggagatggacttgctacttgttccatactgcaaagatcgtgaattggatatattccaatggccaccttttctacttgctagcaagattccgatagcattggatatggcggcagacagtggaggaaattatcgagatctgaacaagagaatgaaatcggacccgtatttttcctatgctatcagagaatgctatgcttcattcaaaaacatcatcaacaccttagtgtttggtcaacgtgagaaaattgttatgcaagagatatttgaagttgttgataaacatatagccgaagaaactctgataaaggatctgaacatgaggagtcttccagccctgagcaagaagctcattgagctacttgagttactgcaaaagaataaggtagaagacttgggtcaagttgttattttgttccaagatatgcttgaggtggtcacaaaggatataatggaggaacaagagctcagcagtgtactggattccatacacggtggaaatgctaaaaaacacgaaggaatgacaccgcttgatcagcaagaccaattgtttactaaagctattaagttccctgtggaggcatcaaatgcatggactgaaaagataaagaggcttcatcttctgctcaccgtcaaagagtctgctatggatgtccctacaaacctcgatgctagaaggagaatatctttctttgcaaattctctttttatggatatgccaaatgctccaaaagtgcggaacatgttgccattctcggtcttgactccttattacaaggaagatgttctgttttcatcagataatctagaagaggcaaatgaggatggaattaccatacttttctacttgcaaaaaatttacccagatgagtggaaaaatttcctcgaaagggtgaacagaactgaggaggaggcccgtgatgatgatacaatagaggatgagcttcggctttgggcatcatataggggacaaacattgacaagaactgtaagagggatgatgtactaccgaaaagctttggagcttcaggcatttctggataatgccaaagatgatgatcttatgaaaggctacagagagatagctgacatgaaggaatctgaattaatgacagaatgcaaagcgctagctgacatgaaatttacatatgttgtctcatgccaacagtatggaatccagaaacgttctggtgatccttgtgcacatgatattttgagactaatgacaacatatccatcttttcgtgttgcctatattgatgaagttgaagcacctagccaagatagaaacaagaagactgacaaagtttactactcagttttggtgaaggctgctgttacaaaatcagatgatcctggacagagtcttgaccaggtcatctacaagatcaagcttccaggcaatgctattttaggtgagggaaagccagaaaatcagaaccacgcaataattttcactcgaggcgaatgtctccaaactatagatatgaaccaggagcattacatggaggaggctctgaaaatgagaaatttgttggaagagtttctggagaaacatgatggtgtgagatatccatcgatacttggagtaagggagcatatatttactggcagtgtttcatcactggcttggttcatgtcaaatcaagagacgagttttgtgactattggacagcgtgtgcttgccaatccattaagggttcggtttcattatggccatcctgatatatttgatcgtcttttccacctgacaaggggtggtataagtaaagcatctaagattatcaatcttagtgaggacatatttgcaggattcaattctacattacgtgaaggcaatgtcactcatcatgaatacatgcaagttggcaagggaagggatgtgggtcttaatcagatttcactatttgaggcaaagatagcaaatggtaacggtgaacagacactcagccgggacatttaccgactggggcaccgttttgatttcttcagaatgttgtcgtgttactatacgacaattgggttctatttcagcacaatgattacagtttggactgtgtatgctttcctttatgggcgtttgtatcttgttctcagtggacttgatgcagcacttgctactggaaagaggttcgtgcataatacaccgctccaggttgcgcttgcatcagaatcttttgttcaacttggatttttgatggcattgcccatgatgatggagatcggtttggagagaggattcagaacggcattaagtgactttgtgctcatgcaactccagttggcatctgttttcttcacgttttcacttgggaccaaaactcactattatggaaggacactactccatggaggagctgaatatagagcgactggacgtgggtttgtggtgtttcatgccaaattcgccgagaactaccgactctattctcgcagccatttcgtgaagggtattgagctgatgattctgcttgtcgtgtatgaaatctttggacagacgtacagaggagctatcacttacatcttcatcactgtttccatgtggtttatggtgggcacctggctctttgcacccttcctgttcaacccttccggattcgagtggcagaagattgtggacgactggactgattggaacaagtggatcagtaaccgtggaggtattggtgtggcaccagagaaaagctgggaatcctggtgggacaaagagcaggggcctcttcggcactctgggaagcgtggcaccattcttgaaatacttcttgcattgcgtttcttcatctaccaatacgggcttgtgtatcatttgaatataaccaagcagtataaccaaagcgtgctggtttacggcttctcatgggttgtgattctggtcatgctgcttgttatgaagaccgtgtctgtcggcaggaggaggttcagcgcggagttccagctcgtcttccggctgatcaaggggctgatattcataacattcatctccatcctcataatcttaacggcaatcgcccacatgacagtccttgacatcttcgtctgcatcctcgccttcatgccgactggatggggcctgcttctgattgcccaagcgatgaagcctgttgtcgagatggtggggctgtgggggtcggtgaaggccctcgcccggggctacgagatcctgatggggctcctgctgttcacgcccatcgcgttcctcgcgtggttccccttcgtgtccgagttccagaccaggatgctcttcaaccaggcattcagcagaggtctgcagatctcccgtatcctcggcggccacaagaaggaccgagccacccggaacaaggagtaggtagaagatctagctcccgcctagtattatcggtgtcgctcgcccccgactcttctagattctcctgccacgattgttcccatgagatttgaatctgactgttctttcagagatcgggtggctgtgctataggctacttagtagtgttctcctgtgtaggcgtagattcagagctgttgcgactgcgctttatgtacatatctaccgctccttggcgtggctgctggaccttatgttagacctgtagtgatgcggggaaggattctgtgatgtatgcaggaagtacaatttctatattaggtttgg

SEQ ID NO: 987 - DNA, 6630 bp, Setaria italica
tccggacaaaggaggaggaaaagcagcagcaagcagcggcggcggcgagcccttcttcttcttcgccaccagcaccccccaccccccactttccccactccgtcctagggactagggcttcgctcttcctgctgctgctaccccatccattgcagagccatggcgtcctcctcgggggggcgcaggatggcccccgggggtgactcctcctccgcctcccccgcctccgccggcgctggcgctggacccaggaggatcctccgcacccagaccgcaggcaacctcggcgagtccatcttcgacagcgaggtcgtcccgtcctcgctcgtcgagatcgcgcccatcctaagggtggccaacgaggtggaggcaagcaaccccagagtagcctacctatgccgcttctacgccttcgagaaggcgcatcgcctcgacccgacctccagcggccgaggtgtccgccagttcaaaaccgcgctcctgcagaggctcgagagggagaacgaccccacgctcaagggcagggtcaagcagagtgacgccagagaaatgcagagcttctaccagcactactacaagaagtacatccaggcgctccaaaatgcagccgacaaggccgaccgggctcagctcactaaagcctatcaaactgccgccgtgctcttcgaggtcctcaaagccgtcaatgtctcccagaaaatcgaagttgatcaatcgattctggagacgcataaccaagtcgaggaaaagaagaagttatatctcccgtacaatatcctcccgctcgatcctgacagcgccaaccaggctatcatgcgctaccctgagatccaagctgctttccatgctcttcgtaacaccagaggtctgccatggcccaaggaacacgaaaagaaacccgacgcggatcttcttggctggcttcaggccatgtttggattccagaaagataatgtatccaatcaaagggagcatctcatactcttgcttgccaacgttcacatcagacagattcccaaacctgaccaacaaccaaagttggatgaccgagcattggacacagtaatgaagaagctatttaagaattacaagaaatggtgcaaatatcttggccgcaaaagcagcttatggttgccgactatccaacaggaggtacagcaacgcaagctcctctatatgggtctttatctgcttatatggggcgaggcggctaatctgagattcatgccagagtgtctttgctacatctatcatcatatggcttttgaactatatggtatgctggctggaaatgtgagcccaacaactggtgaaaatgtcaaaccagcctatggtggagaagaagaagccttcttgaagaaagttgtgactccaatctacaaagttatagagaaggaagccgagaggagcaagatcgtaaaatcaaagcactcacactggagaaactacgatgatcttaatgagtacttttggtcaagagattgcttccgattgggatggcctatgagagctgatgcagatttttttaagactccaaatgatgatcgtcgtcaccctgtgaatggggaggacagacctgttgctaatggcaattggatgggaaaagtcaattttgtcgaagtacggtcattttggcacatcttccgcagctttgataggatgtggagcttcttaattttatctttacaggccatgattataattgcttggaatggtggcacaccaagtgatatctttgatcgaggagtatttaaacaagttttgagcatatttattaccgctgctatactgaaactgggtcaagcaatcctggacattatcttgagctggaaagcaagaaaaaacatgtctcttgttgttaagctacgttacatcttgaagttactatcagctgctgcttgggttgtgattttgcctgtaacttatgcatacacctggcagaatccaaccggccttgcaagaacaattaaaagttggcttggtgatggccagaatcagccatcgttgtacattttggcagttgtggtttacttggcaccaaacatactgtcggctgtgctatttcttttccctgtgattaggagagccctcgagagatcaaatcttaaggttgtgacattcatgatgtggtggtcgcagcctcgcttatttgttggaagaggaatgcatgaaggcgcattctccctgttcaagtatacgatgttctgggtcttgcttttagccacaaaattggttgtgagcttttatgtggagatcaaaccacttgtgcagccaacacaagatataatgaaggagccaatacgaacatttaagtggcacgagtttttcccccatgcaaataacaacattggtgttgtcattgcgctttgggctcctatcattcttgtctatttcatggatactcagatttggtatgcaattttctcaacaatagttggtggtatctatggggcctgtcgccgtcttggtgagataaggacattgggaatgttgagatctcggtttgaatctctgcctaaggctttcaatcaatgcttgattccatctgacacaagcaagaggagaggattccgggctgctttctccagtaaaccttctaagacacctgagggcaccaaagaagaagaaaaaatagcagcaagatttgctcagatttggaatctaattatcacaagctttcgcgaggaagatctgataaataacagagagaaagacttattacttgttccatactgcaaagaccgtgatatggatataatccaatggccaccattcctgcttgccagcaagattccgattgcattggatatggcagcagatagtggaggaaaagatcgtgatctaaagaagaggatgaaatcagacccatattttacttatgctatcaaggaatgctacgcttcattcaaaaacatcatatacgctctagtgattggtccacgagagagagatgtcatacaaaagattttcgatgtggtggatgagcatatagcaggtgacactctgataacagagctgaacatgagtaaccttcctactctgagcaagaagtttattgagctgcttgacttactgcaaaagaataacatagaagaccagggtcaggtcatcatattgtttcaggatatgctcgaagtggttacaagggacataatggatgagcagctcagtggactactggaatcaatacatggtggaaataatagaagatatgaaggaattacaccacttgatcaacaagttcagttgttcacaaaagctattgattttcctgtaaaggaaacacaagcatggactgaaaagataaaaaggcttcaccttctgctcacagtgaaggaatcagctatggatgtccctacgaacctggatgctagaaggaggatatctttctttgctaattctctttttatgtctatgccaagggctccaaaagtgcggcaaatgttacccttctctgtcttgactccctattataaagaagacgttcttttctcttcacacgcgctagaggaaccgaatgaggatggagtttctatccttttctacttgcaaaaaatctacccagatgaatggaacaattttcttcaaagggtggattgcaagaatgaagaggaactccgtgaaactgagcaatctgaagaggagcttcgcctttgggcatcataccggggacaaactttgacaagaactgtaagagggatgatgtactacagacaagctttagtccttcaagctttccttgatatggccagagatgaagatcttatggaaggcttcagagcagctgatctgttatctgatgagtcgcagctattgactcaatgcaaagctatagctgacatgaaattcacatatgttgtatcatgccagcaatatggtatccagaaacgatctggtgatccacgcgcacaggatatactgagattgatgacaacttacccgtcacttagggttgcctatattgatgaagttgaagagcctagcaaagacagaaataagaaaatagagaaggtttactactctgcattggtgaaggcagcggtaacgaagcctgatgatcctggccagaaacttgatcaggatatatataggataaagcttccagggaatgcaatgctaggtgaaggaaaaccagaaaatcagaaccatgccataattttcacgcgtggtgaaggtctccaaaccatcgatatgaatcaggaacattatatggaggagactttgaaaatgaggaatttgttgcaagagtttctgaagaaacatgatggtgtgagatatccatcaatacttggtgtaagagaacatatcttcaccggcagtgtttcttctcttgcatggttcatgtcaaaccaagaaacgagttttgtgaccattggacagcgtgtacttgctaatcctttgagagttcgatttcattatgggcatcctgatatctttgatcggcttttccacctcacaagaggaggtgtaagcaaagcttctaagattatcaatcttagtgaggacatatttgctggattcaattcaactttgcgcgaaggaaatgttacacatcatgaatacatgcaagttggcaagggaagagacgttggtctcaatcagatttcactgtttgaagcaaaaatagcaaatggtaatggtgagcagacactgagccgtgatgtctaccggcttggacaccgttttgactttttcagaatgttgtcctgctactacactactattggtttttacttcagcacaatgataacagtttggacggtgtatgtattcctctatgggcgcctttatcttgtcctcagtggcctcgacgaagcactagccactggaaagaggtttatacacaatgaacctctccaggttgctctagcttcacagtcttttgtgcagcttgggttcttgatggcactgcctatgatgatggaaattggtctagagagaggattcagaactgcgctgagtgacttcgtacttatgcaactgcaactagcatccgtgttcttcacattctctcttgggaccaaaactcactactatggaaccacactgctccacggaggagctgaatatagagctactgggcgtggatttgtggtgttccatgccaaatttgctgagaattatcgactgtactcgcgaagccattttgtcaagggcatcgagctgatgattttgcttattgtgtatgaaatatttgggcagtcataccgaggagctatcgcgtacattttcatcacgatctccatgtggtttatggttgtcacctggctctttgcaccattcctgtttaatccttctgggttcgagtggcagaaaatcgtggatgactggactgactggaataagtggatcagtaaccgtgggggtattggtgtaccaccagagaaaagttgggagtcatggtgggaaaaagagcaggagcctcttagactttctggaaagcgtggcattattcttgaaatagtgcttgcattgcgcttctttatctaccagtatggtcttgtttatcatttgaacatcaccacgcacacaaagagcgttctggtttattgcctctcatgggtcgtaatctttgtgattttgctcgtgatgaagactgtatcagttgggaggcggagattcagtgcagagttccaacttgtgttccggttgatcaaggggctgatattcataacatttatctccatcatcataatcttgatagcaatcccgcacatgacagttcaggacatgtttgtttgcatccttgcgttcatgccgactggatggggtttgcttctgattgcgcgagctatcaaaccagctatcacaaagtttcagctgtggggttcaatcaaggcacttgcccgaggctacgagatcatcatggggctactgctgttcactccgatcgcattccttgcttggttcccgtttgtttcggagttccagacgaggatgctgttcaaccaggccttcagcagaggcctgcagatctcgcgcattctaggcgggcacaagaaagaccgggcaacacggaacaaggagtgagtataggtagcattgtatggttggcccctcctgagtgtaaattgtggctcctctttcaactctgttggactagtataatgtgagtgaatgagagagacgggggtgctatgctgctatgtagtaagttggcaatttagcattgtctgtagtgcctgttgcggccttgtgtaatctgctcctggagtcgtcgtagtattggttgatgaatgattcccaattctgctcacatgcctgccagattgtatatataatatgcgtacctttcgcgttctgggggcgtcggatcgatcataatgaacatcaggtgaaaggatagaaaagaaaatgatgctcaaaaacaagggagtttgtcacactgtatataggtggaataagtatataatatgtaaaactcctaagctgcctaaccttgtacctcaaaaccatataatgaggttgagtactgtggactattataataaactgtctaaataactcaagtggttttagacgacttggtgtttcagtacatgcactgacattgacttaattagtgtggtcttactggcgtattacctatttggtaagttttatgtttgtatgtgctatgtacctatgtac

SEQ ID NO: 988 - DNA, 6583 bp, Oryza sativa
caaaggggagaggaaaacggaggccaacaaatgattccattctatcccatttacgttagggatacaacaccacacatgatagtagtagtagcataaaataaacaaaaaagaaaagaaacgttttcatcttttctgctttacagtagtaggagaaagctgcaggagctctccctcacactcctgatgtgatgagtggagagagtcccccactgctgctgctgctgctgcgcggggcaaccggccaccggctgcacctcctcgggtcggggatttccgggcttgaagcagcagcactaggaaggtaggtagggtagggtggatggcgtcgtcgtcgtcggggcgtcgggttggggggcctaggggcggcggggagagtagtcctagtccggcggcgggggcgggggcggcggcgtcggggggtcgacggatcctacggacgcagacggcggggaacctgggggagtcgatattcgacagcgaggtggtgccgtcgtcgctggtggagatagcgccgatcctgcgtgtggcgaacgaggtggaggggagcaacccgcgggtggcgtacctgtgcaggttctacgcgttcgagaaggcgcaccggctggacccgacgtccagcggccgtggcgtccggcagttcaagaccgcgctcctgcagaggctggagagggagaacgaccccacgctcaaggggagggtcaagcagagcgacgcccgcgagatgcagagcttctaccagcactactacaagaagtacatccaggctcttcagaacgctgccgacaaagccgaccgtgctcaactcactaaagcttaccaaactgctgccgtcctgtttgaggtcctcaaagccgtcaatgtctcccagaaaattgaagttgatcaagcgattttggagacacacaaccaagtcgaggaaaagaaaaaactttatctcccttacaacatcctcccgcttgaccctgacagcgctaatcaggctatcatgcgatatcctgagattcaagctgcttttcacgctcttcgtaatacaagaggactaccgtggcccaaggatcatgaaaaaaagcctgatgctgatcttcttggttggcttcaggcgatgtttggatttcagaaagataacgtgtccaaccaaagggaacacctcatactcttacttgccaacgtccatataaggcagattcccaagcccgaccaacaacccaagttggatgaccgagcactggacacagtcatgaagaagctatttaagaactacaagagatggtgcaagtaccttggccgcaaaagcagcttatggttgccaactattcaacaagaagtgcagcagcgtaagctcctctatatgggtctttatcttctcatctggggtgaggcggctaacctgagatttatgccggaatgtctatgctacatctatcatcacatggcttttgaactatacggtatgttggctggaaatgtgagtccaacgacaggtgaaaatgttaaaccggcttacggtggtgatgaagaagcctttttgaagaaagttgtgactccaatatacaaagtcatcgagaaggaagctgaaaggagtgaaagtagtgaaaggagcgaaaggagcaagacaacaaaatctaagcactcacattggagaaattatgatgatctaaatgagtacttttggtcaagagattgtttcagattaggatggcctatgagagctgatgcagatttttttaagaccccagattatgcttatcatgatgaagtgagcggagagaacagaagagttggtagtggccagtggatgggaaaagtaaattttgttgagataaggtcattttggcacatcttccgcagctttgacaggatgtggagcttcttaattttatctttacaggccatgattataattgcttggaatggtggtacaccaagtgatatctttgatgcaggagtatttaaacaggttttgagcatattcataactgctgcaatactgaaattgggtcaagcaattctggacatcatcctgagctggaaagcaagaagaagcatgtctcttgctggcaagctgcgctacatcttgaagttgatatcagctgctgcatgggttgtgattttaccagtaacttatgcatacacctgggagaatcctacaggtcttgcaagaacaattaaaagttggctcggtgatggtcagaatcaaccatcattatacatcttggctgttgtgatatatttagcaccaaacatgctgtcggctgtgttatttcttttcccagtccttagaagagctcttgagcgatcaaatcttaaagttgtaacattcatgatgtggtggtcgcagcctcgcttgtttgttggtagaggaatgcatgaaggagcattctcccttttcaagtacacaatgttctgggtccttctcttagcaacaaaattgatagtaagctactacgtggagatcaagccacttgtgcgaccaacaaaagatataatgaaggagccaatacggacgtttcaatggcatgagtttttcccacacggaaataacaatattggtattgtaattgcactttgggctcctatcattcttgtatatttcatggatacccagatttggtatgcaattttctcaacattaattggtggtatatatggggcatgtcgccgtcttggtgagatacgcactttaggaatgttaagatctcgcttcgagtctttgcctaaggctttcaatcaacgcttgattccatctgattcaaataagaggagaggaattcgggctgctttctccagtaaacctactaagacaccagaggatagcaaagaagaggaaaaaatagcagcaagatttgctcagatttggaatctaattatcacaagctttcgtgaggaagatctgatagacaacagagagaaggatctgttacttgtgccatactgcaaagatcgtgacatggatataatccagtggccaccattcttgcttgctagcaagatcccgatagcgttggatatggctgcagacagtgaaggaaaagatcgtgatcttaagaagagggtgaaatcagacccatattttacttatgctatcaaggaatgctatgcttcattcaagaacatcatatatactttggtggttggtgcaaaagagagagacgtcatacagaagatttttacagtggttgacgaccatatagcacaagatactttaataaaggagctcaacatgagtaaccttcctaccctgagcaagaagtttattgagctgcttgaattgctgcaaaagaataacaaggaggaccagggtcaggtcatcattttgttccaggatatgcttgaagtggttacaagggatataatggacgagcaactcagtggactacttgaatcagtacatggtggaaataatagaagatatgaagggattacaccacttgatcagcaagaccagttattcactaaagctattgattttcctgtaaaggaatcacatgcatggactgaaaagataaaaagacttcaccttctgctcacagtgaaggaatctgctatggatgttcctacaaacctggatgctagaaggcggatatcattctttgctaattctcttttcatggacatgccaagtgctccaaaagtccggcacatgttgcccttctctgtcttgactccttactacaaagaagatgtccttttctcttcccaagcattagaagaccagaatgaagatggggtttctattcttttttacttgcaaaaaatctatccagatgaatggaaacatttccttcaaagggtggattgcaatactgaagaggaactccgtgagacagagcagttggaagatgagcttcgcctttgggcatcatacaggggccaaactttgacgagaactgtcagagggatgatgtactacagacaagctttggtgcttcaggcttttcttgatatggctagagatgaagatcttagggaaggcttcagagcagctgacctcttaaatgatgaatcaccattactgactcaatgcaaagctatagctgacatgaagtttacatacgttgtatcatgccaacaatacggtatccagaaacgttctggtgatcaccgtgcacaagatattcttagactgatgacaacttatccatcacttcgggttgcctatattgatgaagttgaagagccaagcaaagacaggaacaagaagatagaaaaggtttactactcagcgttggtgaaggcagctgtaaccaagcctgacgatcctggtcagaaacttgatcaggacatatacagaataaagctaccaggtaatgcaatgctaggtgaaggaaagccagaaaatcagaaccatgcgataatatttactcgaggtgaaggccttcaaactatagacatgaatcaggaacattacatggaggagactttgaaaatgagaaatctgctgcaagagtttctgaagaaacatgatggtgtgaggtatccatcaatacttggtgtgagagagcacatattcactggcagtgtttcttctcttgcgtggttcatgtcaaatcaagagacaagttttgtcactattggacaacgggtacttgccaatcctttgagagttcgatttcattatggacatcctgatatttttgatcgacttttccacctcacgaggggtggtgtaagcaaagcatccaagattatcaatcttagtgaggacatatttgctggattcaactcaacactgcgtgaaggaaatgttacgcatcatgaatacatgcaagttggcaaggggagagatgtgggtctcaatcaaatctcactatttgaggcaaaaatagctaatggtaatggagagcagacactgagccgtgacgtctaccgacttggacatcgttttgatttcttcagaatgttgtcctgctactacaccactattggtttttacttcagcactatgatgacagtgtggacagtgtatgtattcctctatggacgtctctatcttgtcctcagtggtcttgatgaagccttggctactggaaaaaggtttatacacaatgaacctctccaggttgctcttgcttcacagtcttttgtgcagcttgggtttttgatggcgttgcctatgatgatggaaattggtctggagagaggatttagaaccgcattgagcgactttgtactgatgcagctgcagttagcatctgttttctttacattctctctcgggaccaaaactcactactatggaacaacgctgctccatggaggagccgagtatagagctactgggcgtggatttgtggtgttccatgccaaatttgcggagaactatcgactatactcacgcagccattttgtcaagggtattgagttgctgattttgctaattgtgtatgaaatctttgggcaatcatatcgaggagctatcgcgtacatcttcattacattttcgatgtggtttatggttgtaacctggctctttgcaccattcctatttaatccttctgggttcgagtggcagaagattgtggatgattggactgattggaataagtggatcagcaaccgtggtggtattggtgtaccaccggagaaaagttgggagtcatggtgggagaaagagcaggagcctataaaatattctgggaagcgtggaattgttctcgaaatagtgcttgcattgcgcttctttatctaccaatatggtcttgtttatcacttgaacataaccaaacacacaaagagtgtcctggtctattgcctgtcatgggttgtcatctttgtaattctgcttgtgatgaagaccgtgtcagttgggaggcggaaattcagcgcggacttccaacttgtgttccggttgattaaggggttgatatttataacatttatctccatcattataatcttgatagcaatccctcatatgacagtccaggacatctttgtttgcattcttgccttcatgccaactggctggggtctgctgttggttgcgcaagctatcaagccagtaattgtgcgcatcgggttgtggggatcgatcaaggcgcttgcgaggggatatgagatcatcatggggctcctgctcttcaccccgatcgcgttcctcgcttggttcccgtttgtatccgagttccagaccagaatgctcttcaaccaggccttcagcagaggtctgcagatctcgcgaatccttggcggccacaagaaagaccgagctacacggaacaaggagtagtagcctgtctgccattcactggacatgtattctgttgtgtcttcttccctcctgttgctgctgtaatttgttactcctattctactactccacttatcttgattgagagacccaaaaaaaaagaaaaagaaagaaagcgtgcattttggtagttgctaatcgccgcgctgctgaggccgcttattgtgcggcccagggagcgatgtgttgtagaatagtacagtagaatgtgtaaagttgctgtttggtagtgatgtgatgtgtgtgtatgaaaacaaacttgggaagagaaatgcaattgtaagacaaaataccttgcctgatgtgatgaatgtttttttttttgacatgtgt

SEQ ID NO: 989 - DNA, 6236 bp, Brachypodium distachyon
gactctgaccggcgcggatggcgtcgtcctccgggaggcggatgggccccggcggggagggccccccctcatccgcctcgccggcctcgggaggccccgccggcaggaggatcctccgcacgcagaccgccggcaacctcggcgagtccagcttcgacagcgaggtggtgccctcctcgctcgtcgagatcgcgcccatcctccgtgtcgccaacgaggtcgaggccagcaacccgcgcgtagcatacctatgtcgcttctacgctttcgagaaggcccatcgcctcgacccaacatccagcggccgaggtgttcgtcagttcaaaaccgcactcctgcagaggctagaaagggaaaacgaccccacattgaagggaagggttaagcagagtgatgctcgagaaatgcagagtttctatcagcactactacaagaagtacatccaagcacttcagaatgccgctgataaagctgaccgtgctcaactcacaaaggcatatcaaaccgcagctgtcttgtttgaggttttaaaagccgttaacgtttcacaaaaaattgaagttgatcaagcgattttggaaacacacaaccaagtggaggaaaagaaaaagttgtatcttccttacaatatcctcccgcttgaccctgatagtgctaatcaggctattatgcaatatcctgagatccaagctgcttttcacgctcttcgtaatacaaggggtttgccatggcccaaggaacatgaaaagaaatctgacgcggatcttcttgattggcttcaggctatgtttggttttcagacagatagtgtatccaaccaaagagaacatctcatactattgcttgccaacatgcatataaggcagatttccaaacctgatcaacaatcaaagttagatgatggtgcgctggataaagtaatgaagaaactatttaaaaactacaagagatggtgcaagtaccttggccgcaaaagcagcttacggctaccgactattcaacaggaagtacagcagcgtaagcttctctatatgggcctttatctgctcatatggggtgaggcggccaacttgagatttatgccagagtgtctttgctacatctatcatcatatggcttttgaattgtatggtatgttggctggaaatgtgagcccaacaaccggtgaaaatgttaaaccagcatatggtggcgctgtagaagccttcttgaagaaagttgtgactccaatatacaaaataatagagatggaagctgaaaggagcaagaccataaaatcaaaacactcgcattggagaaattatgatgatctaaatgagtacttttggtcaagagattgtttccgattagggtggcctatgagagccgatgctgattttttcaagactccaaacttttctcttgctcctcgtgatcagatgaatgaagagaacagaccagctggtagtgaccactggatgggaaaagtcaactttgtcgagatacggtcattttggcacatcttccgtagcttcgacaggatgtggagtttcttaattatatctttacaggccatggttataattgcttggaatggtggcacaccaagtgatatctttgatgcaggagtattgaaacaagttttgagcatatttataactgctgcagtactgaaactgggtcaagcaattctggacattgtcttgagctggaaagcaagaaaaggcatgcctcttgttgttaaactgcggtacatcttaaaattactatcagctgctgcatgggtggtagttttaccagtaacttacgcatacaccttggagaatcctaccggtcttgctagaacaatcaaaagttggctcggtgatggccggaagcagccatcattatacatcttggctgttgcggtatatttggcaccaaatatgctggcggccacgatgtttctttttcctgtcctgaggagagctctggagaggtcaaaccttaaagtcataacatttatgatgtggtggtcgcagcctcgcttatttgttggtagaggaatgcatgaaggcgcattctcccttttcaagtatacgatgttctgggtccttcttttggccacaaaactgatagtgagcttctatgtggagatcaagccacttgtgcaaccaacaaaagatataatgaagcagccaataacaacatttgagtggcatgagttttttccacatgccaagaacaacatcggtgttgttattgcactttgggctcctatcattcttgtctatttcatggatacccagatttggtatgcaattttctcaacgttagttggtggtatatatggggcatgtcgtcgtcttggtgagatacgcaccttaggaatgctcagatctcggttcgaatctttgcctaaggctttcaacgatcgcttgattcccaatgactcaaacaagaggagaggacttcgctctgctttctccagtaaatcttctcagaaacctgaggatgacaaagaaaaagaaaaaatagctgcaaaatttgctcagatttggaatctaattattactagcttccgtgctgaggacttgatagataacagggagaaggacttgttacttgttccatactgcaaagatcgtgaaatggatataatccaatggccaccattcctgcttgctagcaagatcccaatagcgttggatatggcagcagacagtggaggaaaagatcgtgatctaaagaaaaggatgaagtcagatccatattttacttatgctatcaaggaatgctatgcgtcattcaaaaacatcataaacactttagtggttggtcgggagagacttttcatagaaaagatttttaaagtggtggacgatcatatagaacaagacattctaataaaggagctgcacatgagcaaccttcctacactgagcaagaaatttattgagttgcttgatatactgcaaaagaataacaaagaagaccagggtcaggtcatcattttgttccaggatatgctcgaagtggttacaagggatataatggatgaccaactcagtgggctactagaaacggtacacggtggaaatagcagaagacacgaaggaatcacaccacttgatcaacaggatcagttgttcactaaagctattgagtttcctgtaaaggaatcacatgcctggacagaaaagataaaaaggctctacctgttgctcacagtgaaggaatctgccatggatgttcctacaaacctggatgctagaaggcggatatctttctttgccaattctctttttatggagatgccacgggctccaaaagtgcggcacatgctgccattctctgtcttgactccttattacaaagaaggcgttcttttctcttcacaagcactagaggaccagaacgaggatggggtttctgtccttttctacctgcaaaaaatctacccagatgaatggaaaaattttcttgaaagggtggagtgcaagaccgaagaggaactccgtgagactgaacaatcgggagatgagcttcgcctttgggcatcttataggggccaaactttgacaagaactgtaagagggatgatgtactacagacaagctttggtgcttcagtcttttcttgatatggccagagaggaggatcttatggaaggcttcagagctgctgacatactatctgatgaatcaccattgctgactcaatgcaaagctatagctgacatgaagtttacctacgttgtatcatgccagcaatacggtatccagaaacgttctggtgatcagcgtgcacaggatattctgagactgatgacaacttatccatcacttcgagttgcctatattgatgaagtcgaggagacaagtacagagcgaagcaagaagatagagaaggtttactactcagcattggtgaaggcagcagtaaccaagcctgacgatcctggtcagaaactcgatcaggacatatacaggataaagcttccaggtaatgcaatgttaggtgaaggaaaaccagaaaatcagaaccatgcgataatttttactcgaggtgaaggcctacaaactattgacatgaatcaggaacattatatggaggagaccttgaaaatgagaaatctactgcaagagtttacgaagaaacatgatggtgtgaggtatccatctatacttggtgtaagagaacacatattcactggcagcgtttcttcgcttgcatggttcatgtcaaaccaagagacgagttttgtgactattgggcaacgtgtacttgccaatcctttaagagttcgatttcattatggacatcctgatatctttgatcgacttttccacctcacaaggggtggtgtaagcaaagcatctaagattatcaatctaagcgaggacatatttgctggattcaattccacattgcgtgaaggaaatgttacacatcatgaatacatgcaagttggcaagggaagagatgttgggctcaatcaaatttcactatttgaggcgaaaattgcatatggtaatggggaacaaacactgagccgtgacgtctaccgacttggacaccgttttgattttttcagaatgttgtcctgctattacactactattggcttttacttcagcacaatgattacggtatggactgtatatgtattcctctatggccgtttgtatcttgtcctcagtggccttgataaaggtctaaccactggaaaacggtttagacacaatgatcctctccaggttgctcttgcttcacagtcttttgtgcagcttgggttcttgatggcactgcctatgatgatggaaattggtctagagagaggattcagaactgcattgagtgactttatacttatgcagcttcagttagcctctgtcttcttcacattctctcttgggacgaaaactcactactatgggaagacgctgctccatggaggagctgagtatagagctaccggacgtggatttgtggtgttccatgcaaaattcgcagagaactaccggctgtactcacggagccattttgtcaagggcattgaattgatgattttgcttatcgtgtatgaaatcttcgggcagtcttatcgaggagcaatcgcatacatattcatcacgttttccatgtggtttatggttgtcacctggctttttgcacctttcctctttaacccttctggttttgagtggcagaagattgttgatgactggactgattggaataagtggatcagcaaccgtgggggtattggtgtatcgacagagaaaagttgggagtcatggtgggagaaagagcacgaacctcttaagtattctggaaagcgtggcactgttctcgaaatagtactcgcggcgcgcttctttatctaccaatatggtcttgtttaccatttgaacataatacacacgaagagcgtgctggtttattgcttgtcatgggttgttatctttctaattttggccgtaatgaaggctgtatcagttgggagacggaaattcagtgccgaattccaactagtgttccggctgatcaaggggctgatattcataacattcatctccatcatcataatcttgattgcgatcccccacatgacagttcaagacatatttgtctgcatacttgccttcatgccgaccggatggggcttgctcttggtggcgcaagctctcaagccagcaatcgtgaagcttcagctgtggggttcgatcagggcgctggcacgaggctacgagatcatcatggggcttctcttgttcacccccatcgcgttcctggcgtggttcccgttcgtgtcggagttccagacgaggatgctcttcaaccaggcattcagcagaggcctgcagatctcgaggatcctcggcgggcacaagaaggaccgggcggcgcgcaacaaggagtaatagatagtcagatgtctgctggggttgtggtttatataccagtatcaacaaccctggttgttttgtactatgtttgtatattgtctgggctgtagctgttgtagaaaaggaacgggatgggattgattgctgtgtagagcatattgcattggctcgagtgctgatttgtaggaatagtaatctggaaaagattagagaaggtagcctaatctgatgagttaaatgtatgtataacacatggatccagtgactttgtgtcgaatatccaatgccatgttgagttgaagggtggagatgctctgtactaatctttgacagaaacataaggcttattacaaggacgaattcctc

SEQ ID NO: 990 - DNA, 6248 bp, Brachypodium distachyon
ctctgaccggcgcggatggcgtcgtcctccgggaggcggatgggccccggcggggagggccccccctcatccgcctcgccggcctcgggaggccccgccggcaggaggatcctccgcacgcagaccgccggcaacctcggcgagtccagcttcgacagcgaggtggtgccctcctcgctcgtcgagatcgcgcccatcctccgtgtcgccaacgaggtcgaggccagcaacccgcgcgtagcatacctatgtcgcttctacgctttcgagaaggcccatcgcctcgacccaacatccagcggccgaggtgttcgtcagttcaaaaccgcactcctgcagaggctagaaagggaaaacgaccccacattgaagggaagggttaagcagagtgatgctcgagaaatgcagagtttctatcagcactactacaagaagtacatccaagcacttcagaatgccgctgataaagctgaccgtgctcaactcacaaaggcatatcaaaccgcagctgtcttgtttgaggttttaaaagccgttaacgtttcacaaaaaattgaagttgatcaagcgattttggaaacacacaaccaagtggaggaaaagaaaaagttgtatcttccttacaatatcctcccgcttgaccctgatagtgctaatcaggctattatgcaatatcctgagatccaagctgcttttcacgctcttcgtaatacaaggggtttgccatggcccaaggaacatgaaaagaaatctgacgcggatcttcttgattggcttcaggctatgtttggttttcagacagatagtgtatccaaccaaagagaacatctcatactattgcttgccaacatgcatataaggcagatttccaaacctgatcaacaatcaaagttagatgatggtgcgctggataaagtaatgaagaaactatttaaaaactacaagagatggtgcaagtaccttggccgcaaaagcagcttacggctaccgactattcaacaggaagtacagcagcgtaagcttctctatatgggcctttatctgctcatatggggtgaggcggccaacttgagatttatgccagagtgtctttgctacatctatcatcatatggcttttgaattgtatggtatgttggctggaaatgtgagcccaacaaccggtgaaaatgttaaaccagcatatggtggcgctgtagaagccttcttgaagaaagttgtgactccaatatacaaaataatagagatggaagctgaaaggagcaagaccataaaatcaaaacactcgcattggagaaattatgatgatctaaatgagtacttttggtcaagagattgtttccgattagggtggcctatgagagccgatgctgattttttcaagactccaaacttttctcttgctcctcgtgatcagatgaatgaagagaacagaccagctggtagtgaccactggatgggaaaagtcaactttgtcgagatacggtcattttggcacatcttccgtagcttcgacaggatgtggagtttcttaattatatctttacaggccatggttataattgcttggaatggtggcacaccaagtgatatctttgatgcaggagtattgaaacaagttttgagcatatttataactgctgcagtactgaaactgggtcaagcaattctggacattgtcttgagctggaaagcaagaaaaggcatgcctcttgttgttaaactgcggtacatcttaaaattactatcagctgctgcatgggtggtagttttaccagtaacttacgcatacaccttggagaatcctaccggtcttgctagaacaatcaaaagttggctcggtgatggccggaagcagccatcattatacatcttggctgttgcggtatatttggcaccaaatatgctggcggccacgatgtttctttttcctgtcctgaggagagctctggagaggtcaaaccttaaagtcataacatttatgatgtggtggtcgcagcctcgcttatttgttggtagaggaatgcatgaaggcgcattctcccttttcaagtatacgatgttctgggtccttcttttggccacaaaactgatagtgagcttctatgtggagatcaagccacttgtgcaaccaacaaaagatataatgaagcagccaataacaacatttgagtggcatgagttttttccacatgccaagaacaacatcggtgttgttattgcactttgggctcctatcattcttgtctatttcatggatacccagatttggtatgcaattttctcaacgttagttggtggtatatatggggcatgtcgtcgtcttggtgagatacgcaccttaggaatgctcagatctcggttcgaatctttgcctaaggctttcaacgatcgcttgattcccaatgactcaaacaagaggagaggacttcgctctgctttctccagtaaatcttctcagaaacctgaggatgacaaagaaaaagaaaaaatagctgcaaaatttgctcagatttggaatctaattattactagcttccgtgctgaggacttgatagataacagggagaaggacttgttacttgttccatactgcaaagatcgtgaaatggatataatccaatggccaccattcctgcttgctagcaagatcccaatagcgttggatatggcagcagacagtggaggaaaagatcgtgatctaaagaaaaggatgaagtcagatccatattttacttatgctatcaaggaatgctatgcgtcattcaaaaacatcataaacactttagtggttggtcgggagagacttttcatagaaaagatttttaaagtggtggacgatcatatagaacaagacattctaataaaggagctgcacatgagcaaccttcctacactgagcaagaaatttattgagttgcttgatatactgcaaaagaataacaaagaagaccagggtcaggtcatcattttgttccaggatatgctcgaagtggttacaagggatataatggatgaccaactcagtgggctactagaaacggtacacggtggaaatagcagaagacacgaaggaatcacaccacttgatcaacaggatcagttgttcactaaagctattgagtttcctgtaaaggaatcacatgcctggacagaaaagataaaaaggctctacctgttgctcacagtgaaggaatctgccatggatgttcctacaaacctggatgctagaaggcggatatctttctttgccaattctctttttatggagatgccacgggctccaaaagtgcggcacatgctgccattctctgtcttgactccttattacaaagaaggcgttcttttctcttcacaagcactagaggaccagaacgaggatggggtttctgtccttttctacctgcaaaaaatctacccagatgaatggaaaaattttcttgaaagggtggagtgcaagaccgaagaggaactccgtgagactgaacaatcgggagatgagcttcgcctttgggcatcttataggggccaaactttgacaagaactgtaagagggatgatgtactacagacaagctttggtgcttcagtcttttcttgatatggccagagaggaggatcttatggaaggcttcagagctgctgacatactatctgatgaatcaccattgctgactcaatgcaaagctatagctgacatgaagtttacctacgttgtatcatgccagcaatacggtatccagaaacgttctggtgatcagcgtgcacaggatattctgagactgatgacaacttatccatcacttcgagttgcctatattgatgaagtcgaggagacaagtacagagcgaagcaagaagatagagaaggtttactactcagcattggtgaaggcagcagtaaccaagcctgacgatcctggtcagaaactcgatcaggacatatacaggataaagcttccaggtaatgcaatgttaggtgaaggaaaaccagaaaatcagaaccatgcgataatttttactcgaggtgaaggcctacaaactattgacatgaatcaggaacattatatggaggagaccttgaaaatgagaaatctactgcaagagtttacgaagaaacatgatggtgtgaggtatccatctatacttggtgtaagagaacacatattcactggcagcgtttcttcgcttgcatggttcatgtcaaaccaagagacgagttttgtgactattgggcaacgtgtacttgccaatcctttaagagttcgatttcattatggacatcctgatatctttgatcgacttttccacctcacaaggggtggtgtaagcaaagcatctaagattatcaatctaagcgaggacatatttgctggattcaattccacattgcgtgaaggaaatgttacacatcatgaatacatgcaagttggcaagggaagagatgttgggctcaatcaaatttcactatttgaggcgaaaattgcatatggtaatggggaacaaacactgagccgtgacgtctaccgacttggacaccgttttgattttttcagaatgttgtcctgctattacactactattggcttttacttcagcacaatgattacggtatggactgtatatgtattcctctatggccgtttgtatcttgtcctcagtggccttgataaaggtctaaccactggaaaacggtttagacacaatgatcctctccaggttgctcttgcttcacagtcttttgtgcagcttgggttcttgatggcactgcctatgatgatggaaattggtctagagagaggattcagaactgcattgagtgactttatacttatgcagcttcagttagcctctgtcttcttcacattctctcttgggacgaaaactcactactatgggaagacgctgctccatggaggagctgagtatagagctaccggacgtggatttgtggtgttccatgcaaaattcgcagagaactaccggctgtactcacggagccattttgtcaagggcattgaattgatgattttgcttatcgtgtatgaaatcttcgggcagtcttatcgaggagcaatcgcatacatattcatcacgttttccatgtggtttatggttgtcacctggctttttgcacctttcctctttaacccttctggttttgagtggcagaagattgttgatgactggactgattggaataagtggatcagcaaccgtgggggtattggtgtatcgacagagaaaagttgggagtcatggtgggagaaagagcacgaacctcttaagtattctggaaagcgtggcactgttctcgaaatagtactcgcggcgcgcttctttatctaccaatatggtcttgtttaccatttgaacataatacacacgaagagcgtgctggtttattgcttgtcatgggttgttatctttctaattttggccgtaatgaaggctgtatcagttgggagacggaaattcagtgccgaattccaactagtgttccggctgatcaaggggctgatattcataacattcatctccatcatcataatcttgattgcgatcccccacatgacagttcaagacatatttgtctgcatacttgccttcatgccgaccggatggggcttgctcttggtggcgcaagctctcaagccagcaatcgtgaagcttcagctgtggggttcgatcagggcgctggcacgaggctacgagatcatcatggggcttctcttgttcacccccatcgcgttcctggcgtggttcccgttcgtgtcggagttccagacgaggatgctcttcaaccaggcattcagcagaggcctgcagatctcgaggatcctcggcgggcacaagaaggaccgggcggcgcgcaacaaggagtaatagatagtcagatgtctgctggggttgtggtttatataccagtatcaacaaccctggttgttttgtactatgtttgtatattgtctgggctgtagctgttgtagaaaaggaacgggatgggattgattgctgtgtagagcatattgcattggctcgagtgctgatttgtaggaatagtaatctggaaaagattagagaaggtagcctaatctgatgagttaaatgtatgtataacacatggatccagtgactttgtgtcgaatatccaatgccatgttgagttgaagggtggagatgctctgtactaatctttgacagaaacataaggcttattacaaggacgaattcctcttgctgcagcttga

SEQ ID NO: 991 - DNA, 6472 bp, Sorghum bicolor
acttgctgctgctgctgctgctagtcagtagccgaggacccgccccatacccatggcgtcctcctcggggggcggcgggggccgcaggttggcccccgggggagacgcctcccccgcctccgccggcgccaggaggatctaccgcacccagaccgccggtaacctcggcgactccatattcgacagcgaggtcgtcccgtcgtcgcttgtcgagatcgcgcccatcctgcgtgtggccaacgaggtggaggccagcaacccgcgagtagcctacctctgccgcttctacgccttcgagaaggcgcatcgcctcgaccccacctccagcggccgtggcgtccgccagttcaaaaccgccctgctgcagaggctcgagagggagaacgatcccacgctcaagggcagggtcaagcagagtgacgccagagaaatgcagagcttctaccagcactactacaagaagtacattcaggcgcttcaaaacgctgccgataaagccgaccgggctcagctcaccaaagcttatcaaactgccgccgtgctctttgaggtcctcaaagccgtcaatgtttcccagaaaatcgaagtcgatcagtcgattctcgagacgcacaaccaggtcgaggaaaagaagaagctataccttccttacaatatcctcccgcttgatcctgacagcgccaaccaggctatcatgcgctatcctgagatccaagctgctttccatgctcttcgcaacaccagaggtctgccatggcccaaggaacacgacaagaagcccgatgcagatcttcttgcctggcttcaggccatgtttggattccagaaagataacgtatccaaccaaagggagcatctcatacttttgcttgccaacgtgcacataagacagattcccaaacctgaacaacaaccaaagttggatgaccgagcgctggatacagtaatgaagaagctatttaagaattataagagatggtgcaaatatcttggccgcaaaagcagcttatggttgccgactatccaacaggaggtgcaacaacgcaagcttctctatatgggtctttatctgctcatatggggcgaggcagctaacctgagattcatgccagagtgtctttgctacatctatcatcatatggcctttgaactctatggtatgttggctggaaatgtgagcccgacgactggtgaaaatgttaaaccagcttatggtggagaagaagaagccttcttgaagagagttgtgactccaatctataaagttatagaaaaggaagtcgagaggagcaagaccatgaaatcaaagcactcacactggagaaactacgatgatcttaatgagtacttttggtcaagagattgcttccgattgggatggcctatgcgatctgatgcagattttttcaagactccaaatgtttctcttcaccatttggatggagaggacaggcctgtgggtaatggcaattggatgggaaaagtcaactttgttgaaatacggtcattttggcacatcttccgcagctttgataggatgtggagcttcttaattttatctttacaggctatgattataattgcttggaatggtggcacaccaagtgatatctttgatagaggagtgttcaaacaggttttgagcatatttataactgcggctatactgaaactgggtcaagcaatcttggatattatcttgagctggaaagcaagaagaaacatgtctcttgttgttaagctacgatatatcttgaagttactatcagctgctgcttgggttgtgattttgcctgtaacttatgcatacacttgggagaatccaactggccttgcaagaacaattaaaagttggcttggtgatggtcagaatcagccatcattatacattttggcagttgtgatttatttggcaccaaacttgctgtccgctacactatttcttttccctgtaattaggagagctcttgagagatcaaatcttagagtcgtaacattcataatgtggtggtcgcagcctcgcttatttgttggaagagggatgcatgagggcgcattctcccttttcaagtatacaatgttctgggtattgcttttggccactaaattggttgtgagcttctatgtggagatcaaaccacttgtgcagccaacaaaagatataatgaaggagccaatacgaacatttaagtggcacgagtttttcccccatgcaaataacaacattggtgtcgtcattgcgctttgggctcctattattcttgtctatttcatggatactcaaatttggtatgcaattttctcaacgctaattggtggtgtatatggggcttgtcgccgtcttggtgagataaggacattgggaatgttgagatctcggtttgaatctctgcctaaggctttcaatcaatgcttgattccatctgacacaagcaagaggagaggattccgggctgctttctccaaaccttctaagacacctgaggacaccaaagaagaagaaaaaatagccgcaagatttgctcagatttggaatttaattattacaagcttccgcgaggaagatttgatagacgacagagagaaggacttgttacttgttccatactgtaaagatcgtgatatggatataatccaatggccaccattcctgcttgccagcaagattccaatagcattggatatggccgcagatagtggtggaaaagatcgtgatctaaagaagagaatgaagtcggacccatattttacttatgctatcaaggaatgctacgcttctttcaaaaacatcatatatgcactagtgatcagttcacgagagagaggtttcatacaaaagattttcgatatggtggatgagcatataacagaagagactttgataaaggagctgaacatgagtaaccttcctaccctaagcaagaagtttattgagctgcttgacttactggaaagtaacaacaaagaagaacagggtcaggtcatcatattgttccaagacatgcttgaagtggttacaagggacataatggttgaccagctcagcgacctattggaatcaatacatggtccaaataataaaagatctgaaggaatgatgccacttgaccaacaagttcagttgttcacaaaagctattgattttcctgtaaagaaaacacaagcatggaatgaaaagataaaaaggcttcgacttctgctcacggtgaaggaatcagctatggatgtccctacaaacctggatgctagaaggaggatatctttctttgctaattctctttttatgtcgatgccagatgccccaaaagtgcggcaaatgttgcccttctctgtcttgactccttattataaagaagacgttcttttctcttcacaagcactaggggaacagaatgaggatggggtttctatccttttctatttgcaaaaaatctacccagatgaatggaaaaattttcttgaaagggtgcattgtgagagtgaagatcaactccacgagaccgagcaatctgaagagcagcttcgcctttgggcatcataccggggacaaactttgacaagaactgtaagggggatgatgtactacagacaagctttagtccttcaggctttccttgatatggccagagatgacgatcttatggagggttttagagcagctgacctgttatctgaatctgatgaatcgcaacttttgactcaatgcaaagctatagctgacatgaaattcacatatgttgtgtcatgccagcaatatggtatccagaaacgttctggtgatccacatgcacaggatattctgagattgatgaccacttatccgtcacttagggttgcctacatcgacgaagtcgaagagcctagcaaagacagaaataagaaaatagagaaggtttactactccgcattggtgaaggcagcagtaactaagcctgatgatcctggccagaaacttgatcaggatatatataggataaagcttccagggaatgcaatgctaggtgaaggaaaaccagaaaaccagaaccatgccataattttcacacgaggtgaaggtctccaaaccatcgacatgaatcaggaacattatatggaggagactttgaaaatgaggaatttgttgcaagagtttctgaagaaacatgatggtgtgagatatccatcaatacttggtgtaagggaacatatcttcaccggcagtgtttcttctcttgcatggttcatgtcaaaccaagaaacaagttttgtgaccattggacaacgtgtacttgccaatcctttgagagttcggtttcattatgggcatcctgatatctttgatcgacttttccacctgacaaggggaggtgtaagcaaagcttctaagattatcaatcttagtgaagacatatttgctggatttaactcaacattgcgtgaaggaaatgttacacatcatgaatacatgcaagttggcaagggcagagatgttggtctcaatcagatctcactatttgaagcaaaaatagcaaatggtaatggtgaacagacgctgagccgtgacgtctaccgacttggacatcgttttgactttttcagaatgttgtcctgctactacactactattggtttttacttcagcacaatgataacagtttggacagtgtatgtattcctctacgggcgtctgtatcttgtcctcagtggccttgatgaagcactagccactggaaagaggtttatacacaatgagcctctccaggttgctctagcttcgcagtcttttgtgcagcttggcttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgttacatggaggagctgaatatagagctacagggcgtggatttgtggtcttccatgccaaatttgctgagaactatcgattgtattcacgaagtcattttgtgaagggcatcgaactgatgattttgctcattgtgtatgaaatatttgggcagtcataccgaggagctattgcgtacattttcatcacaatttccatgtggtttatggttgtcacctggctctttgccccattcctgtttaatccttctgggttcgagtggcagaaaattgtggatgactggactgactggaataagtggatcagtaaccgtggaggtattggggtgccaccagagaaaagttgggagtcatggtgggaaaaagagcaggagcctcttaggcattctggaaagcgtggcactgttcttgaaatagtgcttgcattgcgcttctttatctaccagtatggtcttgtttatcatttgaacatcaccactcacacaaagagcgttctggtttattgcatctcatgggtcataatctttgtcattttgcttgtgatgaagactgtatcagttggcaggaggaaattcagtgcagagttccagcttgtgttccggttgatcaagggtctgatattcataacgtttatctctattatcataatattgatagcaatcccacacatgacagttcaggacatctttgtttgcatccttgcgttcatgccgactgggtggggtttgcttctgatagcacaaactatgaggtcagctatttcacatatggggctatggggatcggtcaaagcgcttgcccgaggctatgagatcatcatgggcttgctgctgttcaccccgatcgcattcctagcttggttcccgtttgtttcggagttccagacaaggatgctattcaaccaggccttcagtagaggtctgcagatttctcgtatcctaggtggacacaaaaaagacagggctgcacggaacaaggagtgagtagccgattaggtagattgagggtggtgtcgttgggcaatttaactagttggcaccctccctcttgactgtaaatggtagtttctctttgaactctgttggacgataatatgtaagtgtgtgtatgtgtgtgtgtgtgtgtgtgtgtgagagagagagagagagagacagagagacgggggagagggaggccgccgcggatggtaagttgcatggtctgttctgttgtggccttccttgcctggtagtgctgacctacaatgcaaccaatatgccccccacgtggcattatagtagtattggttattgggcactggagaccccggccgaaactgaccaggttatattgcaaggaattcatctctgctaacatgccagattgtatatgtgcgtctacctcttcatgtgctttctttataccagtggaaggcgcgcgccagcgtcctagatttgctaattagctcgaaatgtttgtgtaaaaaatattttcagttttcacaggaaaacaggattaagtttaatgaactaaatatcaatatatgtcattactccgtacatggg

SEQ ID NO: 992 - DNA, 6019 bp, Sorghum bicolor
acttgctgctgctgctgctgctagtcagtagccgaggacccgccccatacccatggcgtcctcctcggggggcggcgggggccgcaggttggcccccgggggagacgcctcccccgcctccgccggcgccaggaggatctaccgcacccagaccgccggtaacctcggcgactccatattcgacagcgaggtcgtcccgtcgtcgcttgtcgagatcgcgcccatcctgcgtgtggccaacgaggtggaggccagcaacccgcgagtagcctacctctgccgcttctacgccttcgagaaggcgcatcgcctcgaccccacctccagcggccgtggcgtccgccagttcaaaaccgccctgctgcagaggctcgagagggagaacgatcccacgctcaagggcagggtcaagcagagtgacgccagagaaatgcagagcttctaccagcactactacaagaagtacattcaggcgcttcaaaacgctgccgataaagccgaccgggctcagctcaccaaagcttatcaaactgccgccgtgctctttgaggtcctcaaagccgtcaatgtttcccagaaaatcgaagtcgatcagtcgattctcgagacgcacaaccaggtcgaggaaaagaagaagctataccttccttacaatatcctcccgcttgatcctgacagcgccaaccaggctatcatgcgctatcctgagatccaagctgctttccatgctcttcgcaacaccagaggtctgccatggcccaaggaacacgacaagaagcccgatgcagatcttcttgcctggcttcaggccatgtttggattccagaaagataacgtatccaaccaaagggagcatctcatacttttgcttgccaacgtgcacataagacagattcccaaacctgaacaacaaccaaagttggatgaccgagcgctggatacagtaatgaagaagctatttaagaattataagagatggtgcaaatatcttggccgcaaaagcagcttatggttgccgactatccaacaggaggtgcaacaacgcaagcttctctatatgggtctttatctgctcatatggggcgaggcagctaacctgagattcatgccagagtgtctttgctacatctatcatcatatggcctttgaactctatggtatgttggctggaaatgtgagcccgacgactggtgaaaatgttaaaccagcttatggtggagaagaagaagccttcttgaagagagttgtgactccaatctataaagttatagaaaaggaagtcgagaggagcaagaccatgaaatcaaagcactcacactggagaaactacgatgatcttaatgagtacttttggtcaagagattgcttccgattgggatggcctatgcgatctgatgcagattttttcaagactccaaatgtttctcttcaccatttggatggagaggacaggcctgtgggtaatggcaattggatgggaaaagtcaactttgttgaaatacggtcattttggcacatcttccgcagctttgataggatgtggagcttcttaattttatctttacaggctatgattataattgcttggaatggtggcacaccaagtgatatctttgatagaggagtgttcaaacaggttttgagcatatttataactgcggctatactgaaactgggtcaagcaatcttggatattatcttgagctggaaagcaagaagaaacatgtctcttgttgttaagctacgatatatcttgaagttactatcagctgctgcttgggttgtgattttgcctgtaacttatgcatacacttgggagaatccaactggccttgcaagaacaattaaaagttggcttggtgatggtcagaatcagccatcattatacattttggcagttgtgatttatttggcaccaaacttgctgtccgctacactatttcttttccctgtaattaggagagctcttgagagatcaaatcttagagtcgtaacattcataatgtggtggtcgcagcctcgcttatttgttggaagagggatgcatgagggcgcattctcccttttcaagtatacaatgttctgggtattgcttttggccactaaattggttgtgagcttctatgtggagatcaaaccacttgtgcagccaacaaaagatataatgaaggagccaatacgaacatttaagtggcacgagtttttcccccatgcaaataacaacattggtgtcgtcattgcgctttgggctcctattattcttgtctatttcatggatactcaaatttggtatgcaattttctcaacgctaattggtggtgtatatggggcttgtcgccgtcttggtgagataaggacattgggaatgttgagatctcggtttgaatctctgcctaaggctttcaatcaatgcttgattccatctgacacaagcaagaggagaggattccgggctgctttctccaaaccttctaagacacctgaggacaccaaagaagaagaaaaaatagccgcaagatttgctcagatttggaatttaattattacaagcttccgcgaggaagatttgatagacgacagagagaaggacttgttacttgttccatactgtaaagatcgtgatatggatataatccaatggccaccattcctgcttgccagcaagattccaatagcattggatatggccgcagatagtggtggaaaagatcgtgatctaaagaagagaatgaagtcggacccatattttacttatgctatcaaggaatgctacgcttctttcaaaaacatcatatatgcactagtgatcagttcacgagagagaggtttcatacaaaagattttcgatatggtggatgagcatataacagaagagactttgataaaggagctgaacatgagtaaccttcctaccctaagcaagaagtttattgagctgcttgacttactggaaagtaacaacaaagaagaacagggtcaggtcatcatattgttccaagacatgcttgaagtggttacaagggacataatggttgaccagctcagcgacctattggaatcaatacatggtccaaataataaaagatctgaaggaatgatgccacttgaccaacaagttcagttgttcacaaaagctattgattttcctataaaaaggcttcgacttctgctcacggtgaaggaatcagctatggatgtccctacaaacctggatgctagaaggaggatatctttctttgctaattctctttttatgtcgatgccagatgccccaaaagtgcggcaaatgttgcccttctctgtcttgactccttattataaagaagacgttcttttctcttcacaagcactaggggaacagaatgaggatggggtttctatccttttctatttgcaaaaaatctacccagatgaatggaaaaattttcttgaaagggtgcattgtgagagtgaagatcaactccacgagaccgagcaatctgaagagcagcttcgcctttgggcatcataccggggacaaactttgacaagaactgtaagggggatgatgtactacagacaagctttagtccttcaggctttccttgatatggccagagatgacgatcttatggagggttttagagcagctgacctgttatctgaatctgatgaatcgcaacttttgactcaatgcaaagctatagctgacatgaaattcacatatgttgtgtcatgccagcaatatggtatccagaaacgttctggtgatccacatgcacaggatattctgagattgatgaccacttatccgtcacttagggttgcctacatcgacgaagtcgaagagcctagcaaagacagaaataagaaaatagagaaggtttactactccgcattggtgaaggcagcagtaactaagcctgatgatcctggccagaaacttgatcaggatatatataggataaagcttccagggaatgcaatgctaggtgaaggaaaaccagaaaaccagaaccatgccataattttcacacgaggtgaaggtctccaaaccatcgacatgaatcaggaacattatatggaggagactttgaaaatgaggaatttgttgcaagagtttctgaagaaacatgatggtgtgagatatccatcaatacttggtgtaagggaacatatcttcaccggcagtgtttcttctcttgcatggttcatgtcaaaccaagaaacaagttttgtgaccattggacaacgtgtacttgccaatcctttgagagttcggtttcattatgggcatcctgatatctttgatcgacttttccacctgacaaggggaggtgtaagcaaagcttctaagattatcaatcttagtgaagacatatttgctggatttaactcaacattgcgtgaaggaaatgttacacatcatgaatacatgcaagttggcaagggcagagatgttggtctcaatcagatctcactatttgaagcaaaaatagcaaatggtaatggtgaacagacgctgagccgtgacgtctaccgacttggacatcgttttgactttttcagaatgttgtcctgctactacactactattggtttttacttcagcacaatgataacagtttggacagtgtatgtattcctctacgggcgtctgtatcttgtcctcagtggccttgatgaagcactagccactggaaagaggtttatacacaatgagcctctccaggttgctctagcttcgcagtcttttgtgcagcttggcttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgttacatggaggagctgaatatagagctacagggcgtggatttgtggtcttccatgccaaatttgctgagaactatcgattgtattcacgaagtcattttgtgaagggcatcgaactgatgattttgctcattgtgtatgaaatatttgggcagtcataccgaggagctattgcgtacattttcatcacaatttccatgtggtttatggttgtcacctggctctttgccccattcctgtttaatccttctgggttcgagtggcagaaaattgtggatgactggactgactggaataagtggatcagtaaccgtggaggtattggggtgccaccagagaaaagttgggagtcatggtgggaaaaagagcaggagcctcttaggcattctggaaagcgtggcactgttcttgaaatagtgcttgcattgcgcttctttatctaccagtatggtcttgtttatcatttgaacatcaccactcacacaaagagcgttctggtttattgcatctcatgggtcataatctttgtcattttgcttgtgatgaagactgtatcagttggcaggaggaaattcagtgcagagttccagcttgtgttccggttgatcaagggtctgatattcataacgtttatctctattatcataatattgatagcaatcccacacatgacagttcaggacatctttgtttgcatccttgcgttcatgccgactgggtggggtttgcttctgatagcacaaactatgaggtcagctatttcacatatggggctatggggatcggtcaaagcgcttgcccgaggctatgagatcatcatgggcttgctgctgttcaccccgatcgcattcctagcttggttcccgtttgtttcggagttccagacaaggatgctattcaaccaggccttcagtagaggtctgcagatttctcgtatcctaggtggacacaaaaaagacagggctgcacggaacaaggagtgagtagccgattaggtagatggagggtggtgtcgttgggcaatttaactagttggcaccctccctcttgactgtaaatggtagtttctctttgaactctgttggacgataatatgtaagtgtgtgtatgtgtgtgtgtgt

SEQ ID NO: 993 - DNA, 6032 bp, Oryza sativa
gctcgatatctaggtgttgcagaggaggagatttgatttgatttgagattccgatggcggcgcccggcggcgccaggaggcccgacttctcctccgcggcctcgccctctccctcgccggcgggggcagccgggaggaggctgctccgcacccagaccgtcggcaacttgggcgagtccatcttcgacagtgaggtcgtcccctcctcgctcgtcgagatcgcccccatcctccgtgtcgccaacgaggtcgaggccaccaacccacgcgtcgcctacctatgccgtttctatgctttcgagaaggctcatcgcctcgaccccacctccaatggccgtggtgttcgtcaattcaaaaccgcgcttctgcagaggcttgaaagggaaaatgatccaacattgaagggaagggttcaccagagtgacgctcgagagatgcaacgtttctaccgtgaatactacaagaagtacatccaggcacttcaaaatgctgccgacaaggctgaccgtgctctgctcactaaggcataccaaactgctgctgtcttgttcgaggtcttgaaagccgtcaatgtttcccaatctgttgaagtcgatcaagcgattctggatacacacaacaaagttgaggaaaagaaaaagctctatgttccttacaatattctgccactcgatcctgagagtacttatcaacctattatgcaatatccagagattcaagcagctgttaatgcgctaaggaatattagaggcctgccgtggcccaaggaacatgaaaagaagcctgatgaaaagaagactggcaaagaccttcttgattggcttcaggccatgtttgggtttcaggtagttatccacttcctggtgaaactctccatgttgacatcacaacatgtactttgccctggaaatgtgcatagtctaactaaagataatgtgtccaaccaaagagaacatctaatactgttacttgcaaatgtgcacataaggcagtctcctaagactgagcaacaagcaaagttggacgacagagctctagatgctgtaatgaagaagctatttaagaattataagaagtggtgcaagtaccttggccgcaaaagcagtttatggttgccaactatccagcaggaagttcagcagcgtaagcttctctacatgggtctctatttgctaatttggggtgaggcggctaacttgaggttcatgccagagtgtctttgctacatctaccatcatataatggaagctttattgaactcaataaattacattgagatggcttttgaactctatggcatgttggctggaaacgtgagtccaatgactggtgaaaatgttaaaccagcgtatggtggtgatgaagaggccttcctgatgaaagtagtgactccaatttacaaagttatagagaaggaagctgaacggagcaagaccataaagtcaaaacactcacattggaggaactatgatgatttaaatgagtatttttggtcagtggattgttttcggctaggatggcctatgagagcagatgctgattttttcaaaactcctgaagatgcttaccctagtcgtcttaatggaataattggaatggattacatttccagccttgtccttcaatgtaatgccaagaaaaagaaatacttgcttggagtattaatcctctgggtacccatttctcgtttggtcgcgaatgcaggagaacagatccgcagaaggtttcttgagagttcaaatgttaaggtcataacattcatcatgtggtggtctcagcctcgactatttgttggcagaggaatgcatgaaggcgcattttccctcttcaagtataccatgttctgggtcctccttttagcaatgaaattgacaatcaagcctctggtacagccaaccaaagatataatgaaagagccgatccgggatttccagtggcatgaatttttccctcgtgctaacaataacattggtgttgttattgcgctgtgggctccaataattcttgtctacttcatggacacccaaatttggtatgcacttttctctacattgatcggtggtatctatggggcttatcgtcgtcttggtgagatacggacattaggaatgttgagatctcgttttgaatctctgcctgaggccttcaatgagcacttgattccttctgattcacacaagagtaaaggtttgcgtgctgcctttactggtaaaccttctaagacttctggtgatgagcaagagaaagagaaaatagccgcaagatttgctcaaatgtggaacctaattatcacaagtttccgtgaggaagatcttatagataacagggagatggacttgctacttgtcccatactgtaaagaccgtgaattgaatatattccagtggccacctttcctacttgctagcaagattccaatagcattggatatggcggcagacagtggaggaaaagatcgtgatctgaagaagagaatgggatcagatccgtatttttcctatgctatcagagagtgctatggttcattcaaaaacatcatcaatactttagtgtttggtcaacgtgagaaaatagtaatacagcagatttttacaattgttgatgaacacatagaagggggaagtctaataaaggatttgaacatgaggagccttcctgccctgagcaagaagttcattgaactacttgaattactgcaaaagaataaggaagaagacttgggccaagttgtcattttattccaagatatgcttgaggtggtcacaagggatataatggatgagcaagaccagctaggcggactattggattctgtacatggtggaaatagaaaacacgaaggaatgacttcacttgatcaacaagatcagttgttcactaaagctattaggttccccgtggaggaatcaaatgcatggacggaaaagataaagaggcttcaccttcttctcactgtgaaagagtctgctatggatgtccctacgaaccttgatgctaggagacggatatcgttctttgcaaattctctttttatggagatgcctaatgctccaaaagtgcggcatatgttgcccttctctgtcttgactccttattacaaggaagatgttcttttctcctctcataatctggaagagccaaatgaggatggggtttccatacttttctacttacaaaaaatctacccagatgaatggaaaaatttccttgatagggtggaccgcaagagcgaggaggagctccgtgaggatgaaacattggaagaggagcttcgcctttgggcatcatataggggacagacattgacaagaactgtgagaggaatgatgtactaccgaaaagcgttggagcttcaggctttccttgacatggccaaagatgatgatcttatggaaggttacagagcaactgaactgatgtctgaggactcgcaattgatgactcaatgcaaagctatagctgacatgaaatttacatatgttgtctcgtgccagcaatatggaatccagaaacgttctggtgaagcctgtgcgcatgatattttgaggctaatgacagtgagagctgttgtgatagtatatccatcacttcgagttgcttatattgatgaggttgaagcacctagccaagatagaaacaagaagactgacaaagtttactactcagcattggtgaaagcttccgttacaaaacctaatgaaccaggacaaagtcttgatcaggtcatatacaagataaaacttccaggtaatgctattttaggtgaaggaaaaccagaaaatcagaatcatgcaattatttttactcgtggtgaatgcctccaaactatagatatgaatcaggagcattatatggaggaggctttgaaaatgagaaatctgctggatgagtttctgaagaaacatgatggtgtgagatatccatcaatacttggagtaagagagcatatatttactggcagtgtttcatcccttgcatggttcatgtcaaatcaggagaccagttttgtgactattggacagcgtgtgcttgccaaccccctgagggttcgattccactatggccatcctgatatctttgatcgtcttttccacctcacaaggggtggtgtaagtaaagcatccaaaattatcaatcttagtgaagatatatttgccggtttcaattcaacattgcgtgaaggcaatgtcactcatcatgagtacatgcaagttggcaagggaagagatgtgggtctcaaccaaattgctctgtttgaggcaaagatagcaaatggtaatggtgaacaaacactgagccgtgacatttatcgactagggcaccggtttgatttcttcagaatgctgtcatgctattacacaacaattggcttctactttagtacaatgattacagtatggactgtatatgttttcctctatgggcgcttatatcttgtcctcagtggactggaccaagcactagccactggaaagaagtttgtgcataatgcacccctccaagttgctcttgcatcagagtcttttgttcaacttggatttttgatggcgttgcccatgatgatggaaattggtctggagaggggattcagaacagcactaagcgactttgtacttatgcaacttcagttggcatctgttttctttacattttcacttgggaccaaaactcattattacggaaggacattactccacggaggagctgaatatagagccactgggcgtggatttgtggtgtttcatgccaagtttgctgacaactaccgactttattctcgcagccattttgtcaagggtattgagctgatgattttgctggttgtgtatgaaatctttgggcaatcatacagaggggctatcacatacattttcatcactgtttccatgtggtttatggtgggcacctggctctttgcaccattcctattcaatccttctggatttgagtggcagaagattgtggatgactggactgattggaataagtggatcagcaaccgtggaggtattggagtagcaccaacaaaaagttgggaatcatggtgggaaaaagagcaggagcctcttcgatactctggaaagcgtggtactattcttgaaattctgctcgcgttgcgcttctttgtctaccaatatgggcttgtgtatcatttgaatataaccaagcatactcgcagtgtactggtttattgcttttcatgggttgtgattttcgtaattttacttgtcatgaagactgtttcagtcggtaggaggaggttcagtgcggagttccagcttgtcttccggttgatcaagggccttatattcataacatttgtcgccattgttgtgatattaattgccatccctcacatgacagttcttgatatcttcgtttgcatccttgctttcatgccaactggatggggcttgcttctgattgcgcaagccatcaaacctgctgtccaggctattgggctttggggatcaatcaaggctcttgcccggggctatgagatcctaatgggactcctgttattcacacccatagcgttccttgcttggtttcctttcgtgtccgagttccagaccaggatgctcttcaaccaggccttcagcagaggtctgcagatctcccgtatccttggcgggcacaagaaagaccgatcaacccggaacaaggagtagactgagcggcgagggctccccccaaaccaattgttgtagtagtatgcattatcctagtaggagtatccgcccccagttttgcgtgtgctctgattgtcaccagattcagagaccgggggaggcgtacgctaagctagcgtatcagcatgtttcagtgtatctgcagattcacaacattcgcacctctccattatgtaaatctctatcgctcattagcaaatcggagcatctaatttagagatgtcttctgggttagtagtaatatatctggtgaacagagttgattgaatgtttgtgggagcaaatcatgttttaaagatcctgctcttgcatctcttaaggcatcagagcagtttttga

SEQ ID NO: 994 - DNA, 5523 bp, Secale cereale
cctacgactacccgaaagtaccgatacaagctataatgaccaaaaccagagattacaacgccgctgtctacgctcttcgacaatataagacggcctgccatggcccaaggacaaggagcaggagaagaagcaggaaaagaagcctgatgagaagaagaccgatagagatcttctcgactggcttcaggctatgttcgggttcagaaagacaatgtagccaaccaaagggaacatctcatcctgttacttgcaaatgtgcacataaggcagataccaaagcctgaacagcaatctaagttggatgacagagctctggatactgtaatgaagaagctatttaagagttataagatgtggtgcaagtaccttggtcgcaaaagcagtttatggttgccaactatccaacaggaagttcagcaacgcaagcttctctatatgggtctctaccttttgatttggggtgaggcggctaacttgagattcatgccagagtgtctttgctacatataccatcatatggcttttgaactctatggtatgttggctggaaacgtgagcccaatgactggtgaaaatgttaaaccagcttatggcggtgatgaagaggcattcttgatgaaagttgtgactccgatatacagggttatagaggaggaagctctcaggagcaagacaatgaaatcaaaacactcacactggaggaattacgatgacctaaatgagtacttttggaaagttgactgcttccggcttgggtggcccatgagagctgatgcagattttttcaaaactcccaaatttgcttatcctaatcgtctgaatggagaggaaagatctgctggcagtgtccattggatgggaaagatcaattttgtcgagatacgttctttttggcacatattccgtagttttgatagaatgtggatcttcttaattttatccttgcaggctatgattattattgcatggaatggtggcacaccaagtgatatctttgatgctggggttttcaaacaggttttgagcatatttataactgctgctgttttaaagttgggtcaagccaccctggacattgtatttggctggaaagcaagaagaagcatgtcgtttgcaagaaagctgcgatatgtcctgaagttagtatcagctgctgcatgggttgtgattctacctgtgacttatgcatatacctggtctaatccttcgggtctttcaagaataataaaaagttggcttggcaacggtcagaatcagccatcattatacattttggctgttgttatatatttggcgccaaatattcttgcggctacgctatttcttttcccatgtatcagaaggaggcttgagagttcaaatgttaaggtcataacttttatgatgtggtggtcccagcctcgattatttgttggcagaggaatgcatgaaggcccattctccctcttcaagtataccatgttctgggttctccttttagcgatgaagttgatagtgagcttctatattgagatcaagcctctggtacaaccaacaaaagatataatgagagaaccgattcggaatttccagtggcatgagtttttccctaatgcaagtaacaatattggtgttgtcatcgcactttgggctccaataattcttgtctatttcatggacacccaaatttggtacgcagttttctcaacattgattggtggtatctatggggcttgtcgtcgacttggtgagatacggactttaggcatgttaagatctcgctttcgaatctttgccttgggccttcaataaattgttgataccttctgatcaacacaagaggaaaggtttccgggctgctttttccactaaacttgctaagccttctggtaatgaacaagagagagagaaaatagctgcaagatttgcccaaatgtggaacctaattatcacaagtttccgtgaagaagatctcatagataacagggagatggacttgctacttgttccatactgcaaagatcgtgaattggatatattccaatggccaccttttctacttgctagcaagattccgatagcattggatatggcggcagacagtggaggaaattatcgagatctgaacaagagaatgaaatcggacccgtatttttcctatgctatcagagaatgctatgcttcattcaaaaacatcatcaacaccttagtgtttggtcaacgtgagaaaattgttatgcaagagatttttgaagttgttgataaacatatagccgaagaaactctgataaaggatctgaacatgaggagtcttccagccctgagcaagaagctcattgagctacttgagttactgcaaaagaataagttagaagacttgggtcaagttgttattttgttccaagatatgcttgaggtggtcacaaaggatataatggaggaacaagagctcagcagtgtactggattccatacacggtggaaatgctaaaaaacacgaaggaatgacaccgcttgatcagcaagatcaattgtttactaaagctattaagttccctgtggaggcatcaaatgcatggactgaaaagataaagaggcttcatcttctgctcaccgtcaaagagtctgctatggatgtccctacaaacctcgatgctagaaggagaatatctttctttgcaaattctctttttatggatatgccaaatgccccaaaagtgcggaacatgttgcccttctcggtcttgactccttattacaaggaagatgttctgttttcatcagataatctagaagaggcaaatgaggatggaattaccatacttttctacttgcaaaaaatttacccagatgagtggaaaaatttccttgaaagggtgaacagaactgaggaggaggcccgtgatgatgatacaatagaagatgagcttcgtctttgggcatcatatagaggacagacattgacaagaactgtaagagggatgatgtactaccgaaaagctttggagcttcaggcatttcttgataatgccaaagatgatgatcttatgaaaggctacagagagatagctgacatgaaggaatctgaattaatgacggaatgcaaagcgctagctgacatgaaatttacatatgttgtctcatgccaacagtatggaatccagaaacgttctggtgatccttgtgcacatgatattttgagactgatgacaacatatccatcttttcgtgttgcctatattgatgaagttgaagcacctagccaagatagaaacaagaagactgacaaagtttactactcagttttggtgaaggctgctgttacaaaatcagatgatcctggacagagtcttgaccaggtcatctacaagatcaagcttccaggcaatgctattctaggcgagggaaagccagaaaatcagaaccatgcaataattttcactcgaggcgaatgtctccaaactatagatatgaaccaggagcattacatggaagaggctctgaaaatgagaaatttgttggaagagtttctggagaaacatgatggtgtgagatatccatcgatacttggagtaagggagcatatatttactggcagtgtttcatcgctggcttggttcatgtcaaatcaagagacgagttttgtgactattggacagcgtgtgcttgccaacccattaagggttcggtttcattatggccatcctgatatatttgatcgtcttttccacctgacaaggggtggtataagtaaagcatctaagattatcaatcttagtgaggacatatttgcaggattcaattctacattacgtgaaggcaatgtcactcatcatgaatacatgcaagttggcaagggaagggatgtgggtcttaatcagatttcactatttgaggcaaagatagcaaatggtaacggtgaacagacactcagccgggacatttaccgactggggcaccgttttgatttcttcagaatgctgtcgtgttactatacgacaattgggttctatttcagcacaatgattacagtttggactgtgtatgctttcctttatgggcgtttgtatcttgtcctcagtggacttgatgcagcacttgctactggaaagaggttcgtgcataatacaccgctccaggtcgcgcttgcatcagaatcttttgttcaacttggatttttgatggcattgcccatgatgatggagatcggtttggagagaggattcagaacggcattaagtgactttgtgctcatgcaactccagttggcatctgttttcttcacgttttcgcttgggaccaaaactcactattatggaaggacgctactccatggaggagctgaatatagagcgactggacgtgggtttgtggtgttccatgccaaattcgccgagaactaccgactctattctcgcagccatttcgtgaagggtattgagctgatgattctgcttgtcgtgtatgaaatctttggacagtcgtacagaggagctatcacttacatcttcatcactgtttccatgtggtttatggtgggcacctggctctttgcacccttcctgttcaacccttccggattcgagtggcagaagattgtggacgactggactgattggaacaagtggatcagtaaccgtggaggtattggtgtggcgccagagaaaagctgggaatcctggtgggacaaagagcaggggcctcttcggcactctgggaagcgtggcaccattcttgaaatacttcttgcattgcgtttcttcatctaccaatacgggcttgtgtatcatttgaatataaccaagcagtataaccaaagcgttctggtttacggcttctcatgggttgtgattctggtcatgctgcttgttatgaagaccgtgtcagtcggcaggaggaggttcagcgcggagttccagctcgtcttccggctgatcaaggggctgatattcataacattcatctccatccttatcatcttaacggcaatcgcccacatgacagtccttgacatcttcgtctgcatcctcgccttcatgccgactggatggggcctgcttctgattgcccaagcgatgaagcctgtcgtcgagatggtggggctgtgggggtcggtgaaggccctcgcccggggctacgagatcctgatggggctcctgctgttcacgcccatcgcgttcctcgcgtggtttcccttcgtgtccgagttccagaccaggatgctcttcaaccaggcattcagcagaggcctgcagatctcccgtatcctcggcggccacaagaaggaccgagccacccggaacaaggagtaggtagaagatctagggcatctattatcggtgtcactcgcccccgactcttctcgattctgctgccacggttgttcccatgcgattctaatctgactgttcatccagagatcgggtggctgtgctataggctacttagtagtgttctccagtgtagttgtagattcagagctgttgcgactgcgctttatgtacatatctactgctccttagcgtggctgctggaccttatgtta

SEQ ID NO: 995 - DNA, 5971 bp, Secale cereale
ctcctccccattttcactccaccgccccaccaaacccctctccgaccccgagcctagtgagcgagggaggagccaaagttccgtcctttccttcttccggccggcgggatggcctcctcctccgggaggcggccgggcgcgggcccaggcggcggggagccctcctcctcgggcgcggcggcaaccccggcgtccggcggcaggaggatcctgcgcacgcagacggcggggaacctgggcgagtccatcttcgacagcgaggtggtcccctcgtcgctggtggagatcgcccccatcctccgtgtcgccaacgaggtcgaggcaagcaaccccagagtcgcctacctatgtcgattctatgccttcgagaaggcccatcgcctcgaccccacatccagcgggcgtggtgtccgtcagttcaagaccgcgctcctccagaggctcgaaagggaaaacgaccccacattgaagggaagggttaagcagagcgatgcccgcgaaatgcagagtttctaccagcactactacaagaagtacatccaggcgctccagaatgccgccgataaagctgaccgcgcccagctaacaaaggcgtatcagactgcggctgtcctgttcgaggtcctgaaggctgtcaatgtctcacagaaaatcgaagttgatcaggcgattttggagacgcacaaccaagtcgaggagaagaaaaagctctatcttccttacaatatcctcccgctcgatcctgacagtgctgctaaccaggctattatgcgatatcccgagatccaagcctcttttcatgctcttcgtaacacaaggggtctgccatggcccaaggaccatgaaaagaaggatgatgcggatcttcttgagtggcttcaggcactgtttgggtttcagaaagataacgtgtccaatcaacgagaacatctcatactgttgcttgccaacgtgcatataagggagatgtccaaacctgaccaacaatcaaagttagacgaccatgcgctagatatagtgatgaagaagctcttcaagaactacaaaagatggtgcaaataccttggccgcaaaagcagcttatggctgccgacaattcaacaagaagtacaacagaggaagcttctctatatgggcctttatctgctcatatggggagaggcagctaacttgcgatttatgccagagtgtctttgctacatctatcatcatatggcttttgaattgtatggtatgttggctggaaatgtgagcccaacaactggtgaaaatgttaaaccagcctatggtggtgccgaagaagccttcctgaagaaagttgtgaccccaatttacaagatcatagagatggaagctgaaaggagcaagaccataaaatcaaaacactcacattggagaaattatgatgatctcaatgagtacttttggtcaagagattgttttcggttaggatggcctatgagagctgatgctgattttttcaagactccaaattttgttctcaatactcgtgatcaggcgaatggagaaaacagaccaattcgtaatgaccattggatgggaaaagtcaactttgttgaaatacggtcattttggcacatcttccgtagctttgacaggatgtggagcttcttaattttatccttgcaggccatggttatagttgcttggaatggtggcacaccaggtgacatcttcgatgcgggagtgttcaaacaagttttgagcatatttataactgctgccgtaatgaaaatgggccaagcaattctggacattgtcttgagctggaaagcaagaaaaagcatgtctcttgctgttaaactccggtacatcttgaaattactatcaggagctgcatgggttgtagttttaccagtaacttacgcatacacctcagacaatcctactggactcaatagaacaatcaaaagctggttcggtgacggccggaaccagccatcgttatacatcttggctgttgtgatatatttgtcaccaaatatgctggcggctacgctattcatttttcctatcctgaggagatttcttgagaagtcaaatcttaaagttgtagccctcataatgtggtggtcacagcctcgcttattcgttggcagaggaatgcatgaaggcgcattctcccttttcaagtatacaatgttctgggtcgttcttctggccacaaaattggtagtgagcttctacgtggagatcaggccactcgtgcaaccaacaaaagatataatgaaggtgccaataacaacatttcagtggcacgagttcttcccacatgcaaagaacaatgtcggtgttgtcattgcactttgggctcctatcattcttgtctatttcatggatacccaaatatggtatgcaattttctcaacattagttggtggtatctatggggcatgtcgtcgtcttggtgagatacggaccttaggaatgttaagatctcgcttcgaatctttgcccaaggctttcaacgatcacttgattccaaatgactcaaagaggagaggattccgctccgctttctccagtaaaccttataagaaacctgaggatggcaaagaagaagacaaaatagctgcacgatttgctcagatatggaatctaatcatcacaagcttccgccaggaagacttgatagataacagggagaaggacttgttacttgttccatactgcaaggatcgtgaaatggatatgatccaatggccaccgttcctgcttgctagcaagatcccaatagcattggatatggcagcagacagtggaggaaaagatcgtgatctaaagaaaaggatgagttcagatccgtattttacttatgccatcaaggaatgctatgcttcattcaaaaacgtaatatatgctttagtggttggcccacgggagcgcgatgtcatccaaaagatctttaaagtggtggatgatctcgtagcagccgatactctgataaaggatctgcacatgagcaacttacctaccctgagcaagaagtttattgagctgcttgtgatactgcaaaagaataacaaagaagatctgggtcaggtcatcattttgttccaggatatgctcgaggtggttacaagggatataatggaagaccaactcaccgagctactggagccggtacatggtggaaataaccgaaaacatgaagggattacaccactggatcaacaggaacaggaacagttattcactaaagccgttgaatttgaatttcctgtgaaggcatcagatgcctggaaggaaaagataaaaaggcttcaccttctgctcacagtcaaggaatctgctatggatgttcctacaaacctggacgctagaaggaggatatctttctttgctaattctctttttatggacatgccaaaagctccaaaagtgcgcaatatgctgcccttctctgtcttgactccctattacaaagaagacgtccttttctcctcacaagcactagaggaagagaacgaggatggggtttctatccttttttacctgcaaaaaatactacccagatgaatggaaaaactttcttgaaagggtggactgcaagaatgaggaggaactccgtgagactgaacaaacggaagatgagcttcgcctttgggcatcatacagaggccaaactttgacgagaactgtaagagggatgatgtactaccgacaagctttggtgcttcagtcttgtcttgatatggccccagagaatgatctcatggaaggcttcagggctgcagatatactatctgaggaatcacacttattgactcagtccaaagctgtagccgacatgaagtttacatacgttgtatcatgccagtcatatggtatccagaagcgttctggtgatgcacgtgcacaggatattctgagactcatgacaacttatccatcacttcgggttgcctatattgacgaagtcgaggagacaagcaaagagggggaggcaagcaaagataggagcaagaagatagagaaggtttactactcagcgttggtgaaggcggcagtaactaagcctgatgatcctggtcagaaactcgatcaggacatatacaggataaaacttccaggcaatgcaatgttgggtgaaggcaaaccagaaaatcagaaccatgcgataatttttactcgaggcgaaggcctgcaaaccatagacatgaatcaggagcattatatggaggagacgttgaaaatgagaaacctgctgcaagagtttacgaagaaacatgatggtgtgaggtatccaacaatacttggtgtaagagaacatatattcactggcagtgtttcttcgcttgcgtggttcatgtcaaaacaagagacaagttttgtgactattggacagcgtgttcttgccaatcctttaagggttcgatttcattatggacatcctgatatctttgatcgactgttccatctcacaaggggtggtgtgagcaaagcatctaagattatcaatcttagtgaggacatatttgctggattcaattcaacactgcgtgaaggaaacgtcacacatcatgaatacatgcaagttggcaagggaagggatgttggtctcaatcagatttcactatttgaggcgaagatcgcgtatggtaatggcgaacagacactgagccgtgacatctaccgacttgggcatcgttttgatttcttcagaatgttgtcctgctactatactaccattggcttctacttcagcacaatgatcaccgtatggactgtatatgtgttcctctacgggcgtttgtatcttgtcctcagtggcctcgatgaaggactagccactggaagaaggtttatacacaacgaccctctccaggtcgctctcgcctcacagtcgtttgtgcagcttggcttcttgatggcgctccctatgatgatggagattggtctggagagagggttcaggactgcgttgagcgactttgtgctcatgcagcttcagttagcgtccgtcttcttcacgttctccctcggaaccaagactcactactacggaaagacgctgctccacggaggagccgagtacagagccaccgggcgtggattcgtggtgttccacgccaaattcgccgagaattaccgcctctactcgcgcagccatttcgtcaagggcatcgagctgatgatcctgcttatcgtgtttgagatcttcgggcagtcgtaccgaggagctatcgcctacatcttcatcaccttctccatgtggttcatggtcgtcacctggctctttgcgcccttcctgttcaacccttctgggttcgagtggcagaagattgtggacgactggaccgattggaacaagtggatcagcaaccgcgggggttagttggtggttccgccgggcaaaaagctcgggaggtcgatggtgggagaaagagcatgagccactcaaatactccgggaagcgtggcaccgttcttgagatagtgctggccgtgcgcttcttcatctaccagtatgggcttgtttaccatctcaacataaccaaacacaccaagagcgtcctggtgtattgcttgtcatgggttgtcatcttcttcattttgctggtgatgaaggctgtgtcggttgggaggcggaaattcagcgccgagttccagctcgtgttccggctgctcaaggggctgatcttcattgtgttcatctccaccatcgtgatcctgatcgtgatcccccacatgacgatccaggacatattcgtctgcatcctcgccttcatgccgacgggatggggcctgctgctggtggctcaggcgctgaaacctgcgatcatgagcgtggggctgtgggggtcgatccgggcgctggctcgtgggtacgagatcatcatggggctgctgctctcaccccgatcgcgttcctggcgtggttcccgttcgtgtcggagttccagacgcgcatgctcttcaaccaggccttcagccgtgggctgcagatc

SEQ ID NO: 996 - DNA, 1510 bp, Triticum aestivum
gcgctcgctaccgcacccgcgccgtcacgtccaggcctcccacccccgacccgctgctcccatctccgccgccccaaagccctagccacctccaagctccctcgccgcgtcatcgccgcccttcacatggacggcgcccgcgccgcaccccttcgctgcactcccgccgagacggacgcggtggcgacgacctcggaccagaccgagacggcggcggcggtcgaagccaccgagcagggcaacaacggggccccagcggcggacgcccccgccgccagcatcgaggggctcgacgggataaagatccggaggcgcccggtgacgggcccgtccgtgcaccacgtgggccccttccagttccgcctcgagaacgagggcaacacgccgcgcaacatcctcgagaagattgtctggaacaaggacgttgagatttggcagatgaaggagaaaatgcccctgtacaggctgaaaggtccgctggacaatgcgcctccggccagggactttgttgctgcgctgaaagcgtcgtatgatcggactgctctgcccgctctgattgcggaggtgaagaaggcttcgccaagccggggggttcttagggagaatttcgacccggtcgagatcgctcaagcatacgagaaaaatggagcagcatgcttaagtgtccttacagattcaaaattctttcagggaagtttcgactacttggaggctatacgcaatgctggagtaaagtgtcctctgctgtgcaaagagttcatcattgatgcttggcagctttactatgcacggtctaagggagcagatgctgttcttctgattgctgccatcttacctgatcgcgatatcagttatatgctgaaaatatgcaaaatactcgggatggcagctttagttgaggtgcatgatgaaagggaaatcgaccgtgttatagggatagatggcattcagcttattggcatcaataaccgtaatcttgaaactttcgaagttgacatttcaaacacgaaaaatcttctggagggtgaacggggacaacttatagcccagaaggacataattgtcgtaggcgaatctggactgttcacgcctgaccatgtttcattcgttcaggatgccggggtcaaagcgattcttgtcggggagtccctcatcaagcaggaggaccctgggaaagcaatcgctgggcttttcggcaaagacatctcacccgtgagtagtgcggtgtaaataggaaaaggggcaaggaatcatgaaatgctgggcctctcatattttgtatagatgaacagagcgacatgcgcttttggagagtttttgtcagcaattttgtttacctggccagtataggtgttcttcccttgctgccatttcctgtaagttgtaaccggcctctttgttcaaaggatgcaatgcgaagagagatgatcgaataagctgggtgtagttgttagcagtttgagtttacttgccttatatttcagctctcttcgctgctgtatctaagttc

SEQ ID NO: 997 - DNA, 1447 bp, Triticum aestivum
gcgctcgctaccgcacccgcgccatcacgtccaggcctcccacccccgacccgctgctcccatctccgccgccccaaagccctagccgcctccaagctccctcgccgcgtcatcgccgcccttcacatggacggcgcccgcgccgcacctcttcgctgcactcccgccgagacggatgcggcggcgacgacctcggaccagactgagacggcggtcgaagccaccgagcagggcaacaacggcgccccggcggcggacgcccccgcctccagcatcgaggggctggacgggataaagatccggaggcgcccggtcacgggcccgtccgtgcaccacgtgggccccttccagttccgcctcgagaacgtggggaacacaccgcgcaacatcctcgagaagattgtctggaacaaggacgttgagatttggcagatgaaggagaaaatgcccttgtacaggctgaaaggccctctggacaatgcgcctccggccagggactttgttgctgcgctgaaagcgtcctacgatcggactgctctgcccgctctgattgcggaggtgaagaaggcctcgccaagtcgggggggtctcagggagaattttgacccgggtgagatcgctcaagcatatgagaaaaatggagcagcatgcttaagtgttcttacagattcaaaattctttcagggaagtttcgactatttggaggctatacgcaatgctggagtgaagtgtcctcttctgtgcaaagaattcatcattgatgcttggcagctttactatgcacggtctaagggagcagatgctgttcttctgattgctgccatcttacctgatcgcgatatcagttatatgctgaaaatatgcaaaatactcgggatggcagctttagttgaggtgcatgatgaaagggaaatcgaccgtgttatagggatagacggcattcagcttattggcatcaataaccgtaatcttgaaactttcgaagttgacatttcaaacacgaaaaagcttctggagggtgaacggggacaacttatagcccagaaggacataattgtcgtaggcgaatctggactgttcacgcctgaccatgtttcattcgttcaggatgccggggtcaaagcgattcttgtcggggagtccctcatcaagcaggaggaccctgggaaagcaatcgctgggcttttcggcaaagacatctcacccgtgagtagtgcggtgtaaataggaaaaggggcaaggaatcgtgaaacgctgggcctctcatattttgtataggagaacagagcgatgtgcgcttttggagagttttggtcagcaattttgtttacctggccagtatcagtgttcttcccttgctgccatttcctggaagttgtaaccggcctcactgttcaaaggatgcaatgcgaagagagatgatcgaataagttgggtgtagatgtta

SEQ ID NO: 998 - DNA, 1310 bp, Pseudoroegneria spicata
  misc_feature (6)..(8): n is a, c, g, or t
cgcgcnnncacgtccaggcctcccacctccgacccgccgctcccatctccgccgccccaaagccctagccacctccaagctccctcgccgcgtcatcgccgcccttcacatggacggcgctcgcgccgcacctcttcgctgcactcccgccgagacggatgcggtggcgacgacctcggaccaggctgagacggcggaggcggcggtcgaagtcaccgagcagggcaacggggccccagcggcggacgcccccgtcgccagcatcgaggggctcgacgggataaagattcggaggcgcccggtcacgggcccgtccgtgcaccacgtgggccccttccagttccgcctcgagaacgaggggaacacgccgcgcaacatcctcgagaagattgtctggaacaaggacgttgagatttggcagatgaaggagaaaatgcccctgtacaggctgaaaggtccgctggacaatgcgcctccagccagggactttgttgctgcgctgaaagcatcgtatgatcggactgctctgcctgctctgattgcggaggttaagaaggcttcaccaagccggggggttcttagggagaatttcgacccggtcgagatcgctcaagcatacgagaaaaatggagcagcatgcttaagtgttcttacagattcaaaattctttcagggaagtttcgactacttggaggctatacgcaatgctggagtgaagtgtcctcttctgtgcaaagagttcatcattgatgcttggcagctttactatgcacggtctaagggagcagatgctgttcttctgattgctgctatcttacctgatcgcgatatcagttatatgctgaaaatatgcaaaatactcgggatggcagccttagttgaggtgcatgatgaaagggaaatcgaccgtgttatagggatagatggcattcagcttattggcatcaataaccgtaatcttgaaactttcgaagttgacatctcaaacaccaaaaagcttctggagggtgaacggggacaacttatagcccagaagaacataattgttgtaggcgaatctggactgttcacgcctgaccatgttttgttcgttcaggatgccggggtcaaagcgattcttgttggagagtccctcatcaagcaggaggatcctgggaaagcaatcactgggcttttcggcaaagacatctcacccatgagtagtgctgtgtaaatagaagaaagggtaaggaatcgtgaaatactagatctctcatattttgtatagaaaaaacagagcggtatgcgcttttggagagttttggtcagca

SEQ ID NO: 999 - DNA, 1451 bp, Secale cereale
tcctctaatggaggcgctcgctaccgcacccgcgccgtcacgtccaggcctcccacctccgactcgctgctcccatctccgccgccccaaagccccagccatctccaagctccctcgccgcgtcatcgccgcccttcacatggaccgcggcacacctcttcgctgcactcccgccgagacggatgcggcggcgacgacctcggaccagactgagacggccgcggcggtcgaagcggccgagcagggcaacaacggggccccggcggcggacgcctccgccgccagcatcgaggggctcgacgggataaagatccggaggcgcccggtcacgggcccgtccgtgcaccacgtgggccccttccagttccgcctcgagaacgtgggcaacacgccgcgcaacatcctcgagaagattgtctggaacaaggacgttgagatttggcagatgaaggagaaaatgcccttgtacaggctgaaaggtccgctggacaatgcccctccggcgagggactttgttgctgcgctgaaagcgtcgtatgatcggactgctctgcccgctctgattgcggaggttaagaaggcttcaccaagccggggggttctcagggagaattttgacccggtcgagatcgctcaagcatacgagaaaaatggagcagcatgcttaagtgttctcacagattcaaaattctttcagggaagtttcgactacttggaggctatacgcaatgctggggtgaagtgtcctcttctgtgcaaagagttcatcattgatgcctggcagctttactatgcacggtctaagggagcagatgctgttcttctgattgctgccatcttacctgatcgtgatatcagttatatgctgaaaatatgcaaaatactcgggatgtcagctttagttgaggtgcatgatgaaagggaaatcgaccgtgttatagggatagatggcattcagcttattggcatcaataaccgtaatacttgaaactttcgaagttgacatttcaaacacaaaaaagacttttggaaggtgaacggggacgaacttatagcccagaaggacataattgtcgtaggcgagtccggactgttcacgcctgaccatgtttcgttcgttcaggatgccggggtcaaagcgattcttgtcggggagtcgctcatcaagcaggaggaccctgggaaagcaatcgctgggcttttcggcaaagacatctcgcccgtgagtgtgtaaataggataaagggtaaggaatcatgaaatgctggatctctcatattttgtataggaaaacagagcgatatgcgcttttggagagttttggtcagcaattttgtttacctgtccagtatcggtgttcttcccttgctgccatttcctggaagttgtaaccggcctcattgttcaaaggatgcattgcgaagagagatgatcgaattatcaaaaaagtc

SEQ ID NO: 1000 - DNA, 1740 bp, Pennisetum glaucum
caatccgttcagcaggcgtacaacgcaacgcataacggctgacgtccaccccaatccgttcagcgcccccctctgctcggcctcggcgctcggcggcgcctcaaatggaagcgctagcaatcggatccgcgcctccccgaccgggcctccccgccccgacccgctactcccacctcggccgcccaagaaccctcgcagccgcgcgccgccccctcgccgcggcccacatggacgacgccgccgccggcggtggccgcccgagccccgcccctccccgctgcacccgcgccgagacggacgcggaggtgggggaggtcgcgacgacgacgagctcgcacgccgaggcggctgcggcggtcgccacggaggaagggggcagcgggagccccgtggaggatgccgccgctgccgggaccgcctcgatcgagggcgtcgacgggataaggatccggcggcggcccgtgacggggcccgcggtgcactacgtcggcccgttccagttccgcctcgagaacgaggggaacacgccgcggaacatcctcgagaagatcgtctgggacaaggacgtcgaggtttcgcagatgaaggagagaaggcccttgtacatgttgaaggggccgctggaggctgctcctccgccgagggacttcgttggggcgctcaaggcgtcgtatcatcggactggattgcctgctctgattgcagaggtcaagaaggcttctccgagccggggtgttcttagggaggactttgatccggttcagatcgctcaggcatatgagaaaaatggggccgcatgccttagtgttcttacagatggcaaatactttcagggaagttttgacaacttggcggatatacgcaatgctggagtccagtgccctcttctgtgcaaagagttcattgttgatgcttggcaactttactatgcacggtccaagggtgcagatgctgttcttctaattgctgctgtattacctgaccgtgatatcaagtacatgttgaaaatttgcaaaatacttgggatggctgctttagttgaggttcatgatgaaagggaaatggaccgtgttttagggattgatggtgtacagctcatcggcatcaataaccgtaatcttgagacatttgaagttgatatttcaaacaccaaaaaacttctggagggtgaacgaggacagatgatagctcagaagggtataattgttgtaggagaatctggactgttcacccctgatcacatttcgttcgttcaaaatgcaggggtcaaagcggtactcgtcggggaatccctcatcaaacaggaagatccagggaaagcaatcgctgggcttttcggcaaagacatttctaacgccggtgctgcctgaagaagctgaagggccggtcaaaataaacgagaaacacagtgctggccacatcattttgtatagcttggcaaagatgactcggggggcttgtttggatagcatcaacccttccaataagtatggatttgagtgaaaataaacgaattttcatgttagtcccacccaaagtcgcaatatatacagattggagccttggtgggatgtcatgtatccgaagttccaaacaaggctccaagggttttggtaggtggttttgtttatctgacctgatcagagacttttctatactgcagtcttttcgtgaagtaaccttctcgaacaaatgaacacaaagatatattcgaaagagttggatacattagagcaaaac

SEQ ID NO: 1001 - DNA, 1737 bp, Setaria italica
gtgaagttgcagtaggaggagcgcaggcgtacaatgcctaacggctaacgtccaccccaatccaatcagcacccctctctgctcggcggcgcctcaaatggaagcactcgctatcggatccgcgcctccccggccgggcctccctgccccgacctgctactcccacctccgccgccccagaaccttcgccgccagcgcagccgcgcgccgccccctcgtcgcggctcacatggacgccgccgcctccggtggccgcccgagccccgcccctccccgctgcacccgcgccgagacggattcggaggtgggcgaggtcgcgacgacgacgagctcgcacgccgaggcggcggtcgccacggaggaaggggacagcgggagccccgtggaggacgccgccgctgccggggcctccatcgagggcgtcgacgggataaggatccggcggcggcccgtgacggggcccgcggtgcactacgtcggcccgttccagttccgcctcgagaacgaggggaacacgccgcggaacatcctcgagaagatcgtctgggacaaggacgtcgaggtttcgcagatgaaggagaggaggcccctgtacatgttgaaggggccgctggaggctgctccgccggcgagggacttcgttggggcgctcaaggcgtcgtatgatcggactggcttgcctgctctgattgcagaggtcaagaaggcttcaccaagccggggtgttcttagggaggactttgatccggttcaggtcgctcaggcatatgagaaaaacggggcagcatgccttagtgttcttacagataaaaaatactttcagggaagttttgacaacttggcagctatacgcaatgctggagtccagtgccctcttctgtgcaaagagttcattgttgatgcttggcaactttactatgcacggtccaagggtgcagatgctgttcttctaattgctgctgtattacctgaccttgatatcaagtacatgttgaaaatttgcaaaatacttgggatggctgctttagttgaggttcatgatgaaagggaaatggaccgtgttttagggattgatggtgtacagctcataggcatcaataaccgtaatcttgagacatttgaagttgatatttcaaacaccaaaaaacttctggagggtgaacgaggaaagatgatagctcagaaggatataattgttgtaggagaatctggactgttcacccctgatcacatttcgttcgttcaaaatgccgggggcaaagcggttctcgtcggggagtccctcatcaagcaggaagatccaggaaaagcaatcgctgggcttttcggcaaagatatttctaacgctggtgctgcctgaagaagctgaagggccggtcaaaataagcgagaaactcagtgctggtcacatcattttgtatagcttcggaaagatgactccttcggggcttgtttggataacatcaacccttccaataagtatggatttgagtgaaaaataaactaattttcatgttaattcctcccaatatgtatggattggagccttggagggatgtcatgtatccaaagttccaaacaaggcctcggagggttttggtaggtggttttgtttatctgacctgatcagagacttttctatactgcagtctttttgtgaactaaccttctcgaacaaatggatacatgattatagtgcacaaagatatattcgaacgagttggacgtatgagagca

SEQ ID NO: 1002 - DNA, 1579 bp, Hordeum vulgare
ccgcacccgcgccatcacgtccaggcctcccacctccgacccgccgctcccatctccgccgccccaaaaccctagccacctccaagctccctcgccgcgtcaccgccgcgcttcccatggaccgcgccgcacctcttcgctgcactcccgccgagacggatgcggcggcgacgacctcggaccaggccgagacggcagcggcggcggcggccgaagccacggagcagggcaacaacgggggcccagcggggaacgctcccgccgcaagcatcgaggggctcgacgggataaagatccggaggcgcccggtcacgggcccgtccgtgcaccacgtgggccccttccagttccgcctcgagaacgaggggaacacgccgcgcaacatcctcgagaagattgtatggaacaaggacgttgagatttggcagatgaaggagaaaatgcccttgtacaggctgaaaggcccgctggacaatgcgcctccggccagggactttgttgctgcgctgaaagcatcgtacaatcggactgctctgcccgctctgattgcggaggtcaagaaggcttcaccaagccggggggttcttagggagaatttcgacccggtcgagatcgctcaagcatacgagaaaaatggagcagcatgcttaagtgttcttacagattcaaaattctttcagggaagtttcgactacttggaggctatacgcaatgctggagtaaagtgtcctcttctgtgcaaagagttcatcattgatgcttggcagctttactatgcacggtctaagggagcagatgctgttcttctgattgctgccatcttacctgatcgtgatatcagttatatgctgaaaatatgcaaaatactcgggatggcagctttagttgaggtgcatgatgaaagggaaatcgaccgtgttatagggatagatggcattcagcttattggcatcaataatcgtaatcttgaaactttcgaagttgacatctcaaacaccaaaaagcttctggagggtgaacggggacaacttatagcccaaaaggacataattgtcgtaggcgaatctggactgtttacgcctgaccatgtttcgttcgttcaggatgccggggtcaaagcgattcttgtcggggaatccctcatcaagcaggacgatcctgggaaagcaatcgctgggctttttggtaaagacatctcacccgtgagtagtgctgcgtaaatagaagaaagggtaaggatcgtgaattactggatctctcatattttgtatagaaaaaacagagcggtatgcgcttttggagagttttggtcagcagttttgtttacctggccagtatcggcgttctcccctcaccactgtttcctggaagttgtaaccggcctctttattcaaaggatgcaattgaagagagatgatcaaataagttggctttagttgttagcagtttgagtttatttaccttatataagagctgtattcgctgctgtgtttaagtttgtatattgtcgtaacaaaaatgttgaccatgctgacaagtgagagtagggatgcaaatttggaaccttaagggtaccctc

SEQ ID NO: 1003 - DNA, 1617 bp, Panicum virgatum
ccaatccaattagccccacctctgctccgcggcgcctcgaatggaagcactcgctgtaggatccgctcctccccggccgggcctcgctgccccgacccgctacccccacctccgccgcccgagaaccctcgccgccgcgcgctgccgcccactcgccgcggcccccatggaggccgacggaggcggtcgcccgagccccgccccggcccgctgcgccagcgccgagacggagtcggaggtggatgaggccgcgacgagctcgcccgccgcggaggccgcggcggcgggcgccacggagcaagggggcaacgggagccccgtagcctccatcgagggcgtcgacgggataaggatccggcggcggcccgtgacggggccggcggtgcactacgtgggcccgttccagttccgcctcgagaacgaggggaacacgccgcggaacatcctcgagaagatcgtctgggacaaggacgtcgaggtttcgcagatgaaggagaggcggcccctgtacatgctgaagggggcgctggaggctgctcctccggcgagggacttcgttggggcgctcaaggcgtcgtatgatcggactggcttgcctgctctgattgcggaggtcaagaaggcttcaccgagccggggtgttctcagggaggattttgatccggttcagatcgctcaggcatatgagaaaaatggagcagcatgtctaagtgttcttacagatgaaaaatattttcagggaagttttaactacttggaggctatacgcaatgctggagtccagtgccctcttctgtgcaaagagttcatagttgatgcttggcaactttactatgcacggtccaagggtgcagatgctgttcttctaattgctgctgtattacctgaccgtgatatcaactacatgttgaaaatttgcaaaatactagggatggctgctttagttgaggttcatgatgaaagggaaatggaccgtgttttaggaatcaatggtgtacagctcattggcatcaataaccgcaatcttgagacatttgaagttgatatttcaaacacaaaaaaacttctggaaggtgaacgaggacagctgatagctcagaaggatgtaattgttgtaggagaatctggtctgttcactcctgatcacatttcattcgttcaaaacgccggggtcaaagcagttctcgttggggagtctctcatcaagcaggaggatccagggaaagcaatcgctgggcttttcggcaaagatatttcgcacgcggttgcttcctgaagatgcagaagggccggtcgagataattgagaaacgcaatgctggaccgcatcgttttgtatatcttgaggaaagatgactccttcggagggtttttggtggtcttttggtgtacctgacctgatcagacgatttttccattatgcggtctttttgtgacctaaccttccggacagataaatacaagattaaagttcgcaaggtatatttgaatgatctggatgtacgagagcagcttgatattttgtagaattgatctgcattgtggctcgttttgtttggagcatgaaaaattaaacttcatgcagtacagaacgtaaggatttgtagaaattttgatg

SEQ ID NO: 1004 - DNA, 1652 bp, Sorghum bicolor
agcagcgggaaggctcgcaagtgtacgacgcccaacggctaacgtccaccccaatccaattagccagaccacctctgctctgcgctgcgggcgcctcggatggaagcactagctatcggatccgcgcctccccggccgggcctcgctgccctcgcaaggtactcccacctccgccgccccggaaccgtcaccggtactctagtcacagctgcgcgccgccccgtcacggcggcctccatggacgccgccgccggtggccgcccgagccccgcgcctatccgctgcaccagcgcggagacggacgccgaggtggaggtggatgaggtcgcgacgagctcgcacgccgcgggggccaccacggacacggagcaagggggcaacgggagccccgtggcgggtgccgcggactccgccgaggtcgtcccgggcgtcgacgggataaggatccggcggcggcccgtcacggggcccgcggtgcactacgtgggcccgttccagttccgcctcgagaacgaggggaacacgccgcggaacatcctcgagaagatcatctgggacaaggatgtagaggtttcgcagatgaaggagaggaggcccctgtacatgctgaagggcccgcttgaggctgctccccccgctagggactttgttggggcgctcaaggcgtcctatgatcgaactggcttgcctgctctgatcgcggaggtcaagaaggcttcaccaagccggggtgttatcagggagaattttgatccggttcagatcgctcaggcatacgagaaaaacggagcagcatgccttagtgttcttacagacgaaaaatactttcagggaagttttaacaacttggaggctattcgcaatgctggagtccagtgccctcttctgtgcaaagagttcattgttgatgcttggcaactttactatgcacggtccaagggtgcagacgctgttcttctaattgctgctgtattacctgaccgcgatatcaaatatatgttgaaaatttgcaagatacttgggatggctgctttagttgaggtccatgatgaaatggaaatggaccgtgttttagggattgatggtgtacagctcatcggcatcaataaccgtaatcttgagacatttgaagttgatattacaaacacaaaaaagcttctggagggtgaacgaggacaaattatagctcaaaaggatgtaattgttgtaggagaatctgggctgttcactcctgatgatatttcgtttgttcaaaatgctggggtcaaagcggttctcgtcggggaatccctcatcaagcaggaggatccagggaaagcaatcgctgggcttttcggcaaagatatctcgcacgctggtgctacctaaagagcaaaggcgcagaagagcaaccagaataagcgagaaacgcaactccaggttgcatcattttgtgtaggggagaaaatggagcggtgcaaatcagaaatccaccacccttccgcagagttttgatcggtcgttttgtttacctgaccagcaacttccccatgctgctgtttctttgtgaccgaaccatctcaaaataaatacagattttagtgcacaagatatgttcaatgagttgaatgtaaattgcaagcagcttgatttttgcctatttaggcttgatc

SEQ ID NO: 1005 - DNA, 1632 bp, Sorghum bicolor
gcagcgggaaggctcgcaagtgtacgacgcccaacggctaacgtccaccccaatccaattagccagaccacctctgctctgcgctgcgggcgcctcggatggaagcactagctatcggatccgcgcctccccggccgggcctcgctgccctcgcaaggtactcccacctccgccgccccggaaccgtcaccggtactctagtcacagctgcgcgccgccccgtcacggcggcctccatggacgccgccgccggtggccgcccgagccccgcgcctatccgctgcaccagcgcggagacggacgccgaggtggaggtggatgaggtcgcgacgagctcgcacgccgcgggggccaccacggacacggagcaagggggcaacgggagccccgtggcgggtgccgcggactccgccgaggtcgtcccgggcgtcgacgggataaggatccggcggcggcccgtcacggggcccgcggtgcactacgtgggcccgttccagttccgcctcgagaacgaggggaacacgccgcggaacatcctcgagaagatcatctgggacaaggatgtagaggtttcgcagatgaaggagaggaggcccctgtacatgctgaagggcccgcttgaggctgctccccccgctagggactttgttggggcgctcaaggcgtcctatgatcgaactggcttgcctgctctgatcgcggaggtcaagaaggcttcaccaagccggggtgttatcagggagaattttgatccggttcagatcgctcaggcatacgagaaaaacggagcagcatgccttagtgttcttacagacgaaaaatactttcagggaagttttaacaacttggaggctattcgcaatgctggagtccagtgccctcttctgtgcaaagagttcattgttgatgcttggcaactttactatgcacggtccaagggtgcagacgctgttcttctaattgctgctgtattacctgaccgcgatatcaaatatatgttgaaaatttgcaagatacttgggatggctgctttagttgaggtccatgatgaaatggaaatggaccgtgttttagggattgatggtgtacagctcatcggcatcaataaccgtaatcttgagacatttgaagttgatattacaaacacaaaaaagcttctggagggtgaacgaggacaaattatagctcaaaaggatgtaattgttgtaggagaatctgggctgttcactcctgatgatatttcgtttgttcaaaatgctggggtcaaagcggttctcgtcggggaatccctcatcaagcaggaggatccagggaaagcaatcgctgggcttttcggcaaagatatctcgcacgctggtgctacctaaagagcaaaggcgcagaagagcaaccagaataagcgagaaacgcaactccaggttgcatcattttgtgtaggggagaaaatggagcggtgcaaatcagaaatccaccacccttccgcagagttttgatcggtcgttttgtttacctgaccagcaacttccccatgctgctgtttctttgtgaccgaaccatctcaaaataaatacagattttagtgcacaagatatgttcaatgagttgaatgtaaattgcaagcagcttgatttt

SEQ ID NO: 1006 - DNA, 1712 bp, Zea mays
cgccgctactgctagcgctagacaggtggttcagagacgccgtctcggtaaagcagcgggaagactcgcacgcgtacaactcccaacggctaacgtccaccccaatccaattagccagcccacctctgctctgcgggcgcttcagatggaagcactagccattggatccgcgcctcgccgtccgggcgcaaggtactcccaactccgccgccccggaaccctcgccgtcaccaccacagccacagttgcatgccgccccctcacggcgccctccatggacgccgccgttggccgcccgagccgcgcgcctatccgctgcaccagcgcggagacggactcggtggatgaggtcgcgacgagctcgcacgccgcggaggccaacgcggggggcaccacggagcaagagggcaacgggagccccgtggccgccgctgccgcgtactcccccgtggtcgccggcgtcgacgggataaggatccggcggcggcccgtgacggggcccgcggtgcactacgtgggcccgttccagttccgcctcgagaacgaggggaacacgccgcggaacatcctcgagaaaatcatctggaacaaggacgtcgaggtttcgcagatgaaggagaggaggcccctgtacatgctgaagggtccgcttgaggctgctccccccgctagggacttcgttggggcgctcaaggcgtcctacgatcgaactggcttgcctgctctgattgcggaggtcaagaaggcttcaccaagccggggtgttatcagggagaattttgatccggttcagatcgctcaggcatatgagaaaaacggagcagcatgccttagtgttcttacagatgaaaagtactttcagggaagtttttacaacttggaggctatacgcaatgctggagtccagtgccctcttctgtgcaaagagttcattattgatgcttggcaactttactatgcacggtccaagggtgcagatgctgttcttctaatagctgctgtattacctgaccgcgatatcaaatacatgttgaaaatttgcaaaatacttgggatggctgctttagttgaggttcatgacgaaagagaaatggaccgtgttttagggattgatggtgtacagctcatcggcatcaataaccgtaatctcgagacatttgaagttgatattacaaacacaaaaaagcttctggaaggtgaacgaggacaggttatagctcaaaaggatgtaattgttgtaggagaatctgcgctgttcactcctgatgatatctcgttcgttcaaaacgctggggtcaaagcggttctcgtcggggaatccctcatcaagcaggaggatccagggaaagcaatcgctgggcttttcggcaaagatatctcgcatgctggtgctacctagagacgacgcagaagagcaacagaataccagaaacgctactccgggttgcatcattttgtgtaggggagaaaatcgagcgttgcaatcagaaatccaccctttcgcagagttttgatcggtcgttttgtttacctgacctgccaacttccccatgctgctatttttttgtgaccgagccatctcaataattacagattttagtgcacaagatgtatatgttcaaaaagttggatgtagtttcaagcagcttgatttttgcctatctaggcttcatctgcactattttttctaatataaaactagtaagaaaaaa

SEQ ID NO: 1007 - DNA, 1658 bp, Oryza sativa
gcctaaacaacggctaacgtccaccccaatccacgcgacgctatacctcgcggttctcccacttctccttcctcctccataaaccgcgaaagaaaatggaagctctcgctatcggatccgcacctccccgcccgccgggcctcgcactcccacccctcacccgtcaccaccacctcctcctccaccgctccaaaaccctagcccctcgccgtttcgtcgccgccgcgcccatggacgccgccgccgccgccgccggccggggcggccccgcccctccccgctgcgcccgcgccgagacggattcggaggatgcggtcgcgacgacaagctcgccgcactccgccgaggccgcgggcgcggcggagcaggggaacggggccccggccccggtggcggatgccgccgacgtcgagggggttgacgggataaggatccggaggcgccccgtgaccgggccgccggtgcactacgtggggccgttccagttccgcctcgagaacgaggggaacacgccgcggaacatcctcgagaggatcgtgtgggacaaggaagccgaggtttcacagatgaaggagagaaggccactgtacatgctgaaggggccgctggagaatgctcctccggtgagggatttcgttggggtgttgaaggcgtcttttgatcggactggtctgcctgctctgattgcagaggtcaagaaggcttcaccgagccgcggtgtcctgagggaggacttcgagccggttcagatcgcccaaacatatgagaaaaatggagcagcatgcttaagtgttctcacagatgcaaaatactttcagggaagttttgactatttggatgctatacgcaatgctggagtacagtgtcctctgctgtgcaaagagttcattgttgatgcctggcaactttactatgcgcgtttgaagggagcagatgctgttcttctgattgctgctgtcttacctgatcttgatatcaagtatatgttgaaaatatgcaaaatacttggcatggctgctttagttgaggtgcatgatgaaagggaaatggaccgtgtgttagggatagatggtgtccagctcatcggcatcaataaccgtaacctcgagacttttcaagttgatatttcaaacactaaaaatcttcttgagggtgaaagaggacaaactatagctcagaaaggcataattgttgtaggggaatcagggctgttcacaccagaccatatttcattcgttcagaatgctggggttaaagctgttctcgttggggagtctctcatcaagcaggaggatcctggcaaagcaatcgctgggcttttcggcaaagacatctcacctgtgagtgctgcgtaaagtctaaagacaaacagagtggcagagaggctgagaaatgatggagcacatcatcatattgtacagggagagatggagcaattagcttttctggagagtttttggtcagccattttttgtttactaaactcgatcagttcttcccatatactcttgtgaccaaaccttttcgaccaatacaaatggttcactgcaaagaaatatatgatcgaataagttggatttaattgcaaggagtacgagttcatatttcctttggaatatggaacatcaaaatctgacacacgatttcttaaggctcat

SEQ ID NO: 1008 - DNA, 1502 bp, Oryza sativa
ataaaccgcgaaagaaaatggaagctctcgctatcggatccgcacctccccgcccgccgggcctcgcactcccacccctcacccgtcaccaccacctcctcctccaccgctccaaaaccctagcccctcgccgtttcgtcgccgccgcgcccatggacgccgccgccgccgccgccggccggggcggccccgcccctccccgctgcgcccgcgccgagacggattcggaggatgcggtcgcgacgacaagctcgccgcactccgccgaggccgcgggcgcggcggagcaggggaacggggccccggccccggtggcggatgccgccgacgtcgagggggttgacgggataaggatccggaggcgccccgtgaccgggccgccggtgcactacgtggggccgttccagttccgcctcgagaacgaggggaacacgccgcggaacatcctcgagaggatcgtgtgggacaaggaagccgaggtttcacagatgaaggagagaaggccactgtacatgctgaaggggccgctggagaatgctcctccggtgagggatttcgttggggtgttgaaggcgtcttttgatcggactggtctgcctgctctgattgcagaggtcaagaaggcttcaccgagccgcggtgtcctgagggaggacttcgagccggttcagatcgcccaaacatatgagaaaaatggagcagcatgcttaagtgttctcacagatgcaaaatactttcagggaagttttgactatttggatgctatacgcaatgctggagtacagtgtcctctgctgtgcaaagagttcattgttgatgcctggcaactttactatgcgcgtttgaagggagcagatgctgttcttctgattgctgctgtcttacctgatcttgatatcaagtatatgttgaaaatatgcaaaatacttggcatggctgctttagttgaggtgcatgatgaaagggaaatggaccgtgtgttagggatagatggtgtccagctcatcggcatcaataaccgtaacctcgagacttttcaagttgatatttcaaacactaaaaatcttcttgagggtgaaagaggacaaactatagctcagaaaggcataattgttgtaggggaatcagggctgttcacaccagaccatatttcattcgttcagaatgctggggttaaagctgttctcgttggggagtctctcatcaagcaggaggatcctggcaaagcaatcgctgggcttttcggcaaagacatctcacctgtgagtgctgcgtaaagtctaaagacaaacagagtggcagagaggctgagaaatgatggagcacatcatcatattgtacagggagagatggagcaattagcttttctggagagtttttggtcagccattttttgtttactaaactcgatcagttcttcccatatactcttgtgaccaaaccttttcgaccaatacaaatggttcactgcaaagaaatatatgatcgaataagttggattt

SEQ ID NO: 1009 - DNA, 2254 bp, Secale cereale
tgtggggggagctctcgcgggccgtgcttcgcccgggggtgcccttcgccgtccaccggatgctctactacggctgctacgtcgggtccccgtccaccacgccgcccgcctggacgcccgactccgaggaggcggccctgaccaatgttggccgcgtcctggaggcgcgcgggagtgagatcatcggccaagcgtacaaggacccagtcaccagcttccgggacttccacaagttctccaacgagaacccagaggcatattggaagatggtctttgaggagatgggcatcacattcagcgtcgagccatcttgcatcttgcgtgatagtgatgcctaccccggtggcgagtggttgccaggggctgtgctgaatgctgctgcgaattgcctgactgctaaacccggaaggacttccagtgacgttgccattgtgtggagggatgaggggaaggattccgaggccctcaactttgtgactgtggaggaattgaggaaaaaagtttgcctcgtggcaaatgcgctcgatgcacttaatctggcagagggatctgctattgcaattgacatgcctatgaatgtgaatgccgttgttatctacctcgcgatcgtgttagcgggatacattgttgtctcgattgcagacagctttgctgcacctgcaatatcgacgaggctaaagatatcagaggcaaaagcaattttcacccaggattgcatccttcgtgatgacaaggagctgccattgtatagtagagttgtggaggccaaagcccctatggctatcgtgatccctgcaaggggatccacaccgataaaaggactccgtaccgatgacctttcatgggaagattttcttggaagggctgatcgtaccaaggctggtatttataccgcagtcgagcaacctgcctaccagttcagtaatatcctattttcatcagggaccacaggtgagccaaaggcgattccttggacgcatttgacccctcttaaggcagctgctgatggatggtgtcacatggatattcgtaaaggtgatgttgttgcgtggcctacaaaccttggttggatgatgggtccctggcttgtctatgcctcgctattgaatggagcatccatggcgctgtataatggctccccgaatagttcaggttttgcgaagtttgtacaggatgctaaggtgacaatgcttggagtggtacccagcattgttcgtacatggaaaaatacggattgtaccgcaggatttgattggtcaaacatcagatgctttagctcaactggggaggcatcaagtgtggatgattatttgtggctgatgggaagagcttgctacaaaccagtaatcgagtattgtggtggcacagaaattggtggtggatttattactggatccctgttgcaacctcaagcactgtcagcattcagtacacctgccatgggttgtaacctgtttattcttgacagcaatgggaatcccttgccacatgattctgctggtattggagaacttgcgctcgatccaacattatttgggtcatcaacgacactgctaaatgctgatcatcatgaggtgtacttcagtggaatgccagaatggaatgcgaaagtcctccggaggcatggcgatgaatttgaacgtaccgcagatggatattacagggctcatgggcgtgcagatgatacaatgaaccttggtggcattaaggtcagttccatcgagattgagaggatctgcaacagggttaatgatgccattcttgaaacagcagctattggggttccaccagtaggaggcggccccgaacagttgaccatagccgtcgtattcaaagatcaaagtccacaagcagaagatttgaaccaactgaaactaatgttcaactctgctctgaagaaattaaatcctcttttcaaggtttcgtcggtggttgtggtgtcatcgctccctcgaaccgcctcaaacaaggtcatgaggagagtcctacgcaaggagttcacccaggcaaagcactctaaaatctagtagacgttaggaagtgtatcctgcgcctactaaaatttcagggaattgcacaccaaacttgtgaatacatacgtgccggctcaagtcttcagaaattcaggtgtattatcacacatccattgtacagcgaggctaattcacattgatctggcattgcagataaggtactaataaagcatgattgctatcatgtgctgttttgtttttcataataaagaaaatatcat

SEQ ID NO: 1010 - DNA, 2580 bp, Oryza sativa
atcgtcatcgccatcgccatcgccatcgccaattcgccatctcatcctctttctctctctctcgcccagtttggtgcacctgtccgcgacgcatctgccgcagcttcgcagcagcagcagcatcatgggccacgccgccgcagccgccgcggcggcgcacgtgccgctgggcgcgatcaccgtcgacgacctcctcgccgcgggggtggcgggtggtgcggcggcggagctgcacgaggcggtccggcgcgcggtgggcgcgcgcggcggggacggggatgcggcggcggtgtggggggagctctgcagggccgcgctccgcccgggcgtgccgttcgcggtgcaccggatgctctactacggatgcttcgccgggttcccctccgccacgccgccggcctggacccccgacccggaggaggccgtattgaccaatgtcggccgcgtcctcgaggcgcgagggagggagttcctcggcgacaagtacaaggatccaatcgctagcttcaccgacttccacaagttctccattgagaatccagagggcaggcgtactggaagatggtgtttgaggagatggggattactttcagtgtggagccatcttgcatcctgagggagaacgatgcttaccccggcggcgagtggttgcccggcgccgtgctgaatgctgctgcgaattgcctgaccgcgaagcccggaaggagttccgacgacgttgctatcgtgtggagggatgaggggaaggattctgagcccctcaactttgttactcttgaggaactgaggaaaaaagtttgcctggtggcaaatgcgcttgatgcactcaacctggctaagggatccgcgattgccattgacatgcccatgaatgtgaatgctgttgtgatctacctggcaattgtgttggcaggctatgtggttgtctcaatcgcggacagctttgctgctcccgcaatatcaatgaggctaaagatatcagaagcaaaagcaattttcacccaggattacatccttcgagatgacaaggaattgcctttgtacagtagagttgtggaagctaaggcccctatgacaattgtgatccctgtaaggggatcaacaccaataaaaggactgcgtgctgatgatctgtcctgggaagattttcttgcaaaagttaaccatgccaaggctgataattataccgctgttgagcaacctgcctatgccttcaccaatatcttgttttcgtcagggactacaggggagccaaaagcaattccatggacacacttaacacctctgaagtcagctgctgatggatggtgtcacatggatattcgcagaggtgatgttgttgcatggcctactaacctcggttggatgatgggcccatggcttgtttatgcctctttactgaatggagcttccatggctctttataatggctccctgaatagttcaggctttgcaaagtttgtacaggatgcaaaggtgactatgcttgggttggtacccagcattgctcgttcatggaaaagtacagattgtacagctgggtttgattggtcaaccattagatgttttagctcatccggggaggcatccagtgtggatgattatttatggttgatgggaagagtttgctacaaaccagttatagagtactgtggaggcacagaaattggtggtggatttgttgctggatcattgctgcaacctcaagcattatctgcattcagtacacctgcaatgggttgtaacctgtttattcttgacaacaatggaaatccattaccacaagattctgttggtactggagaacttgcgcttgatccaaccttcctgggagcttcaacaacattgctgaatgctgatcatcatgaggtgtacttcagtggaatgccagaatggaacgggaaagtccttcggaggcatggggatgaatttgagcgtactccagatgggtattatagggctcatgggcgcgcagatgacacaatgaaccttggtggaattaaggtgagttccatcgagatagagcggatctgcaacagggtaaacgacgccatccttgaaacagcagctattggggttccacctctagggggtggccctgaacagctgaccatagccgtcgtcttcaaagaccaaagctcacaaacagaggatttgaatcagctgaaactggcattcaacactgctctgaagaaacttaaccctcttttcaaggtttcttcagttgtggtagtcccttcgctccctagaacagcctcaaacaaggtcatgaggagagtcctccgcaaggagttcacccagcagccaaagcactccaaaatctaggtagttacaaaaaagcaaaattggttctattgcatcatacgtacacccaaaaggaaaaaacttcggcacagcaaactgtgaatacacatgtctggttaaaaatcactaaatcagttgtatagcaaggcttttgttctctccggtgtgaaatgagatgatagatcaggtcatgatgaggtactgaaagtgttattgctacattttcctgtcatatgtttttcgctatgtgaataaagtctttgtgggacttcagtg

SEQ ID NO: 1011 - DNA, 2612 bp, Setaria italica
tctccccctctctgtcccaatcggtgttactttaggttgctcgcaagtttggtacaccggtccgagaattctccccttcttcgtcttctttatttgccgtaaagaacttgtgccctgctgcatctacaactgcaacctatctgctgagcagcagaagcagtagcggctatagcagagggacgtcatggccgccgcgtcgcacaagcccctgggcgcgatcaccgccgacgacctggccgccgcggcgcccggggtggacgccgccgcgctccacgcggccctccggcgcgcgctcgactcccgcgccggcgccggggaccccgccgccgtgtggggggagctctgtaggtcccttctccgcccggacgtccccttcgccgtccaccggatgctctactacggctgcttcgccgggttcccgtcccccacgccgcccgcctggacccccgaccccaaggaggcggccttgaccaatgtcggccgcgtcatggaggtgcgggggagggagctcctcggcgacgcgtacaaggatcccatcaccagcttccctgacctctacaagttctccaatgagaacccagaggcgtactggaggatggtctttgaggatatgggtgttgagttcagtgtggaaccgtcttgcatctggagagagagcgatgcatatcccggtggagagtggctaccgggcgctgagctgaatgccgccgcgaattgcctgaatgctaaacctgggagaagttcccaggatgttgccattgtttggagggatgaagggaaggattcagaacctctcaacttcatgacccttgaggagttgaggaaaaaagtttgccttgtggcaaatgcacttgatgccctggacctgccaaagggctctgcaattgctatcgacatgcctatgaatgtgaatgctgttgtgatctacctagcgattgttttagcaggctatgtggttgtctcaattgcagacagctttgctgcacctgcaatatcgacaaggttaaagatatcagaagcaaaagcaattttcacacaggattacatccttcgtgatgacaaggaactgccgttgtacagtagagttgtggaggccaaggctcctatggcgattgtgatccctgtaagaggatctttgccaataaagggactgcgtgttagtgacctatcctggcaggatttccttggaagggttaatgataccaaggtggaaaattatgctgctgttaagcaacctgcctacgcatttaccaatatcctattttcgtcagggaccacaggggagcccaaggcaattccatggacacatataacccccctaaaggcagctgctgatggttggtgtcacatggatattcgtaaaggagatgttgttgtgtggccaactaatcttggttggatgatgggtccctggcttgtatatgcctccttactgaatggagcttccatggctctgtataacggctccccaaatagttcaggctttgcaaagtttgtacaggatgctaaggtaacaatgcttggactggttcccagcatcgcccgtacatggaaaaatacagattgtacagctggatttgactggtccgccatccgatgctttagctcatctggggaggcgtccagtgtggatgactatttatggttgatgggaagagcttgctacaagccagtaattgaatattgtggaggcacagagattggaggtggatttgttgctggatctttgctgcaacctcaagcgttgtctgcattcagcacacctgccatgggctgtaacttgtttattcttgatggcagcgggaatcccttgccacaggattcggtgggtattggtgaacttgcacttgatccagttttatttggatcatcaacaacactactaaacgctgatcatcaggaagtttattttaacgggatgccggaatggaacgggaaagtcctccgcagacatggagatgaatttgagcgtacttgtgatggatattatagggctcatgggcgcgctgatgacacaatgaaccttggtggcattaaggttagttccatcgagattgagaggatctgcaacagagtgaatgatgccatccttgaaacagctgctattggggttccgcctatcggtggtggccctgaacaactaaccatagccgtcgtcttgaaagaccagagctcacaagtagaggacttgaaccagctgaaactagcattcaatgtggctctgaagaagctgaaccctctcttcaaggtttcttctgtagtcgtggttccatcgctcccaagaacagcctcgaacaaggtcatgaggagagtcctgcgcaaggagttcacccaagcagcacaggcgaaaaagtcaaaaatctagatagaattttacttcctgcaaatgtacctcaaaaaaagagctatacagcaaactgtgcatatcaatatacataggccctccaacatccagttgtttatttacctccaaaaagaggtatgaggtgtattcatatttcgggaaaataaatgagctgtatttcctgggatttgttcacttgatgtgaacccacagatgaggtactaataaaacattcatggtatcgtttgcccttgcatgaattttctct

SEQ ID NO: 1012 - DNA, 2770 bp, Oryza sativa
gccaaacgtgcgctgcatataaaattcgccggaattccatctacccgcacaaaatattcgcgagatatttttgtttatcccatccgaactgctcattgatccgaccaaggcgacaagcacgacgtcgccatcgtcatcgccatcgccatcgccatcgccaattcgccatctcatcctctttctctctctctcgcccagtttggtgcacctgtccgcgacgcatctgccgcagcttcgcagcagcagcagcatcatgggccacgccgccgcagccgccgcggcggcgcacgtgccgctgggcgcgatcaccgtcgacgacctcctcgccgcgggggtggcgggtggtgcggcggcggagctgcacgaggcggtccggcgcgcggtgggcgcgcgcggcggggacggggatgcggcggcggtgtggggggagctctgcagggccgcgctccgcccgggcgtgccgttcgcggtgcaccggatgctctactacggatgcttcgccgggttcccctccgccacgccgccggcctggacccccgacccggaggaggccgtattgaccaatgtcggccgcgtcctcgaggcgcgagggagggagttcctcggcgacaagtacaaggatccaatcgctagcttcaccgacttccacaagttctccattgagaatccagaggcgtactggaagatggtgtttgaggagatggggattactttcagtgtggagccatcttgcatcctgagggagaacgatgcttaccccggcggcgagtggttgcccggcgccgtgctgaatgctgctgcgaattgcctgaccgcgaagcccggaaggagttccgacgacgttgctatcgtgtggagggatgaggggaaggattctgagcccctcaactttgttactcttgaggaactgaggaaaaaagtttgcctggtggcaaatgcgcttgatgcactcaacctggctaagggatccgcgattgccattgacatgcccatgaatgtgaatgctgttgtgatctacctggcaattgtgttggcaggctatgtggttgtctcaatcgcggacagctttgctgctcccgcaatatcaatgaggctaaagatatcagaagcaaaagcaattttcacccaggattacatccttcgagatgacaaggaattgcctttgtacagtagagttgtggaagctaaggcccctatgacaattgtgatccctgtaaggggatcaacaccaataaaaggactgcgtgctgatgatctgtcctgggaagattttcttgcaaaagttaaccatgccaaggctgataattataccgctgttgagcaacctgcctatgccttcaccaatatcttgttttcgtcagggactacaggggagccaaaagcaattccatggacacacttaacacctctgaagtcagctgctgatggatggtgtcacatggatattcgcagaggtgatgttgttgcatggcctactaacctcggttggatgatgggcccatggcttgtttatgcctctttactgaatggagcttccatggctctttataatggctccctgaatagttcaggctttgcaaagtttgtacaggatgcaaaggtgactatgcttgggttggtacccagcattgctcgttcatggaaaagtacagattgtacagctgggtttgattggtcaaccattagatgttttagctcatccggggaggcatccagtgtggatgattatttatggttgatgggaagagtttgctacaaaccagttatagagtactgtggaggcacagaaattggtggtggatttgttgctggatcattgctgcaacctcaagcattatctgcattcagtacacctgcaatgggttgtaacctgtttattcttgacaacaatggaaatccattaccacaagattctgttggtactggagaacttgcgcttgatccaaccttcctgggagcttcaacaacattgctgaatgctgatcatcatgaggtgtacttcagtggaatgccagaatggaacgggaaagtccttcggaggcatggggatgaatttgagcgtactccagatgggtattatagggctcatgggcgcgcagatgacacaatgaaccttggtggaattaaggtgagttccatcgagatagagcggatctgcaacagggtaaacgacgccatccttgaaacagcagctattggggttccacctctagggggtggccctgaacagctgaccatagccgtcgtcttcaaagaccaaagctcacaaacagaggatttgaatcagctgaaactggcattcaacactgctctgaagaaacttaaccctcttttcaaggtttcttcagttgtggtagtcccttcgctccctagaacagcctcaaacaaggtcatgaggagagtcctccgcaaggagttcacccagcagccaaagcactccaaaatctaggtagttacaaaaaagcaaaattggttctattgcatcatacgtacacccaaaaggaaaaaacttcggcacagcaaactgtgaatacacatgtctggttaaaaatcactaaatcagttgtatagcaaggcttttgttctctccggtgtgaaatgagatgatagatcaggtcatgatgaggtactgaaagtgttattgctacattttcctgtcatatgtttttcgctatgtgaataaagtctttgtgggacttcagtgaaattcaggtggcctatagtgtattccagtgaaattcctaagctctattccctccgtcccataaaa

SEQ ID NO: 1013 - DNA, 2625 bp, Sorghum bicolor
catctctatctgagctttccctccgtctcaatcgtgagccgatcgctgtgaggttgctccccagcagcagctgtagctgtagcagcggcacggcatggccgccgagttgcacaagcccctgggcgcgatcaccgccgacgacctcgcggcggcggcgcctgggtgcgacgccaccgcgctccactcggcgctccggcgcgcgctcgactcgcacggccccgccgcggtgtgggcggagctctgccggtccgtgctccgtccgtccgtccccttcgccgtccaccggatgctctactacggctgcttcgccgggttcccgtcccccacgccgccggcctggacccccgaccccaaggaggctgccttgaccaatgtcggccgtgtcctggaggcgcgcgggagggacttcatcggcgacgcgtacaaggatcccatcaccagcttcccagacctccacaagttctccaacgagaacccagagacgtactggaagatggtatttgaggagatgggtgtccaattcagtgtagagccatcctgcatctggagagagaacgctgcgtatcccggtggtgagtggctaccgggcgccgagctgaatgctgctgcgaattgcttgaccgctaaacctgggaggagctctgacagtccagccattgtatggagagatgaggggaaggattctgagcctcttaactttatgtctctggaggaattgaggaagaaagtttgcctcgtggcgaatgcactcgatgccctggaactgccaaagggatctgcaattgctattgacatgcctatggatgtcaatgctgttgtgatctaccttgctatcgtattggcaggatatgtggttgtctcaattgcagacagttttgctgcacctgcgatatcgatgaggttaaagatatcagaagcaaaggcaatttttactcaggattacatccttcgtgatgacaaagaactgccattgtacagtagagttgtggaggttaaggcccctatggcaattgtgattcctgtaagggggtctttgccaataaagggactacgtgttgatgacctttcctggcaagacttccttggaagagttaataataccgaggcggaaaattacattgctgttaagcaaccggccgacgcgttcacaaatatcctattttcatcagggaccacaggggagcccaaggcaattccatggacacatataacacccctaaaggcagctgctgatggatggtgccacatggatattcgtaaaggagatgttgttgcatggccaactaatcttggttggatgatgggcccttggcttgtttatgcctctttactgaatggagcttccatggctctgtataatggctccccaaatagttcaggctttgcaaagtttgtacaggatgctaaggtgacaatgcttggactggtacccagcatcgctcgtacatggaagaatacagactgtacagctggactagactggtcctccatccgatgctttagctcatctggggaggcatccagtgtggatgattatttatggctgatgggaagagctggctacaagccagtaatcgagtactgtggaggcacagagattggtggtggatttgttactggatccttgctgcaacctcaagcgttgtctgcattcagcacacctgccatgggttgtaacctgttcattcttgatagcaacgggaatcctttgccacaagactctgtgggtatcggtgaacttgcacttgatccaactttatttggatcatcaacaacacttctaaatgctgatcatcaggaggtttatttcaacggaatgccagaatggcacgggaaaatcctccgcaggcatggagatgaatttgagcgtacttctgacgggtattacagggctcatgggcgtgcagatgatacaatgaacctcggtggaattaaggttagttccattgagattgagaggatctgcaacagagtacatgatgccatcgttgaaacagcagctatcggggttccacctgtagggggtggccccgaacaactaaccatagccgtcgtgttgaaagaccagagctcacaattagaggactggaaccaactgaaactagcgttcaacgttgctctgaagaaactgaaccctctcttcaaggtatcctcggtcgtcgtggtcccgtctctccctagaaccgcctctaacaaggtcatgaggagggtcctgcgcaaggagttcagccaggcagcccaggcaaagcattcgaaaatatagatagttagaaataattaatgcttctgctgcaaatgcacctgcagaaaagagttaaacagcaaactgtgcatatcgtcactcataggcccttcaaaatcctgttgtctacctcgatccaaagaggagaaatgagatgtacttatagatttcgggaaacaaacgagctgtatttcctgccaacgtgcagcactcacatgatgtgagctcacatatgaggaggcactaataaaacatgaatgcaatcacttacgtatgcattctccaatgcaggccattatcgagaatcaaggctttaggatggtgtgccttgcaggcccggacgcccggtcctgttttggtggcacatggcctaaagaggtcct

SEQ ID NO: 1014 - DNA, 2416 bp, Panicum virgatum
gtcgcacaagcccctgggcgcgatcaccgccggcgacctggccgccgcggcgcccgggacggacgccgccgcgctccacgcggccctccggcgcgcgctcggcgccggcgacgcggaccccgccgccgtgtggggggagctctgccggtccctgctccgcccggacgcccccttcgccatccaccggatgctttactacggctgcttcgccgggctcccgtcccccacgccgcccgcctggacccccgaccccgaggaggcggccttgaccaatgtcggccgcgtcatggaggcgcgggggagggagctcctcggagacgcgtaccaggatcccatcaccagcttcactgacctctacaagttctccaacgagaacccagaggcgtactggaagatggtctttgaggatatgggtgttgagttcagtgtggagccgtcttgcatctggagagagagccatgcgtatcctggtggcgagtggttaccgggcgcagagctgaatgctgccgccaattgcctgacggctaaacctgggagaagctccgaggatgttgccattgtgtggagggatgaaggaaaggattcagaacctctcaacttcatgactcttgaggagctgaggaaaaaagtttgccatgtggcaaatgcacttgatgcactggacctgccaaagggatccgcaattgctatcgacatgcctatgaacgtgaatgctgtcgtgatctaccttgcgattgttttagcaggctatgtggttgtctcaattgcagacagcttttctgcaccggcaatatcaacaaggttgaagatatcagaagcaaaagcaattttcactcaggattacatccttcgtgatgacaaggaactgccattgtacagtagagttgtggaggctaaggcccctatggcagttgtgatctctgcaaggggatcattgccaataaagggactgcgtcttaacgacctatcctggcaggatttccttggaagggttaatgataccaaggtggaaagttatgctgctgttaatcaacctgcctacgctttcaccaatatcctattttcgtcagggaccacaggggagcccaaggcaattccatggacacatatgacccccctaaaggcagctgctgatggatggtgtcacatggatattcgtaaaggagatgttgttgcgtggccaacaaatcttggttggatgatgggcccctggcttgtatatgcctccttactcaatggagcttccatggctctgtataacggctccccaaatagttcaggttttgcaaagtttgtacaggattctaaggtgacaatgcttggactggtacccagcatcgctcgtacatggaaaaatactgattgtacagctggatttgactggtcctccatccggtgctttagctcatctggggaggcgtccagtgtggatgactatttatggctgatgggaagagcttgctacaagccagttattgagtattgtggaggcacagagattggtggtggatttgttactggatctttgctgcaacctcaagcattgtctgcattcagcacacctgccatgggttgcaacttgttcattcttgacagcagcgggaatcccttgccacaagattcagtgggtattggtgaacttgcgcttgatccgattttatttggatcatcaacaactctgctaaacgctgatcatcaggaagtttatttcaacggaatgccagaatggaatgggaaagtcctccgcagacatggagatgaatttgagcgtacttgtgatggatattatagggctcatgggcgcgcagatgacacaatgaatcttggtggcattaaggttagttccatcgagattgagaggatctgcaacagagcaaacgacgccatcctcgaaacagcagctattggggttccgccaataggtggtggccctgaacagctaacgatagccgtcgttttcaaagaccagagcacacaagtagaggacttgaaccagctgaaactagcgttcaacacggctctgaagaagctgaaccccctcttcaaggtctcttctgttgccgtggttccatcgctccctagaaccgcctcgaacaaggtcatgaggagagtcctgcgcaaggagttcacccaagcagcacaggcgaaaatatcaaaaatctagatacttagaaatatatttcttccctgcaaatgtaccccaccaagaaagagctatacaacaaagtgtgcatatcattatacataggcccttcagaatcaagttgtttacctctagaaaggaggtatgagttgtatctatatttcggaaaaataaatgagctgtatttcctgccaaaggatttcttcacttcgtgccaactctcacacatgaggtgctaataaaacattcatgatatcattttttctgaatacg

SEQ ID NO: 1015 - DNA, 2755 bp, Sorghum bicolor
tatacccccaactatactggtatatagttgcctttagttggtgtaggagtacatctctatctgagctttccctccgtctcaatcgtgagccgatcgctgtgaggttgctccccagcagcagctgtagctgtagcagcggcacggcatggccgccgagttgcacaagcccctgggcgcgatcaccgccgacgacctcgcggcggcggcgcctgggtgcgacgccaccgcgctccactcggcgctccggcgcgcgctcgactcgcacggccccgccgcggtgtgggcggagctctgccggtccgtgctccgtccgtccgtccccttcgccgtccaccggatgctctactacggctgcttcgccgggttcccgtcccccacgccgccggcctggacccccgaccccaaggaggctgccttgaccaatgtcggccgtgtcctggaggcgcgcgggagggacttcatcggcgacgcgtacaaggatcccatcaccagcttcccagacctccacaagttctccaacgagaacccagagacgtactggaagatggtatttgaggagatgggtgtccaattcagtgtagagccatcctgcatctggagagagaacgctgcgtatcccggtggtgagtggctaccgggcgccgagctgaatgctgctgcgaattgcttgaccgctaaacctgggaggagctctgacagtccagccattgtatggagagatgaggggaaggattctgagcctcttaactttatgtctctggaggaattgaggaagaaaagcagcctcgtggcgaatgcactcgatgccctggaactgccaaagggatctgcaattgctattgacatgcctatggatgtcaatgctgttgtgatctaccttgctatcgtattggcaggatatgtggttgtctcaattgcagacagttttgctgcacctgcgatatcgatgaggttaaagatatcagaagcaaaggcaatttttactcaggattacatccttcgtgatgacaaagaactgccattgtacagtagagttgtggaggttaaggcccctatggcaattgtgattcctgtaagggggtctttgccaataaagggactacgtgttgatgacctttcctggcaagacttccttggaagagttaataataccgaggcggaaaattacattgctgttaagcaaccggccgacgcgttcacaaatatcctattttcatcagggaccacaggggagcccaaggcaattccatggacacatataacacccctaaaggcagctgctgatggatggtgccacatggatattcgtaaaggagatgttgttgcatggccaactaatcttggttggatgatgggcccttggcttgtttatgcctctttactgaatggagcttccatggctctgtataatggctccccaaatagttcaggctttgcaaagtttgtacaggatgctaaggtgacaatgcttggactggtacccagcatcgctcgtacatggaagaatacagactgtacagctggactagactggtcctccatccgatgctttagctcatctggggaggcatccagtgtggatgattatttatggctgatgggaagagctggctacaagccagtaatcgagtactgtggaggcacagagattggtggtggatttgttactggatccttgctgcaacctcaagcgttgtctgcattcagcacacctgccatgggttgtaacctgttcattcttgatagcaacgggaatcctttgccacaagactctgtgggtatcggtgaacttgcacttgatccaactttatttggatcatcaacaacacttctaaatgctgatcatcaggaggtttatttcaacggaatgccagaatggcacgggaaaatcctccgcaggcatggagatgaatttgagcgtacttctgacgggtattacagggctcatgggcgtgcagatgatacaatgaacctcggtggaattaaggttagttccattgagattgagaggatctgcaacagagtacatgatgccatcgttgaaacagcagctatcggggttccacctgtagggggtggccccgaacaactaaccatagccgtcgtgttgaaagaccagagctcacaattagaggactggaaccaactgaaactagcgttcaacgttgctctgaagaaactgaaccctctcttcaaggtatcctcggtcgtcgtggtcccgtctctccctagaaccgcctctaacaaggtcatgaggagggtcctgcgcaaggagttcagccaggcagcccaggcaaagcattcgaaaatatagatagttagaaataattaatgcttctgctgcaaatgcacctgcagaaaagagttaaacagcaaactgtgcatatcgtcactcataggcccttcaaaatcctgttgtctacctcgatccaaagaggagaaatgagatgtacttatagatttcgggaaacaaacgagctgtatttcctgccaacgtgcagcactcacatgatgtgagctcacatatgaggaggcactaataaaacatgaatgcaatcacttacgtatgcattctccaatgcaggccattatcgagaatcaaggctttaggatggtgtgccttgcaggcccggacgcccggtcctgttttggtggcacatggcctaaagaggtcctataaacattatcttgaaattttcttctaacattttattgatgttgacatcaatatcaatctcatctaataatttcctct

SEQ ID NO: 1016 - DNA, 2587 bp, Pennisetum glaucum
gccgtaaagaacttgtgccctgccgcatctgcaactgcaacctactcctatctgctgagcagcagcagcagtagcagctgtagcagaaggacgtcatggccgccgccgcggcgcacaaacccctgggcgcgatcacgcccggcgacctggccgccgcggcgcccggggcggacgccgccgcgctccacgcagccctccggctcgtgctcgacgagtcccgcgccggcgccgcggaccccgccgccgtgtggggggagctctgcaggtccctgctccgcccggacgtccccttcgccgtccaccggatgctctactacggctgcttcgccgggttcccgtactccacgccgcccgcctggacccccgaccccaaggaggcgcccttgaccaatgtcggccgcgtcatggaggcgcggggaagggagctcctcggcgacgcgtacaaggatcccatcaccagcttccctgacctctacaagttctccaatgagaacccagaggcgtactggaggatggtctttgaggatatgggtgttgagttcagtgcggagccgtcttgcatctggagagagagtgatgcatatcccggtggcgagtggctacccggtgctgagctgaatgctgcctcaaattgtctgagtgctaaacctggtacaagttccaaagatgttgccattgtgtggagggatgaagggaaagattcagagcctctcaacttcgtgactcttgaggagctgaggaaaaaagtttgccttgtggcaaatgcacttgatgccctggacctgccaaagggatcagcaattgctatcgacatgcctatgaatgtgaatgctgttgtgatctacctagcgatcattttagcaggctatgtggttgtctcaattgctgacagctttgctgcacctgcaatatcaacaaggttgaagatatcagaagcaaaagcaattttcactcaggattacattcttcgtgatgacaaggaactgccattgtacagtagagttgtggaggctatggcacctatggcaattgtgatccctgtaaggggatctttgccaataaagggactgcgtgttaacgacctatcctggcaggatttccttggaagggttaatgataccaaggtggaaaattatactgctgttaagcaacctgcctacgcattcaccaatatcctattttcttcagggaccacaggggagccaaaggcaattccatggacacatataacccccctgaaggcagctgctgatggttggggtcacatggatattcgtaaaggagatgttgttgcgtggccaactaatcttggttggatgatgggtccctggcttgtatatgcctccttactcaatggagcttccatggctctatataacggctccccaaatagctcaggctttgcaaagtttgtacaggatgctaaggtgacaatgcttggactggtgcccagcattgctcgagcatggaaaaatacagattgtacagctggatttgactggtccaccatccgatgctttagctcatcaggggaggcatcaagtgtggatgactatttatggctcatgggaagagcttgctataagcctgtaattgaatattgtggaggcacggagattggaggtggatttgttactggatctttggtgcaacctcaagcgttgtctgcattcagcacacctgccatgggctgtaacttgttcattcttgatggcagtgggaatcccttgccgcaggattctgtgggcattggtgaactcgcacttgatccggttttatttggatcatcaacaacactgctaaacgctgaccatcacgaagtttattttaatggaatgccagaatggaatgggaaaatcctccgcagacatggagatgaattcgagcgtacttctgatggatattatagggctcatgggcgtgcagatgacacaatgaaccttggtggcattaaggttagttccatcgagattgagagaatctgcaacagagtgaacgatgccatcctcgaaacagcagctattggggttccgcctatcggtggtggtcctgagcaactaaccatagccgccgtcttgaaagaccagagctcacaagtagaggacttgaaccagctgaaactagcgttcaacgtggctctgaagaagctgaaccctctcttcaaggtttcttctgttgtcgtggttccatcactcccaagaaccgcctcgaacaaggtcatgaggagagtcctgcgcaaggaattctcccaagcaccacaggcgaagaagtcaaaaatctagatagaattttacttcctgcaaatgtactacctcaagaaagggctatacagcaaactgtgcatatcaatacttaggcccttcgtcacccagttaattatttacctctgaagaagaggtatgaggtgtgtatttctatttcggaaaaagaaacgagcagtattacctgccgcaggatttgttcacttgatgtgaactcacagatgaggtatactaataaaacattcatgatgttatttgcagtaccatgaattttttcttctgaaaaaaaaaaaacaaaaaaaaaaaaaaaaaaaaaaaaaagtctc

SEQ ID NO: 1017 - DNA, 2415 bp, Zea mays
aaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctctgtccgtctgtccccttcgccgtccaccggatgctctactacggttgcttcgccgggttcccgtctcccacgccgccggcctggacgcccgaccccaaggaggctgtcttgaccaatgtcggccgtgtcctcgaggcgcgtggtagggacttcatcggcgacgcgtacaaggatcccatcaccagcttcccagacctccacaagttctccaacgagaacccagaggcgtactggaagatggtatttgaggatatgggtatccaattcagcgtagagccatcctgcatctggagagagaacactgcatatcctggtggcgagtggctaccaggcgccgagctcaacgctgctgttaattgcttgactgctaaacccgggaggagctccgacggtccggccattgtatggagggatgaagggaaggactctgatcctcttaacttcatgtctttggaggacttgaggaagaaagtttgcctagtggccaatgcaattgatgccctggaactgccgaagggatctgcaattgctattgacatgcctatggatgtcaatgctgttgtgatctaccttgcgatcgtgttggcgggatatgtggttgtctcaattgcagacagttttgctgcacctgcaatatcaatgaggttgaagttatcagaagcgaaggcaatttttactcaggattacatccttcgtgatgacaaagaactaccattgtacagtagagttgtggaggctaaggcccctatggcaattgtgattcctgtaagggggtctttgctaataaagggactacgtgttgatgacctttcctggcaagatttccttggaagggttaattataccgaggctgaaaattacactgctgttaaccaacctgcctatgcattcaccaatattctattttcatcagggaccacaggggagcccaaagcaattccatggacacatataacacccctaaaggcagctgccgatggatggtgtcacatggatattcgtaaaggagatgttgttgcttggccaacgaatcttggttggatgatgggcccttggcttgtttatgcctccttgctgaatggagcttccatggctctgtataatggctccccaaatagttcaggctttgcgaagtttgtacaggatgctaaggtaacaatgcttggactggtacccagcatcgttcgtacttggaagaatacggactgtacagctggactagactggtcctccatccgatgctttagctcctctggggaggcatccagtgtggatgattatttatggctgatgggaagagctggttacaagccagtaatcgagtactgtggaggcacagagattggtggtggatttgttactggatcgatgctacaacctcaagcgttgtctgcattcagcacacctgccatgggttgtaacctgttcattcttgatagcagtgggaatcctttgccacaagactctgtcggcattggtgaacttgcacttgatccaactttatttggatcatcaacaacacttctaaacgctgatcatcaggaggtttacttcaacggaatgccagaatggcacgggaaaatcctccgcaggcatggagatgaatttgagcgtacttctgacgggtattatagagctcatgggcgtgcagatgatacaatgaaccttggtggaattaaggttagttccattgagatcgagaggatctgcaacagagtacatgacgccatccttgaaacagcagctatcggggttccacctgtagggggtggccccgaacaactaaccatagccgtcgtgttgaaggaccagagctctcaaatagaggacttgaaccagctgaaactagcatgcaacatggctctgaagaaactgaaccctctcttcaaggtttcctccgtcgtcatcgtcccgtccctccctaggaccgcctctaacaaggtcatgaggagagtccttcgcaaggagttcagccaggccgcccaggcaaagcattcaaaaatataggtagttattagaaataattagtgttttctgctgcaaatgcacctgcagaaagagtaaaacaccaaactgggcatatcgggaagtcctgttgtttgccaccaaaacggataaatgagatgtacttagatttcgggaaataagggagctgtattcctgcca

SEQ ID NO: 1018 - DNA, 1060 bp, Panicum virgatum
cttgttcttcttcttcttcttcttcttgttgttcgttccttcacaaggcgaagagctccttcctctgatcccccactgtcactgcaatccgaatcccaccgcgtcgcatcgcagagcaggaaggtggttgcttcgcgccgtgttcggttggagatttgactgtcgctgctgcaatggccgccgccgctccatctctggcgccgtccccgtcccctgccacggcgccgacgacggccgcgtcgcccaaggccggcgacaggagtaaggtggtgccgctgacggcggccgacgaggtggagctggaggagaagcacgtgctggccgtcgacgacagctctgtcgaccgggccgtcatcgccaagatcctccgcagctccaagtacagagtgaccactgtcgattcggcgacgagggcgctggagctgctcgcgctgggcctgctgccggacgtgaacatgatcatcacggactactggatgcccggcatgaccgggtacgagctcctcaagcacgtcaaggagtcgtccaagctcaaggagatcccggtggtgatcatgtcgtcggagaacgtgcccaaccggatcacccgctgcctggaggagggcgccgaggacttcctcctcaagcccgtccgcccctccgacgtctccaggctctgcagccggatccgatgatctgatcgtccattcgtgcccccgccggagttcgctaggactgattagtactcgtaggaaaccattttttgctgtttcttttccccattttttggacatagatgatagatctgctactgctgctgccgcctcaaagaagaagctaacatttggggcctaggtagactagagcttaggagcttaggagtgggggatcgaggggagcatttgctttgcttgctccctcgtgtgacccgctgctgcaaaagagaagatgccaaaagcgaaaaggagcagaggtcctctgagatgctcttctgttcagagaagcctcccttcctctcgacgccctgtaactgattgaaaaaaaagagaaaaattggcatcagggcaacctgttaaccttt

SEQ ID NO: 1019 - DNA, 1188 bp, Panicum virgatum
ttcttcttcttcttcctgttcgttccttcacaaggcggagagctccttcctttgatcgatcccccgctgcaatccgaatcccatcgcagagcaggagcgacaggaggtccatcgacccgtggtgttcggttggagatttgactgtcgctgctgcaatggccgccgccgctccatgtctggcgccggtgccgtccccgtcccagtcccctgcctcgtcgccgacggccgcgtcgcccaaggccggcgacaggaaggtggtgccgctgacggcggccgacgaggtggagctggaggagaagcacgtgctggcggtcgacgacagctccgtcgaccgggccgtcatcgccaagatactacgcagctccaagtacagagtgaccacggtcgattcggcgacgagggcgctggagctgcttgcactgggcctgctgccggacgtgaacatgatcatcacggactactggatgcccggcatgaccgggtacgagctcctcaagcacgtcaaggagtcgtccaagctcaaggagatcccggtggtgatcatgtcgtcggagaacgtgcccaaccggatcagccggtgcctggaggagggcgccgagggcttcctcctcaagcccgtccgcccctccgacgtctcccggctctgcagccggatccgatgatcggccccccggcggagtccgctaggactgataatttacgcttaggaaaccattttttgctgtttcttttccccattttttggacatagatgatagatctgctgatgctgcttgcctcaaacaagaagctaacatttggggcctagggagactagaaggttaggagtgggggatcgaacagagcatttgtgctttgctttgcttgcgccctcgtgtgacccgctgctgcaaaagagaagatgccaaaagcgaaaaggagcagagttcctctgagatgctgttctgttcagagaaacctctcaacctgttgattgaaaaaaagaagaaaaattggcatcagggcagggcaaccctgttaacctttccatgatcggagcttttcacaccagttttccaggattagcagttactaattctgcccacttctcatttcttggtaacccacatggctgattcctcttaatctgtctgtccatgattgattgatagctaatcaataacgcagatggttgggctctgccatagc

SEQ ID NO: 1020 - DNA, 1112 bp, Sorghum bicolor
cctccaactcctcgccgcaaccgcacctgtctctgcctgctcctgctttcattcattcactcgcaagaagaacaagaacaagaggagagctccgcaatcgcatagcatcccggctcaaagaagattcggttggagtttggattgtttgtctctgcaaattgcaatggctgccgctgctgctccgtcagtgtccccctccccgtccccggcgacggcgccggcgccgaaggtcgtgtcgcccaaggccggcgacaggaaggtggtgccggtggacgctgtggaggtggagctcaagctggagctggaggagaagcacgtgctggcggtggacgacagctccgtcgaccgcgccgtcatcgccaagatcctccgcagctccaagtacagagtgaccaccgtggaatcggcgacgcgtgctctggagctgctcgcgctgggtctgctccccgacgtgaacatgatcatcacggactactggatgccagggatgaccggctacgagctcctcaagcacgtcaaggagtcgtcggagctgagggagatcccggtcgtgatcatgtcgtcggagaacgtgcccacccgcatcacccgctgcctggaggagggcgccgaggacttcctcctcaagcccgtccgcccctccgacgtgtcccgcctctgcagccggatcagatgatctggtcacccagccagccatccatgccggcgcatcggctgccgcatggactggttgcgtactcttaggagttagtaggatccattttttgttctttcttttccccattttttcccttctttcttggacatagatctgctgctgctgccgcctcaaacaagaatctaacttttggggcctagggagacttttagatttaggaacgaagttaaattaggaatgggggatggagcagagcatttgctcttgttcttttccctgtgatgatcttctgctgcaaaagatgccccccaggcatgaaaaaagaaaagaacccctgtccatggtcctcactgatcacatctgttgaaaagaaatggcatccgtgcaaacctgttaaccgtttcaagatcagagcttctgtttctttttccttgtcaaatgacaccagtatcag

SEQ ID NO: 1021 - DNA, 1281 bp, Sorghum bicolor
acacgccccgccgcgcctccaactcctcgccgcaaccgcacctgtctctgcctgctcctgctttcattcattcactcgcaagaagaacaagaacaagaggagagctccgcaatcgcatagcatcccggctcaaagaagattcggttggagtttggattgtttgtctctgcaaattgcaatggctgccgctgctgctccgtcagtgtccccctccccgtccccggcgacggcgccggcgccgaaggtcgtgtcgcccaaggccggcgacaggaaggtggtgccggtggacgctgtggaggtggagctcaagctggagctggaggagaagcacgtgctggcggtggacgacagctccgtcgaccgcgccgtcatcgccaagatcctccgcagctccaagtacagagtgaccaccgtggaatcggcgacgcgtgctctggagctgctcgcgctgggtctgctccccgacgtgaacatgatcatcacggactactggatgccagggatgaccggctacgagctcctcaagcacgtcaaggagtcgtcggagctgagggagatcccggtcgtgatcatgtcgtcggagaacgtgcccacccgcatcacccgctgcctggaggagggcgccgaggacttcctcctcaagcccgtccgcccctccgacgtgtcccgcctctgcagccggatcagatgatctggtcacccagccagccatccatgccggcgcatcggctgccgcatggactggttgcgtactcttaggagttagtaggatccattttttgttctttcttttccccattttttcccttctttcttggacatagatctgctgctgctgccgcctcaaacaagaatctaacttttggggcctagggagacttttagatttaggaacgaagttaaattaggaatgggggatggagcagagcatttgctcttgttcttttccctgtgatgatcttctgctgcaaaagatgccccccaggcatgcaaaaaaaaaaaagaaaaaagaaaagaacccctgtccatggtcctcactgatcacatctgttgaaaagaaatggcatccgtgcaaacctgttaaccgtttcaagatcagagcttctgtttctttttccttgtcaaatgacaccagtatcaggattagcatttatattattatatatactaattttaagatgagagttcttcccccaaccaattcctgttcatacattgtttctcaattcgcatggatggcggtcacggttcacgcacgatctcatctccatctccatgatt

SEQ ID NO: 1022 - DNA, 751 bp, Cynodon dactylon
caagcagaggttcattcgatcgactgcttcgtctccttgattctgggctcctagcaatggctgcggctgctcagtctcccgttccggcaatttccgcgcccaccaccaaggtttcgtcgcccaaggccggcgacaggaaggtcgtgccggtcacggccgccgacgaggtccagcaggagcagatgcacgtcctggcagtggacgacagcaacgtcgaccgggccgtcatcgccaagatcctccgcagctcaaaatacagagtgaccacggtggattccgccacaagagctctggagctcctctgcctcggcctgcttcccgacgtcaacatgatcatcacggactactggatgcccggcatgaccggctacgagctcctcaagcgcgtcaaggagtcgtccgagctcaaggagattcccgtggtgatcatgtcgtccgagaacgtgcccaaccggatcagccgctgcctcgaggagggagccgaggacttcctcctcaagcccgtccgcccgtccgacgtgtcccgcctctgcaaccggatcagatgatcgccgcgtcgcggaccatgactactacttttaggattttttttcattcttctccgattttttggacatagatctgctgctgctgctgcctcaaacaacaagaacctaacttttgaggcttagggagactactagcttttaggaggttattaggatttaggcctgttatctgctgaaagatgccatggagaatttgttcgctt

SEQ ID NO: 1023 - DNA, 717 bp, Saccharum officinarum
cttcgcgcacctgtctgcctgctcctgcattcgttcgttcagtcgagctccgcaatcgcatcgcatcccatcccggcacaagaagattcggttcgagtttggattgtttgtctctgcaaattgcaatggctgctgctgctgctccgtctgtggcgccgtcgtccccgttggtcgcgtcgcccaaggccggcgacaggaaggtggtgccggtggacgcggtggaggtggaggtggagctgaagctggagctggaggagaagcacgtgctggcggtggacgacagctccgtcgaccgcgccgtcatcgccaagatcctccgcagctccaagtacagagtgaccaccgtggagtcggcgacgcgggcgctggagctgctcgcgctgggtctgctccccgacgtgaacatgatcatcacggactactggatgcccgggatgaccgggtacgagctcctcaagcacgtcaaggagtcgtcggagctgagggagatccccgtggtgatcatgtcgtcggagaacgtgcccaaccgcatcacccgctgcctggaggagggcgccgaggacttcctcctcaagcccgtccgcccctccgacgtcttccgcctctgcagccggatcagatgatcgatcaccatgatccattcaccccctgcgcccggcgcgtcatctgctgcagggactggacggattgcgtactcgtaggaattaataggatcca

SEQ ID NO: 1024 - DNA, 913 bp, Leymus cinereus x Leymus triticoides
tcgccgttccatactactactactgctgctccggcgaggaagaggatcgactgactgattcgatggccgcggctgctcccacccaggctccggccatgaccctgcccgccgccctgactgccaaggtggcgtcgccgaaggccgccgccgccgaccgcaaggtggtgccggtgatgacggacgccgacgaggtcgtcgtccaggtccaggcggagttgcacgtgctcgccgtcgacgacagcgtcgtcgaccgcgccgtcatcgccaagatcctccgcagctccaaatacagagtgaccactgtggactctgcgactcgggcgctcgagctgctgggcctggggctcatcacagacgtgaacatgatcatcaccgactactggatgcccggcatgaccggctacgaactgctgaaacgcgtcaaggagtcgtcggagctcagggagatccccgtggtcatcatgtcgtcggagaacgtgcccaaccgcatcacccgctgcctcgaggagggcgccgaggacttcctcctcaagcctgtccgcccctccgacgtctcccgcctctgcaacaggttccggtgatcaaccatcgaatcgtcgacggaggaggattaattcttaagtaggattttcaattcttttttcggtgttctttccatggacatagatccgctgccgcctcaaacaacagcttaactttttggggtcctagagatgattagattaggatgttagttcgttcccttgtgtgctctgcttcagagatgccaagaaaaaccaaaacagagtattcattcagccaaaaagaaaggaaatcttctgaatgaatgttattcagacaagtttcccctcttggctacatgttgaaaacttgaaatggcatcagatcagagcaacatgttgacagtttcata

SEQ ID NO: 1025 - DNA, 1013 bp, Triticum aestivum
ccacgcgtccgcaccaatctattccagccaagaagaagagctcttcgccgttccatattactactgcttcttcggcgagagagtttgatcgactgatggccgcggctgctcccacccaggctccggccatgaccctgccggccgccatggccgccaaggtggcgccctcgccgaagcccaccgccgccggcgaccgcaaggtggtgccggtgatgaccgacgccgacgaggtcgtcgtccaggtccaggtccaggcggagctgcacgtgctcgccgtcgacgacagcgtcgtcgaccgcgccgtcatcgccaagatcctccgcagctcaaaatacagagtgactactgtggactctgcgactcgggcgctggagctgctgggcctggggctcatcacggacgtgaacatgatcatcaccgactactggatgcccggcatgaccgggtacgagctgctgaagcgggtcaaggagtcgtcggagctccgggagatccccgtggtgatcatgtcgtcggagaacgtgcccaaccgcatcacccgctgcctcgaggagggcgccgaggacttcctcctcaagcccgtccgcccctccgacgtctcccgcctctgcaaccgcatccggtgatgaaccgtctctcgccgcacccgtggatcatctacggaggaggattaattcttaagtaggatttttcattcttttttcttcggtgttctttccatggacatagatccgccgcttgctgccgcctcaaacaacagcttaactttttggggtcctagtagatgatgatgactagattaggatgttagttcgtccccttgtgtgctctgcttcttcaaagatgccaagaaaaaaaaaatcaaaacagagtattcatccggccaaaagaaaggaaatcctctgaatgaatgttgttcagagaagtttcccatcttggctaaatgtcgaaatggcatcggatcagagcaacatgttgacagttccataatcagagctaatcttttgcaacaa

SEQ ID NO: 1026 - DNA, 962 bp, Triticum aestivum
aacacatccatccttcagacgagttcttcgccgttacatactactactcctgctgctccggcgagtttgatcgactgatggctgcggctgctcccacccaggctccggccatgaccctgccggccgccatggccgccaaggtggcgcccgcccccgccggcgaccgcaaggtggtgccgctgatgaccgacgccgacgaggtcgtcgtccaggtccaggtccaggccgagctgcacgtgctcgccgtcgacgacagcgtcgtcgaccgcgccgtcatcgccaagatcctccgcagctcaaaatacagagtgaccaccgtggactcagcgacgcgggcgctggagctgctgggcctggggctcatcacggacgtgaacatgatcatcaccgactactggatgcccggcatgaccgggtacgagctgctgaagcgcgtcaaggagtcgtcggagctccgggagatccccgtggtgatcatgtcgtcggagaacgtgcccaaccgcatcacccgctgcctcgaggagggcgccgaggacttcctcctcaagcccgtccgcccctccgacgtctcccgcctctgcaaccgcatccggtgatcagccgtccaagcctcagacaacggaggaggattaattcttaagtagagcaggatttttcaattcttttttcttcggtcttctttcccatggacatagatccgccgctcgctgccgcctcaaacaacagcttgactttttggggtcctaggagatgatgatgatttagattaggatgttagttcgttcgtccccttgtgtgctctgcttcttcagagatgccaagaagaacaaaccgaaacagagtattccttctaccaaaaggaaggatatcttctgaatgaatgttgttcagagaagtttcccctcttggctacatgtcgaaagctttgatgaaatggcatcggatcagagcaacatgttgac

SEQ ID NO: 1027 - DNA, 987 bp, Secale cereale
cgcatcaatccattcaagccaaggagaagagttcttcgcccatactgcttctatcgctgctccggcgagtttgatccactgatggctgcggctgctcccacccaggctccggccatgaccctccccgccgccatggctgccaaggtggcctcctcgcccaaggccgctggcgctgaccgcaaggttgtgccgctgatgaccgacgccgacgaggtggtcgtccaggtccaggtccaggccgagctgcacgtgctcgccgtcgacgacagcgtcgtcgaccgcgccgtcatcgccaagatcctccgcagctcaaagtacagagtgaccaccgtggactctgcgacccgggctctggagctcctcggcctggggctcatcacggacgtgaacatgatcatcaccgactactggatgcccggcatgaccgggtacgagctgctgaagcgcgtcaaggagtcgtcggagctccgcgagatccccgtggtgatcatgtcgtcggagaacgtgcccaaccgcatcacccgctgcctcgaggagggcgccgaggacttcctcctcaagcccgtccgcccctccgacgtctcccgcctctgcaaccgcatccggtgatcgtctctcgccggacccgtgcatcatccacggaggaggattaattcttaagtagagcaggatttttcaattcttttttcttcggtgttctttcccatggacatagatccgcccgctgcccgcctcaaacaacagcttaacctttttggggtcctaggagacgatgatggttagattagggtgttagttcgttcgcccccttgcctgctctgcttcttcagagatgccaagaacaaaaaccgaaacagagtattcattctgccaaaaaagaagggaaatcttctgaatgaatgaatgaatgttgttcagagatgtttcccctcttggctacatgtcgaaaacctgaaatggcatcggatcagagcaacatgttgacaa

SEQ ID NO: 1028 - DNA, 1068 bp, Secale cereale
gatggctgcggctgctcccacccaggctccggccatgaccctccccgccgccatggccgccaaggtggcgtcctcgccgaagcccgcccccggcggcgaccgcaaggttgtgccgctgatgaccgacgccgacgaggtggtcgtccaggtccaggtccaggccgagctgcacgtgctcgccgtcgacgacagcgtcgtcgaccgcgccgtcatcgccaagatcctccgcagctccaagtacagagtgaccaccgtggactctgcgacccgggctctggagctcctcggcctggggctcatcacggacgtgaacatgatcatcaccgactactggatgcccggcatgaccgggtacgagctgctgaagcgcgtcaaggagtcgtcggagctccgcgagatccccgtggtgatcatgtcgtcggagaacgtgcccaaccgcatcacccgctgcctcgaggagggcgccgaggacttcctcctcaagcccgtccgcccctccgacgtctcccgcctctgcaaccgcatccggtgattgatcgaccatccaagccaagcctcgacggaggaggattaattcctaaataggatttttcattcttttcttcggtgttctttcccatggacatagttccgctgccgcctcaaacaacagcttaactttttggggtcctaggagacgatgatgattagattaggatgttagttcgttcgctcgcccccttccgtgctctgcttcttcagagatgccaagaacaaaaaccgaaacagagtattcatcctgcctgccaagaagaaaggaaatcttctgaatgaatgttgttcatagatgtttcccctcttggctacatgtcgaaaacttgaaatggcatcggatcagggcaacatgttgacagtttcataatcagagttagttttttggcatgtctcaccaattaaccatcatcgactcgactgtgtcccttctccttaatcaatccccacatggtcaccgctgttcatacatgcgtctgtctgcctgcctgcccttaatcatgctttgtctgccacgcgatgcagttttccaaagtc

SEQ ID NO: 1029 - DNA, 812 bp, Avena sativa
accgcaccgagagacaagtcaagaagaaggaagaagagctcgtccgccctgccctgccctccgagagatactactactactacttcggaatttctactacggctcgtctgatcgattccatggctgcggctgctcccaccccggctccggcggccatgaccctcccactggcgcagaaggtgtcctcccccaaggccggcgaccgcaaggtggtgccggtccctgtcatggtggccgacgaggccgtccaggtgcaggagatgcacgtgctggccgtcgacgacagcgtcgtcgaccgcgccgtcatcgccaagatcctccgcagctctaaatacagagtgaccaccgtggaatccgcgacgcgcgcgctggagctgctgggcctgggcctcatcacgaacgtgaacatgatcatcaccgactactggatgccggggatgaccggctacgagctgctcaagcgcgtcaaggagtcctccgagctccgtgagatccccgtggtgatcatgtcgtccgagaacgtgcccacccggatcacgcgctgcatggaggagggcgccgaggacttcctgctcaagcccgtcaggccctcggacgtctcgcgcctctgcagccgcatgatccgatgatctcgccgccgcctcgcgtcaaggacgcgccaaccaggattaattcttaggaggatctttcgttttgttttttgttctgctgttctttctgtggacatagagatctgccgccgccaagcttaacttttggggtcctaggagacgatgattaggcttttattaggatgtaatgttaggatgaag

SEQ ID NO: 1030 - DNA, 920 bp, Avena sativa
accgcaccgagagacaagtcaagaagaaggaagaagagctcgtccgccctgccctgccctccgagagatactactactactacttcggaatttctactacggctcgtctgatcgattccatggctgcggctgctcccaccccggctccggcggccatgaccctcccactggcgcagaaggtgtcctcccccaaggccggcgaccgcaaggtggtgccggtccctgtcatggtggccgacgaggccgtccaggtgcaggagatgcacgtgctggccgtcgacgacagcgtcgtcgaccgcgccgtcatcgccaagatcctccgcagctctaaatacagagtgaccaccgtggaatccgcgacgcgcgcgctggagctgctgggcctgggcctcatcacgaacgtgaacatgatcatcaccgactactggatgccggggatgaccggctacgagctgctcaagcgcgtcaaggagtcctccgagctccgtgagatccccgtggtgatcatgtcgtccgagaacgtgcccacccggatcacgcgctgcatggaggagggcgccgaggacttcctgctcaagcccgtcaggccctcggacgtctcgcgcctctgcagccgcatgatccgatgatctcgccgccgcctcgcgtcaaggacgcgccaaccaggattaattcttaggaggatctttcgttttgttttttgttctgctgttctttctgtggacatagagatctgccgccgccaagcttaacttttggggtcctaggagacgatgattaggcttttattaggatgtaatgttaggatgaagcgttcgcctgttcgttccctgcaaatgggttccgagaaaatgaaaaaaaaaaaacagagaattcagccagaacagagcagttcttctgaatgtcttgttcagaaaata

SEQ ID NO: 1031 - DNA, 972 bp, Brachypodium distachyon
ggatttctaatggctgcagcggctccggctctttctctagcacccatggcgacgacggtaacggcggcggcggcgcagaaagcggcgtccccgaaggcggcggccggcggcgacgtgcggaaggtggtgccggtgatggcggccgcagccgacgaggtggtcgtccaggagctgcacgtgctggccgtcgacgacagcgtcgtcgaccgcgccgtcatcgccaagatcctccgcagctccaagtacagagttaccacggtggaatcggcgacgagggcgcttgagcttctcggcctcgggctcatcacaaacgtcaacatgatcatcaccgactactggatgcccggcatgaccggctacgagctcctcaagcgcgtcaaggaatcgtctgagctgaaggagatccccgtggtgatcatgtcgtcggagaacgtgccgaaccggatcaaccggtgcctggaggagggcgccgaggacttcctactcaagcccgtccgcccctccgacgtctccaggctctgcagccggatccgatgaaccccgtcgtctggatcaagcaggattaatttattcttaggatttttgttttttgttttgccccgtgttcttttccatggacatagatctgctgctgctgctgcttcctcaaacaagaagctaactttggggggctgccttaggagagacgattagctttagcaagttaggaacgaggggccgatcaagcatctgtttgcttgctttgttccctcgtgtagtcgtgtgatctgctgcaaagatgcccaagagaaatgagaaaaggaaatttcattcagcaaaaagaaaggaattcttcttgtggacagtcaaattctttcagagaagttttcccctcttccctgttgaaatgggcatcggagcagagcagagcaaacctgttaactgtttttcacgatcagagttgacattaatcgatcccgaatttatttaccc

SEQ ID NO: 1032 - DNA, 1438 bp, Brachypodium distachyon
tcgagatctcgcaggatctcctccgcattgatttccttttcctttttcttttctcttcttcttccccacttgtatatatactcccgcgcgtcgcggctcaaagcaaaccacaaccagcgcattcatccttcgatccatcgagtcaagcaaagacaagtcaagactcgagagttcttcttcttcatccccgaaatcatcaacacgagggaggagggatttctaatggctgcagcggctccggctctttctctagcacccatggcgacgacggtaacggcggcggcggcgcagaaagcggcgtccccgaaggcggcggccggcggcgacgtgcggaaggtggtgccggtgatggcggccgcagccgacgaggtggtcgtccaggagctgcacgtgctggccgtcgacgacagcgtcgtcgaccgcgccgtcatcgccaagatcctccgcagctccaagtacagagttaccacggtggaatcggcgacgagggcgcttgagcttctcggcctcgggctcatcacaaacgtcaacatgatcatcaccgactactggatgcccggcatgaccggctacgagctcctcaagcgcgtcaaggaatcgtctgagctgaaggagatccccgtggtgatcatgtcgtcggagaacgtgccgaaccggatcaaccggtgcctggaggagggcgccgaggacttcctactcaagcccgtccgcccctccgacgtctccaggctctgcagccggatccgatgaaccccgtcgtctggatcaagcaggattaatttattcttaggatttttgttttttgttttgccccgtgttcttttccatggacatagatctgctgctgctgctgcttcctcaaacaagaagctaactttggggggctgccttaggagagacgattagctttagcaagttaggaacgaggggccgatcaagcatctgtttgcttgctttgttccctcgtgtagtcgtgtgatctgctgcaaagatgcccaagagaaatgagaaaaggaaatttcattcagcaaaaagaaaggaattcttcttgtggacagtcaaattctttcagagaagttttcccctcttccctgttgaaatgggcatcggagcagagcagagcaaacctgttaactgtttttcacgatcagagttgacattaatcgatcccgaatttatttacccaatcaatcatccttatttgtccgccacatggtcaatcacatcacgctgttcatgttcatgcatctgtccttcaatcgtattttttcttcttcttgtgtggcatgtgacgctatccacatttcccccatgattgatttcttgttaagttgtgctgatgtcgcctctcccacccatgatttgtgtatgtgctgtactattgtataatcatttgtgcaagaatcataatcttgctgtgcgtatctcattagtgtgc

SEQ ID NO: 1033 - DNA, 1026 bp, Hordeum vulgare
cgcattcatccatccatccatcttcgcccttctctcccatactactattactgctgctgcttcttctccggcgaggaaggggaagaggatcgactgtctttgactgaatcgatcgatggccgcggctgctcccacccaggctccggctatgaccctgccgcccgccatggtggcctcgtcgccgaagcccgccgccgtcggcgaccgcaaggtggtgccggtgatgaccgacgccgacgaggtcgtcgtccaggtccaggtccaggcggagctgcacgtgctcgccgtcgacgacagcgtcgtcgaccgcgccgtcatcgccaagatcctccgcagctccaagtacagagttactaccgtggactctgcgacccgggctctggagctgctggggctggggctcatcacggacgtgaacatgatcatcaccgactactggatgcccggcatgacggggtacgagctgctcaagcgcgtcaaggagtcgtcggagctccgggagatccccgtcgtcatcatgtcgtcggagaacgtgcccaaccgcatcacccgctgcctcgaggaaggcgccgaggacttcctcctcaagcccgtccgcccctccgacgtctcccgcctctgcaaccgcatccggtgatcatcaaccaccgcgtcgcccatccacggaggaggattaattctaagtaggatttttcaattctttttcttcggtgttctttcccatggacatagatccgctcgctgccgcctcaaacaacagcttaactttttgggggtcctaggagatgatgatgatgattttagattaggatgttagttcgtccccttgtgtgctctgcttcagagatgccaagaaacaaaaaccgaaacagagtattcatccagccaaaagaaagcaaatcttctgaatgaatgttattcagacaactttcccctcttggctacatgtcgaaatggcatcagatcagatcagagcagagcaaacatgttgacagtttcataatcagagttagtttctttggcatc

SEQ ID NO: 1034 - DNA, 908 bp, Secale cereale
gagaaggaggaggagagtttgatccactgactcactcgatggccgcggctgctcccacccaggctccggccatgaccctccccgccgccatggccgccaaggtggcgtcctcgccgaagccgcccccggcggcgaccgcaaggttgtgccgctgatgaccgacgccgacgaggtggtcgtccaggtccaggtccaggccgagctgcacgtgctcgccgtcgacgacagcgtcgtcgaccgcgccgtcatcgccaagatcctccgcagctcaaaatacagagtgaccaccgtggactctgcgacccgggctctggagctcctcggcctgggcctcatcacggacgtgaacatgatcatcacagactactggatgcccggcatgaccgggtacgagctgctgaagcgcgtcaaggagtcgtcggagctccgcgagatccccgtggtgatcatgtcgtcggagaacgtgcccaaccgcatcacccgctgcctcgaggagggcgccgaggacttcctcctcaagcccgtccgcccctccgacgtctcccgcctctgcaaccgcatccggtgatcgtctctcgccggacccgtgcatcatccacggaggaggattaattcttgagtagagcaggatttttcaattcttttttcttcggtgttctttcccatggacatagatccgcccgctgcccgcctcaaacaacagcttaacctttttggggtcctaggagatgatgatggttagagtagattgttagttcgtttgcccccttgcgtgctctgcttcttcagagatgccaagaacaaaaaccgaaacagagtattcattctgccaaaaaagaagggaaatcttctgaatgaatgaatgaatgttgttcagagatgtttcccctcttggctacatgtcgaaa

SEQ ID NO: 1035 - DNA, 605 bp, Saccharum officinarum
gtcgacccacgcgtccgggagtttcgattgtttgtctctgcaaattgcaatggctgctgctgctgctgctgctccgtctgtggcgccgttggtcgcgtcgcccaaggccggcgacaggaaggtggtgccggtggacgcggtggagctggagctggagctggaggagaagcacgtgctggcggtggacgacagctccgtcgaccgcgccgtcatcgccaagatcctccgcagctccaagtacagagtgaccaccgtggaatcggcgacgcgggcgctggagctgctggcgctgggtctgctccccgacgtgaacatgatcatcacggactactggatgccccggatgaccgggtacgagcttcttcaacacgttaaggagtcgtcgagcttaaggaaaatcccgtggtgatattgtcgtccaagaacctgcccaaccgcattaccgttgcttggagaggcgccgaggacttcttcttaaacccgtccgcccttcgacgtttccgctttttgaggccggtaaatgtcgttccttgatccttcccccttggcccgggcgttattttgttgaaggaatggatgattggtctcaaggaataaaaagaaca

SEQ ID NO: 1036 - DNA, 946 bp, Panicum virgatum
cgccgccgccgcacttcccgtctggtatcgtctgcgcagcaagccctagcagcaggtggatcggttgtcgacggatagcagcaatgagtaagttgcaaactgaggtcctaaaggatgccatctcccaggtcgtgtcggaggcaagggagaagaacaggaagttcacagagaccatcgagctccagattggactgaagaactacgatccgcaaaaggacaagcgtttcagtggctccgtcaagctgccccacatccctcgccccaagatgaaggtctgcatgcttggtgatgcccagcacgtggaggaggctgagaatatcggtcttgattacatggatgttgaagctcttaagaagatgaacaagaacaagaagcttgtcaagaagcttgctaagaagtaccatgctttcttagcttctgaggctattatcaagcagattccccggctccttggtcctggtctcaacaaggcaggcaagttcccaactttggttactcaccaggaatctctggaatcaaaggtgaatgagacgaaagctacagtcaagttccagctcaagaaggttctttgcatgggtgtggctgtgggcaacctgtcgatggaggagaagcagatccagcaaaacatccagatgagcgtcaacttcctggtttcattgcttaagaagaattggcagaacgtgaggtgcctgtacatcaagagcaccatggggaagccaaatagggtgttctaagttgctgcatccatgcccgtttaaaacgactccgtagtctgtagtggagtttgctatgggattatttgtttatgcagtaatctatcgtaccgttttgcaaattttgtgcctgaattaagagtggatttgtgatacactgtttttcaccttgccccttgagctgacgggacaatgagcatcaagctacgctgctgctgttggcatagttcttg

SEQ ID NO: 1037 - DNA, 1152 bp, Panicum virgatum
ggtccctgtcctcctctacgcgctcgctcgctcgcgccgccgccgccgccgccgcacttcccgtctggtctcgtctgcgcagcaaaccctagcagcaggtgggtcggttatcgacggacagtagccatgagtaagttgcaaactgaggccctcaaggaggccatctccctggtcgtgtcggaggcaagggagaagaacaggaagttcacagagaccatcgagctccagattggactgaagaactatgatccgcaaaaggacaagcgtttcagtggctccgtcaagctgccccacatccctcgccccaagatgaaggtctgcatgcttggtgatgcccagcacgtggaggaggctgagaagatcggtcttgattacatggatgttgaagctcttaagaagatgaacaagaacaagaagcttgtcaagaagcttgctaagaagtaccatgctttcttagcttctgaggctattatcaagcagattccccgtctccttggtcctggtctcaacaaggcaggcaagttcccaactttggttactcaccaggagtctctggaatcaaaggtgaatgagacgaaagctacagtcaagttccagctcaagaaggttctttgcatgggtgtggctgtgggtaacctgtcgatggaggagaagcagatccagcaaaacatccagatgagcgtcaacttcctggtttcattgctgaagaagaattggcagaacgtgaggtgcctgtacatcaagagcaccatggggaagccaaacagggtgttctaagttgctgcgctcatgcccttttaaaaccaactctagtccgtagtggagtttgttatgggatatatgcttatgcagtaatctatcgtactgttttgcaaattttgtgcctaatttgaacaagagtggcattatgatccactagtttcaccttgcacttgagctactagacagtgtgcttcaggttacgctgctgctagtggcatagtttttgtgaattcctctttacgatatgctgcgttcatgcacgttgcacgtttgatagctggccgttgtttacggatttatttcaaccgtcaaatcctacacaaaatacatgcattaaggtggaataatattagaatagggtgtttgtttgatgaattttacaggctggtc

SEQ ID NO: 1038 - DNA, 1103 bp, Panicum virgatum
ggcggccgccgccgcttttctttctcgctcgctccgtcgcccgcccgaagcaaagcaagggagttgagttgagttgagtcaccggttgcagccatgagtaagttgcaatccgaggttctcaaggatgccatctcccagattgttggggatgccaaagagaagaataggaagttcaccgagaccgttgagcttcagattggtctgaagaactatgacccgcagaaggacaagcgtttcagcggctctgttaagctccctcacatcccccgcccaaagatgaaggtgtgcatgcttggtgatgcccagcacgttgaggaggctgagaagattggacttgactacatggatgtcgaggcgctcaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagatgcctgtacatcaagagcaccatggggaagccatacagggtgttctaagtcttgccgcgatccttgtgaagttgataaaaatactaggccacaccagctgggctggtcttgaaacttagatttgtgcctaaaaatactccgcagtttcgatgatattgtcatcctgactggtatgagaatgagatcgttggttatgaactgcattcatcattccttctctagtttctttgtttagacaatcacgtagatttgcaatcatgattttgatggaactgttttcccggagaaaggacggagctagtaggagaaccaagggggcaatggccccattatactttatgtgcactcttatgctggcgtgcaaaatgtcaaacacagaggaagcaagctacagtgttgtactgaat

SEQ ID NO: 1039 - DNA, 2083 bp, Oryza sativa
gcagagacgccatttctgcctcgtcccctcttcgcctctcctccgccggcgccgcccctgcccaaaccctagagtgttgttgagttatcggccgcaaacatgagtaagttacaaaccgaggctctcaaggaagccatctcccaggttgttgctgattgcaaggaaaagaacaggaagttcaccgagaccgttgagcttcaaattggtctcaagaactatgacccacaaaaggacaagcgtttcagcggctccgttaagctgccccatatcccccgccccaagatgaaggtctgcatgcttggtgatgcccagcatgtcgaggaggctgagaagattgggctcgactacatggatgttgaggcccttaagaagatgaacaagaacaagaagcttgtgaagaagcttgccaagaagtaccatgctttcttagcatcagaggccatcatcaagcagatcccccgtctccttggtcctggtctaaacaaggcaggcaagttccctacattggttactcaccaggagtctcttgaatccaaggtcaatgagacgaaagctacagtcaagttccagctgaagaaggttctgtgcatgggtgttgctgtgggtaacttgtcgatggaggagaagcagatccagcaaaacatccaaatgagcgtcaacttcctcgtgtcccttttgaagaagaactggcagaatgtgaggtgcctgtacatcaaaagcacaatggggaaaccgtacagggtgttctaagctggtttgctccacattgaagctgataagatgctgggcggttgaactgagcttgtccttacattagatctgcttgcactgatatcagttttgtgcttacccaagagaacatcgagatatgttatcatattttgtagtagtttattcagtgcacttcggatttatgcaaatgaggcttgtgttatttatgaatagtttcgttcatggggagaattggtgtgccaactaccgttcgttctggtttgaccttgaatcgatagcaaatgttgccgctgctcgcaagaatcgtgcagcatcgaaatcatgatgcggcgccgtttgaccccatttttgaagatacagaaacagtataattcaagtagacttttaagaacttgactgaacatagatgctgagtttactctcccatattatctgttagcatcaaaaggcaattacatttgaggataactaagatcaaagcatgtcagaaccgagacgcaatcacaggtaacagtcgatataggctatagggaaaacaaaatggtactaagtacacagtacggcacagagtcaataaaatcaccaaggcctatttgcacaaacaaatccaactaggaagcagaaacatagctgaaaagctgtacaaattcaaagctctttgggtcttgagacacccgaagaagtcaagggacaatgaagggaatgaccattgacaagaacccgtcatatgaaagagttgccgagccgctgtagcgtgtatccttctctttgaatttttcagttaaaccctacgcggaaccaaaaaataaataaataaaaaaatcagtcattaggttctttgctgcttctttgcatgatccaatcataattggagggctgcaaatggaagagaagtggcataccttaacaatcattccacacctgcagaattaaaattacagaggcatacgaaacaatagtcagattccttcattcagaaaataaactgactgatgagttcgttttgtgtgagaaatatacttactccacaaagttgtcaaagtccaacgcgccacggctggagactccattgttgtagttcgcgataagaagctcaaggacagaaggtggaaccgcatatccaagactgcgtagagcttctctcaactcatctttctcaatttttccactcccgtccctatcgtatctgtcgaaaatgccctggatgttgccaccaagaacagaaattagcccaataggtaacactaaatgaaagaacagaagaataggcaacatgacacctattgattaattgagcaccatataatcttgcaaagtcttgcttagataagttaacagacaataattataa

SEQ ID NO: 1040 - DNA, 1019 bp, Oryza sativa
atttctgcctcgtcccctcttcgcctctcctccgccggcgccgcccctgcccaaaccctagagtgttgttgagttatcggccgcaaacatgagtaagttacaaaccgaggctctcaaggaagccatctcccaggttgttgctgattgcaaggaaaagaacaggaagttcaccgagaccgttgagcttcaaattggtctcaagaactatgacccacaaaaggacaagcgtttcagcggctccgttaagctgccccatatcccccgccccaagatgaaggtctgcatgcttggtgatgcccagcatgtcgaggaggctgagaagattgggctcgactacatggatgttgaggcccttaagaagatgaacaagaacaagaagcttgtgaagaagcttgccaagaagtaccatgctttcttagcatcagaggccatcatcaagcagatcccccgtctccttggtcctggtctaaacaaggcaggcaagttccctacattggttactcaccaggagtctcttgaatccaaggtcaatgagacgaaagctacagtcaagttccagctgaagaaggttctgtgcatgggtgttgctgtgggtaacttgtcgatggaggagaagcagatccagcaaaacatccaaatgagcgtcaacttcctcgtgtcccttttgaagaagaactggcagaatgtgaggtgcctgtacatcaaaagcacaatggggaaaccgtacagggtgttctaagctggtttgctccacattgaagctgataagatgctgggcggttgaactgagcttgtccttacattagatctgcttgcactgatatcagttttgtgcttacccaagagaacatcgagatatgttatcatattttgtagtagtttattcagtgcacttcggatttatgcaaatgaggcttgtgttatttatgaatagtttcgttcatggggagaattggtgtgccaactaccgttcgttctggtttgaccttgaatcgatagcaaatgttgccgctgctcgc

SEQ ID NO: 1041 - DNA, 1262 bp, Oryza sativa
tcactcgccgccttctctcctctcgcgccgtttcgctccctgaccctccgccgccgccgccgccgatcatcatgagtaagttgcagagcgaggttctcaaggaagccatctcccaggttgttggggaatccaaggagaagggcaggaagttcaccgagaccgttgagcttcagattggtctcaagaactatgacccgcaaaaggacaagcgtttcagcggctccgtcaagctgccccatatcccccgccccaagatgaaggtctgcatgcttggtgatgcccagcatgtcgaggaggctgagaagattgggcttgactacatggatgttgaggctcttaagaaaatgaacaagaacaagaagctggttaagaagcttgccaagaagtaccatgctttcttagcatcagaggccatcatcaagcagattcctcgtctccttggtcctggtctcaacaaggcaggcaagttccctacattggttactcaccaggagtctcttgaatccaaggtcaacgagacgaaagctacagtcaagttccagctgaagaaggttctgtgcatgggtgttgctgtgggtaacttgtcaatggaggagaagcagatccagcaaaacatccaaatgagcgtcaacttcctcgtgtcccttttgaaaaagaactggcagaatgtgaggtgcctttacatcaagagcaccatggggaaaccaatcagggtgttctaagttggtgtgttccacctagaagtgaaaaggatcagttgaaaccaagcttttcctcttaaaatagacctgtcgctctgggaccggcttttgtctgtcagtgcaagagaatatatcaaagaaatatctggaccttatttttgtagcgtgtttatttgggagtaacttattctacgtaagcttctaatgtggaaattctatgtgtgttatgctgctcctacatactccctccgtttcggaatgtttgacgccgttgactttttattacatgtttgaccgttcgtcttattcaaaaaattttgacacttaataattcttttcctatcatttgattcattgttaaatatattttcatgtaggcatataattttacatatttcataaaagtttttgaataagacgaacagtcaaacatgtgctaaaaagtcaacggtgtcaaatatttcgaaacggagggagtataagcctttttaccttgcaagattcaagattggtgcaatttgtttcactgccacaggtagtgttgatgatcatacttggata

SEQ ID NO: 1042 - DNA, 1020 bp, Panicum virgatum
gctcgctcgcccgccccgcgccgaaccctaaccaagggagtcgagttgagttgagtcaccggttgcagccatgagtaagttgcaatccgaggctctcaaggatgccatctcccagatcgttggggatgccaaggagaagaataggaagttcaccgagaccgttgagcttcagattggtctgaagaactacgacccgcagaaggacaagcgtttcagcggctctgttaagctgcctcacatcccccgcccaaagatgaaagtgtgcatgcttggtgatgcccagcacgttgaggaggctgagaagattggacttgactacatggatgtcgaggcgctcaagaaaatgaacaagaacaagaagcttgtcaagaagcttgccaagaagtaccatgctttcttagcatcagaggctatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagatgcctatacatcaagagcaccatggggaagccatacagggtgttctaagtcttgccgcgattcttgtgaagttgataaaatactaaggcctctccagctgggcttgtcttaaaacttagatatgtacccatcaattctgtacctgttactgaggatgttgaagtatttggtccttaatctagtgtttcctttaatagaacttttggaggaatgcttttgggattacacagttgcaacttttgttaaggttctttggccgctccgcagttttgatattattgtcattccgaccggtatgagaatgagaacgttggttatgaactgcattcatatgcatgtttttatcc

SEQ ID NO: 1043 - DNA, 1212 bp, Panicum virgatum
ggcttctctttctcgccagccccgcgccgaaccctaaccaaagggtgttgagttgagtcaccggttgcagccatgagtaagttgcaatctgaggctctcaaggatgccatctcccagatcgttggggatgccaaggagaagaataggaagttcaccgagaccgttgagcttcagattggtctgaagaactacgacccacagaaggacaagcgtttcagcggctctgttaagctgcctcacatccctcgcccaaagatgaaggtgtgcatgcttggtgatgcccagcatgttgaggaggctgagaagattggacttgactacatggatgtcgaggcgctcaagaaaatgaacaagaacaagaagcttgtcaagaagcttgccaagaagtaccatgctttcttggcatcagaggccatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaagaactggcagaatgtgaggtgcctgtacatcaagagcaccatgggaaagccatacagggtgttctaagtcttgccgtgatccttgtgatgttgatttactatgcctctccagctgggcttgtcttaaaacttagatatgtacccatcagttttgtgcctgtcaaagagaatgttgaagtatttggtctttaatctagtgtttcctgtggaggaattctttttgggattatgcagttgcagcttgcgttacgagaccgtgtgtttcaaccgttcagtccagagcatgagctccaagtcccaaatgacgattccaacaggtggagcggtaaatatgagaacacggtgtatgctaaaattcctcggtaactgtatacaagataccagccgatgcttgttggcagcaaccagcagggaacaatattcacatcacgtgcataacggatagttcagtatgtaactcgtatgcatctcgtgtgggtgttctattggtgtcacaatgtgtgaacagttgaaaaagattacgaggcaataaagcatatgggatagtttttgaccc

SEQ ID NO: 1044 - DNA, 1001 bp, Panicum virgatum
gaactcccggcgccgccacctccatcagcttctccttctcgctcgctccgtcgccctccccgagccgaaccctaaccaagggagttgagttgagtcaccggttgcagccatgagtaagttgcaatcagaggccctcaaggatgccatctcccagatcgttggggatgccaaggagaagaataggaagttcaccgagaccgttgagcttcagattggtctgaagaactacgacccgcagaaggacaagcgtttcagtggctctgttaagctgcctcacatcccccgcccaaagatgaaggtgtgcatgcttggtgatgcccagcacgttgaggaggctgagaagattggacttgactacatggatgttgaggcgctcaagaaaatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaagtgaatgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaagaactggcagaatgtgagatgcctgtacatcaagagcaccatggggaagccatacagggtgttctaagtcttgccgcgatcctagtgaagttactaggcctctccagctgggcttgtcttaaaacttagatatgtacccatcagttttgtgcctgtcaatgagaatgttgaagtatttggtccttgatctagtgtttcctttaatagaacctgaggagcaatgtttttgggattatgcagttgcatcttatgttaaggttctttcgatgctccttgtctcttatttgcagctccgcagttttgatatt

SEQ ID NO: 1045 - DNA, 4735 bp, Oryza sativa
acatgggacaactggtattcactaatctagtagactaacagtacagctaaatcaaggtcaagtaggaaactacagtaagagataagatatttttaacaatttaattagaccatgtgacataaaaaagaagaagaagaagaagaagaaaaaccacttcatgtcgagcagtaaaaaaccattgttttataaggactagccagccaacaaaggtggatgtaaacaaggggtattgttatatttacctttctgccatcttccaacaggagccttaatgctatgaccgaggtaattctctcggtgcttgtcaaccttaacatcatcccatttgaattctgcaaggaacaaaaggagaaaagtatttagatttactgagcttttctaataattgtatgttcaacccatataacaaaaaagctcgtaagctacaatgcaaagtgcaagatggagatgacacaatggcagtggaacagaacaacatgtagaagagcttatagcaaaaacaaacgatcaaaatgtaggcctattcatgttggcaggtgtaggagtagtccagtgcacgcttttctgtttgagaaaaggtagctttatgttcatagtacaaaatgaagaaccacaggtgcaattggaggagctaacgggctgcactcattatttatagcgcttgtaaagttgaatagtaagcataaggttatacaattagggcaccgatgatgcccataagtgatgataatctagtgagtttatcatatacaaagtagttatatagtacaagcctataaatgaaccccccccccccccaaaaaaaaagtgatgattttctctttcagatgcagcaattgtaatcaatgtaatttggatcattttctcacctcattgtatcttgtagttatctagcagctttttgctcattcagcatgaggatgaaccttagcattataaagcataaaacacaacgaaatacagagagtaaaactgaatattccatgatatcctagagctatattcatgatatcctagagctcggagcacattaataagtgccgtacattgcagcaaacaaatgcatatccataatatatgcccacagaagttgaaaaactcgtgtaaattttggaaagctcatacatccagcatatagaagtgctaatactaattttatagtgtcatgtttcatcctgatgactggtattgccatgccaccattcattaaggtaattttggcagcagtacgttgtaaccccagtagttgttgtcccttgatgatccgactgtcagtctgtcacacgaggatcccttgcaatggggtcatccattcatcttatgaccattgtttttaaactaaaaaacaatgtcggataccaatgaggaacttggtatcaattggatagagaagagataaaggtgaacacgcgtgccgaagggtgctgaatgcgggcaggcatacgtgcgtgaccgcgccatgtgcagtttccatcttataacctttcaaaggaacatgattcaataacaatatggcagacacagaattcctcctgatgcaagatcatacaagcaaacagatgagttggaaggtaagatcctacgcactaaccacatagacacaagagacgaactagctaatcgaatccagtgcaacacggacgagttggaaccaacaagtaagaccggacgagatgcaatcaaacgcgaggaaggagcatcgacaaatcaacaactagaaccttacagccacagcgagtccctagcaacagcatcgaaaccctagcgagtgtttcacggaagtaaaaaaattacgcggcagaattagggcccgcagccagcgattgagatctcacggcgagtggatttgggaaaggtaggagaaggagagagcttacgatcccgtccgccgcggacgccgcctctcgtcgggtggtacatctccgcccggtcgcgccgccggtggggtggggaattcggcggaggaagacgacgacgatttgcgtagtggaggtttttttccttttttttttttttttgagattgagatgcgcgaccgccatatgtggaatgggccctttatgtttcggcccacgacgaaaggaagcccaccggcgtcaatctccaccgtccgatccgatcggacggtcgaaacggcacagagcatgcagccacaaaaaccctaggtcgggagcacgcatcctcactcgccgccttctctcctctcgcgccgtttcgctccctgaccctccgccgccgccgccgccgatcatcatgagtaagttgcagagcgaggttctcaaggaagccatctcccaggttgttggggaatccaaggagaagggcaggaagttcaccgagaccgttgagcttcagattggtctcaagaactatgacccgcaaaaggacaagcgtttcagcggctccgtcaagctgccccatatcccccgccccaagatgaaggtctgcatgcttggtgatgcccagcatgtcgaggaggctgagaagattgggcttgactacatggatgttgaggctcttaagaaaatgaacaagaacaagaagctggttaagaagcttgccaagaagtaccatgctttcttagcatcagaggccatcatcaagcagattcctcgtctccttggtcctggtctcaacaaggcaggcaagttccctacattggttactcaccaggagtctcttgaatccaaggtcaacgagacgaaagctacagtcaagttccagctgaagaaggttctgtgcatgggtgttgctgtgggtaacttgtcaatggaggagaagcagatccagcaaaacatccaaatgagcgtcaacttcctcgtgtcccttttgaaaaagaactggcagaatgtgaggtgcctttacatcaagagcaccatggggaaaccaatcagggtgttctaagttggtgtgttccacctagaagtgaaaaggatcagttgaaaccaagcttttcctcttaaaatagacctgtcgctctgggaccggcttttgtctgtcagtgcaagagaatatatcaaagaaatatctggaccttatttttgtagcgtgtttatttgggagtaacttattctacgtaagcttctaatgtggaaattctatgtgtgttatgctgctcctacatactccctccgtttcggaatgtttgacgccgttgactttttattacatgtttgaccgttcgtcttattcaaaaaattttgacacttaataattcttttcctatcatttgattcattgttaaatatattttcatgtaggcatataattttacatatttcataaaagtttttgaataagacgaacagtcaaacatgtgctaaaaagtcaacggtgtcaaatatttcgaaacggagggagtataagcctttttaccttgcaagattcaagattggtgcaatttgtttcactgccacaggtagtgttgatgatcatacttggatagcaaatttgtgagagccttctgtggcgcttgacgacaccattcggattgttccatcacttccatacttcgtgctggttgtaagattagcattagactacaatgtccaatccttcagtcttctgcacgtttaccctaagttttatgggtttgttaaattgtcgtgcttccaaagtttagggtttatccatagctatgaatttttgcaaaacatgtttagggtttgatggaactaagcatatacaacatcgtgaaaatctccgaaaattttctcaactttaaatcttttgataaagtaaaaaaaaaaagaaagaaggctatagtcaacgagacttgaagcgtgaggacgacctctgccgccgttgatttggaatggacggttaggaggtgaggtgaggccgtcgttgcagcccacaaaaaggcggaggagacccggagactgtggagacgcgacgcgaaatcgatcgagagattattggcgagtcgaggagagtgcgcgagagagatggcgatgagatcggcgctgacctcactcccgttgcgcctccgctcccctgctcctgtggcggcggcgtgcggcgggatgcggctgatgagcgacggcaaggggcgcgtgctgagcgaggaggagcgggccaaggagaacgtctacgtccagaagatggagagggagaggatggagaagcgcaagaagaagctcgagaaggagaaggcggaggcagacaagggcaatcccgccgcctccgacaagaatacggaggggggatccaactaggagtgatgtgcttctgtctgaagacggacttgtttcacatgcctatgttggacaccggtgttcatacatgtcctaggatgaaagaataaattctgtaaaacatttgacagagctagattcatctgctctggtttccggtgcttgttcatgattgaatgaggctctattgtgttggacaagtatatctgtgttccctttctgcattttgttgcgcacctagatatgcagaacatgcgtgctgctgcggttccagacatgcggtttatgcaattcattcgcagcggcgtgagaatgcgtacgtatgcggttccaggcatgaggttcatttgacaacaatatttgcagctacaagtagcatacgctgttcagacttatacatcttgaattcttgattgcaacatacatacaccattcagacatcagaccagtagcgagctcacacaagtgctgctccattctctttggatgagggcacaaaaaaaagaggcaaatatgtagcagtataccagacaagtcaa

SEQ ID NO: 1046 - DNA, 1076 bp, Setaria italica
cgctcgctccgtcgcccgccgcgcgccagaccctaacaagggagctgagtgaccggttgcagccatgagtaagttgcaatctgaggttctcaaggaggccatctcccagatcgttggggattccaaggagaagaataggaagttcaccgagacagttgagcttcagattggtctgaagaactatgacccgcagaaggacaagcgtttcagtggctccgttaagctgccccacatcccccgccccaagatgaaggtgtgcatgcttggtgatgcccagcacgttgaggaggctgagaagattggacttgactacatggatgttgaggctctgaagaagatgaacaagaacaagaagcttgtcaagaagcttgccaagaagtaccatgctttcttagcatcagaggccatcatcaagcagattccccgtctccttggtcctggtctcaacaaggcaggcaagttccctacactggttacccaccaggagtctcttgaatccaaggtgaacgagacgaaagctacagtcaagttccagctgaagaaggttctttgcatgggtgttgctgttggtaacctgtcgatggaggagaagcagatccagcagaacatccagatgagcgtcaacttccttgtgtcccttctgaagaagaattggcagaatgtgaggtgcctgtacatcaagagcactatggggaagccgtacagggtgttctaagtcttgccgtgatccttgtgaagttgataaaaaatactaggacgtcgaactgggcttgtcttaaacttagatatgtacccatcagttttgtgcctgtcaatgagaatgtcgaagtatctggtccaatctagtgtttcctttaatagaacatgtggaggaatgccttttgggattatgcgcagcttgtgttatggttcttttgccacccctttgtctcttattagctgctctgcagtcttgatatcattggctattggcataccgagtgctttcgtatgcatggttttatctgaaaacaggccatcagttctgaaattgtcggagttgtggattaattggcttcgttgaatctgaagcgtcg

SEQ ID NO: 1047 - DNA, 911 bp, Saccharum officinarum
cctctcctctcgctccgtcgctcgcctccggccaaaccctaagcagggattcgagtgatcggttgcagccatgagtaagttgcagtccgaggttctcaaggatgccatctcccagattgttggggatgccaaggagaagaataggaagttcaccgagactgttgagcttcagattggtctgaagaattatgatccacagaaggacaagcgtttcagtggctctgttaagttgccccacatccctcgtccgaagatgaaggtgtgcatgcttggtgatgcccagcatgttgaggaggctgagaagatgggacttgactacatggatgttgaggccctgaagaaaatgaacaagaacaagaagcttgttaagaagcttgccaagaagtaccatgctttcttggcatcagaggccatcatcaagcagattccccgtctccttggtcctggtctcaacaaggcaggcaaattccctacgctggttactcaccaggaatcccttgaatccaaggtgaatgagacgaaggctacagtcaagtttcagctgaagaaggttctttgcatgggtgtcgctgtcggtaacttgtccatggaggagaagcagatccagcagaacatccaaatgagcgtcaacttccttgtgtccctcctgaagaagaactggcagaatgtgagatgcctgtacgtcaagagcaccatggggaaaccatacagggtgttctaagtcagctctttgttaagtctgctctttatgaattatgatgctagggttttggaccgaggttgtcttgaactaaactcttgttagagtatgttttgttggcaggatattggagtggtactgccataagtatccgggcatgtgtcttgcacccaaacctttgtattctctatatatgttgcttgagtggttc

SEQ ID NO: 1048 - DNA, 917 bp, Saccharum officinarum
cctctcctctcgctccgtcgctcgcctccggccaaaccctaagcagggattcgagtgatcggttgcagccatgagtaagttgcagtccgaggttctcaaggatgccatctcccagattgttggggatgccaaggagaagaataggaagttcaccgagactgttgagcttcagattggtctgaagaattatgatccacagaaggacaagcgtttcagtggctctgttaagttgccccacatccctcgtccgaagatgaaggtgtgcatgcttggtgatgcccagcatgttgaggaggctgagaagatgggacttgactacatggatgttgaggccctcaagaaaatgaacaagaacaagaagcttgttaagaagcttgctaagaagtaccatgctttcttggcatcagaggccatcatcaagcagattccccgtctccttggtcctggtctcaacaaggcaggcaaattccctacgctggttactcaccaggaatcccttgaatccaaggtgaacgagacgaaggctacagtcaagtttcagctgaagaaagtcctttgcatgggcgtcgctgtcggtaacttgtcaatggaggagaagcagatccagcagaacatccaaatgagcgtcaacttcctcgtgtcccttctgaagaagaattggcagaatgtgagatgcctgtacgtcaagagcaccatggggaaaccatacagggtgttctaagtctgctctttatgaattatgatgctagggttttgaaccgaggttgtcttgaactaaactcttgttagagtatatttggttggcaggatattggagtggtgtcttgcccgcaagcctttgtattctctatgggtctcattggttgtctgcacagaacttgcattgccttgcttgaaattctactttatagttgttt

SEQ ID NO: 1049 - DNA, 1005 bp, Sorghum bicolor
ctcgctccgtcgctcgcctcgggccaaaccctagcagggagttgtgtgatcggttgcagccatgagtaagttgcagtctgaggttctcaaggatgccatctcccaaatcgttggggatgccaaggagaagaataggaagttcaccgagactgttgagcttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgctaagaagtaccatgctttcttggcatcagaggctatcatcaagcagattccccgtctccttggccctggtctcaacaaggcaggcaagttccctacgctggtaactcaccaggaatccctggaatccaaggtgaacgagactaaggctacagtcaagtttcagctgaagaaggtcctttgcatgggtgtcgccgtcggtaacttgtccatggaggagaagcagatccagcagaacatccaaatgagcgtcaacttccttgtgtccctcctgaagaagaattggcagaatgtgagatgcctgtacgtcaagagcaccatggggaaaccatacagggtgttctaagtctgctctttgtgaagtcgtctgctctttgtgatattaggcttttgaaccgaggttgtcttgaactgaactcttgttagagtatattttgttggctggatattggagtggtaccaccataagtatccgggcaggtgtcttgctcccaagtctttgtattctctctatatatactagatgatacctctcggggattttgtctcgttatagcatgtctctcattattcatgccactgtaatcttctgaattaaaattctaattacaccatttactcttgaggactgatttcagc

SEQ ID NO: 1050 - DNA, 1140 bp, Sorghum bicolor
ccgaatccgcacatccgacggttccaagattaacacgcgtcatccatcgggagctcgttctagggttttgcttcgacaccgctccccgctcatatataaacacccggcgccgccgtttcaattcccttttcgcctcgctccgtcgctcgcctcgggccaaaccctaagcagggagttgtgtgatcggttgcagccatgagtaagttgcagtctgaggttctcaaggatgccatctcccaaatcgttggggatgccaaggagaagaataggaagttcaccgagactgttgaacttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgctaagaagtaccatgctttcttggcatcagaggctatcatcaagcagattccccgtctccttggccctggtctcaacaaggcaggcaagttccctacgctggtaactcaccaggaatccctggaatccaaggtgaacgagactaaggctacagtcaagtttcagctgaagaaggtcctttgcatgggtgtcgccgtcggtaacttgtccatggaggagaagcagatccagcagaacatccaaatgagcgtcaacttccttgtgtccctcctgaagaagaattggcagaatgtgagatgcctgtacgtcaagagcaccatggggaaaccatacagggtgttctaagtctgctctttgtgaagtcgtctgctctttgtgatattaggcttttgaaccgaggttgtcttgaactgaactcttgttagagtatattttgttggctggatattggagtggtaccaccataagtatccgggcaggtgtcttgctcccaagtctttgtattctctctatatatactagatgatacctctcggggattttgtctcgttatagcatatctctcattattcatgccactgtaatattctgaattaaaattctaattacaccatttactcttgaggactgatttcagca

SEQ ID NO: 1051 - DNA, 1027 bp, Sorghum bicolor
gtccgtacccgcatctggcggtctcaagattaacacgcgtcatccatcgggagctcgttctagggttttgcttcgacaccgctccccgctcgtatataaacacccggcgccgccgtcccttccctctcgctccgtcgctcgcctcgggccaaaccctagcagggagtcgagtgaacggttgcagccatgagtaagttgcagtccgaggttctcaaggatgccatctctcagattgttggggatgccaaggagaagaataggaagttcaccgagactgttgagcttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgccaagaagtaccatgcgtttttggcatcagaggccatcatcaagcagattccccgtctccttggtcctggtcttaacaaggcaggcaagttccctacgcttgttactcaccaggagtccctggaatccaaggtgaatgagacgaaggctactgtcaagtttcagctgaagaaggtcctctgcatgggtgtcgccgtcggtaacttgtccatggaggagaagcagatccagcagaacatccaaatgagtgtgaacttccttgtgtccctcctgaagaagaactggcagaatgtgagatgcctttacgtcaagagcaccatggggaaaccatacagggtgttctaagcctgctcgatctttgtgaagtctgctgtttatgaattatgatgctaggattttgaaccgaggttgtcttgaactaaaactcttgttagagtatgtttggttggcaggatattggagtggtactaaagcctttgtattctctctctatatatattgcttgaggctcaatataacatgcgtcttataactc

SEQ ID NO: 1052 - DNA, 1218 bp, Sorghum bicolor
gtccgtacccgcatctggcggtctcaagattaacacgcgtcatccatcgggagctcgttctagggttttgcttcgacaccgctccccgctcgtatataaacacccggcgccgccgtcccttccctctcgctccgtcgctcgcctcgggccaaaccctagcagggagtcgagtgaacggttgcagccatgagtaagttgcagtccgaggttctcaaggatgccatctctcagattgttggggatgccaaggagaagaataggaagttcaccgagactgttgagcttcagattggtctgaagaattatgatccacagaaggacaagcgtttcagtggctctgttaagttgccccacatccctcgtccaaagatgaaggtgtgcatgcttggtgatgcccagcacgttgaggaggctgagaagatgggacttgactacatggatgttgagtccctcaagaaaatgaacaagaacaagaagcttgttaagaagcttgccaagaagtaccatgcgtttttggcatcagaggccatcatcaagcagattccccgtctccttggtcctggtcttaacaaggcaggcaagttccctacgcttgttactcaccaggagtccctggaatccaaggtgaatgagacgaaggctactgtcaagtttcagctgaagaaggtcctctgcatgggtgtcgccgtcggtaacttgtccatggaggagaagcagatccagcagaacatccaaatgagtgtgaacttccttgtgtccctcctgaagaagaactggcagaatgtgagatgcctttacgtcaagagcaccatggggaaaccatacagggtgttctaagcctgctcgatctttgtgaagtctgctgtttatgaattatgatgctaggattttgaaccgaggttgtcttgaactaaaactcttgttagagtatgtttggttggcaggatattggagtggtactaaagcctttgtattctctctctatatatattgcttgaggctcaatataacatgcgtcttataactcatttcttttctaatttcatggtagcatgagtttccaccatggctgctccgccctcggggagattgatcaccatttctaataattaatgcattcataaatatccatgcatacataagtttttgaagtttgatattgtagcactttcgcttgtatttgacaattattgattaactataaactaattaggctta

SEQ ID NO: 1053 - DNA, 1057 bp, Zea mays
ccgtacccgcatccgacggttccaagcctaacacgcgtcatccatcgggagctcgctctagggttttgcttcgagaccgttcccacttcccatcgctcatataacaccgggcgccgccgcttccgtcctcttcctctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcgtcaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaactcttgttaagagtatgtttttggacgatcctatatttcgtcctggcgctactatgtttcagaatggtggtactactataagtatcctggcgctttaagtattgcttgaaaggatcaatataatttgcgtgtcatacccacaaccttttctgc

SEQ ID NO: 1054 - DNA, 964 bp, Pennisetum glaucum
gcacaatcctttcctgccaggcggcggcggcggctccactggtataacacccggcgccgccacttcccccgcttctctccctctccctctcggcgcccgccagtccctgacgaagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagctgccccacatcccccgccccaagatgaaggtgtgcatgcttggtgatgcccagcacgttgaggaggctgagaagctcggacttgactacatggatgtcgagtctctgaagaaaatgaacaagaacaagaagcttgtcaagaagcttgccaagaagtaccatgctttcttggcgtcagaggccatcatcaagcagatcccccgtctccttggtcctggtctcaacaaggcaggcaagtttcccacactggtttctcaccaggagtctcttgaagccaaggtgaacgagacgaaagctacagtcaagttccagctaaagaaggttctttgcatgggtgttgctgttggtaacctgtccatggaggagaagcagatccagcagaacatccagatgagcgtcaacttccttgtgtcccttctgaagaagaattggcagaacgtgaggtgcctgtatgtcaagagcaccatggggaagccgtacagggtgttctaagtcctgccgctatgtgaaggaccttgaactgggctttgccataaacttagatatgtacccatcagttttgtgcctgacaatgagactgttgaaatatctggtccttaaatttattttttcgcttaatggaacctctggaggaatgcttttgcaattatggagtcgcatcttgtg

SEQ ID NO: 1055 - DNA, 916 bp, Pennisetum glaucum
actgactctgcttcaggttccatggcgcaatcctttccgccgccgccacttcccccgcttccccccctctccctctcggcgcccgctaatccctgacgaagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagttgccccacatcccccgccccaagatgaaggtgtgcatgcttggtgatgcccagcacgttgaggaggctgagaagctcggacttgactacatggatgtcgagtctctgaagaaaatgaacaagaacaagaagcttgtcaagaagcttgccaagaagtatcatgctttcttggcgtcagaggccatcatcaagcagattccccgtctccttggtcctggtctcaacaaggcaggtaagtttcctacactggtttctcaccaggagtctcttgaagccaaggtgaacgagacgaaagctacagtcaagttccagctaaagaaggtcctatgcatgggtgttgctgttggtaacctgtccatggaggagaagcagatccagcagaacatccagatgagcgtcaacttccttgtgtcccttctgaagaagaattggcagaacgtgaggtgcctgtacgtcaagagcactatggggaagccgtacagggtgttctaagtcttgccgctatccttgtgaaggacctcgaactgggcttgccataaacttagattgtacccatcagttttgtgcctgtcaatgagactgttgaaatatcttgtccttaaatttagtgttttgcttaatagaacctgtgg

SEQ ID NO: 1056 - DNA, 926 bp, Pennisetum glaucum
ataacacccggcgccgccacttcccccgcttctctccctctccctctcggcgccctccagtccctgacgaagggagctgagtgaccggttgcagccatgagtaagttgcaaactgaggttctcaaagaagccatctctcagatcgttgtggcttccaaggagaagaataggaagttcactgagacagttgagcttcagattggcctgaagaactatgacccacagaaggacaagcgtttcagtggctctgttaagttgccccacatcccccgccccaagatgaaggtgtgcatgcttggtgatgcccagcacgttgaggaggctgagaagctcggacttgactacatggatgtcgagtctctgaagaaaatgaacaagaacaagaagcttgtcaagaagcttgccaagaagtaccatgctttcttggcgtcagaggccatcatcaagcagatcccccgtctccttggtcctggtctcaacaaggcaggcaagtttcccacactggtttctcaccaggagtctcttgaagccaaggtgaacgagacgaaagctacagtcaagttccagctaaagaaggttctttgcatgggtgttgctgttggtaacctgtccatggaggagaagcagatccagcagaacatccagatgagcgtcaacttccttgtgtcccttctgaagaagaattggcagaacgtgaggtgcctgtacgtcaagagcactatggggaagccgtacagggtgttctaagtcttgccgctatccttgtgaaggacctcgaactgggcttgccataaacttagaattgtacccatcagttttgtgcctgtcaatgagactgttgaaatatcttgtccttaaatttagtgtttcgcttaatagaacctgtggagggatgcttttggaattatggagttgcatcttgtgtt

SEQ ID NO: 1057 - DNA, 906 bp, Brachypodium distachyon
gaagcctccatctaacagaagagccgacgagagccactcctcgcgccgccctcccttcgtcctcacccctccccaaaccctagaccagcaggcggatagtcgatcgatcggcgaccatgagtaagttgcagactgaggcccttaaggaggccatcacccaggttgtcacggaggccaaggagaagaatagaaagtttacggagaccgttgaactccagatcggtctcaagaactatgacccgcaaaaggacaagcgtttcagcggctctgttaagctgccccatgtccctcgcccaaagatgagggtctgcatgcttggtgatgcacagcatgtgggggaggctgagaagattggtcttgattccatggatgttgaagctcttaagaagatgaacaagaacaagaagcttgtcaagaggcttgccaagaagtatcatgctttcttagcttcagaggctatcatcaagcagattccccgtctccttggtcctggtctcaacaaggcaggcaagttccctactctggtttctcaccaggaatctctggaagccaaggtaaacgagacgaaagctacaatcaagttccagctgaagaaggtgctttgcatgggtgtcgcagtgggtaacctttccatggaggagaagcagatccagcaaaacatccagatgagcgtcaacttcctggtttccctgcttaagaagaattggcaaaacgtcaggtgcctgtacatcaagagcaccatggggaagccggttcgggtgttctaagtccttgcctctgcctagaatcaatattaccatagtggactttcttactatgtctgtgcttaaatatgtcgcagttttatcaaatgtgtgcgtgccctgatgaacatgatggaataaactagcagtattacttttttgg

SEQ ID NO: 1058 - DNA, 1237 bp, Brachypodium distachyon
ggctgtcagcaacccgcggagcagatccatccgccatctctctcttccccagctcccccgattcccgaagcctccatctaacagaagagccgacgagagccactcctcgcgccgccctcccttcgtcctcacccctccccaaaccctagaccagcaggcggatagtcgatcgatcggcgaccatgagtaagttgcagactgaggcccttaaggaggccatcacccaggttgtcacggaggccaaggagaagaatagaaagtttacggagaccgttgaactccagatcggtctcaagaactatgacccgcaaaaggacaagcgtttcagcggctctgttaagctgccccatgtccctcgcccaaagatgagggtctgcatgcttggtgatgcacagcatgtgggggaggctgagaagattggtcttgattccatggatgttgaagctcttaagaagatgaacaagaacaagaagcttgtcaagaggcttgccaagaagtatcatgctttcttagcttcagaggctatcatcaagcagattccccgtctccttggtcctggtctcaacaaggcaggcaagttccctactctggtttctcaccaggaatctctggaagccaaggtaaacgagacgaaagctacaatcaagttccagctgaagaaggtgctttgcatgggtgtcgcagtgggtaacctttccatggaggagaagcagatccagcaaaacatccagatgagcgtcaacttcctggtttccctgcttaagaagaattggcaaaacgtcaggtgcctgtacatcaagagcaccatggggaagccggttcgggtgttctaagtccttgcctctgcctagaatcaatattaccatagtggactttcttactatgtctgtgcttaaatatgtcgcagttttatcaaatgtgtgcgtgccctgatgaacatgatggaataaactagcagtattacttttttggcagtgtttttgtttttcgtcgaccagatattatcgaacaatgtgctcaagattatactctaccggtacctgatatatacgtcgtggatgctgtgtcgcttgtgctgtttatctacggtgcaatctgtctgatcgagtgattgtgatactggcttagtgcctatgttgggtcgatgcatcggaatatacagatgatatctgcatggcaagcactcacttcgggcttgtttggaaccttcaatgatatttcgttttggattagttca

SEQ ID NO: 1059 - DNA, 1167 bp, Hordeum vulgare
tcatctcaccgtgtttcttcccccctttccccgcaggtgaatcggcgacaggcgaatcgacccaccccacccccccgcggcgagccatgagtaagctgcagactgaggccctcaaggaggccatcacccaggtggtggcggatgccaaggagaagaacaggaagttcactgagaccgttgagctccagatcggcctcaagaactatgatccgcaaaaggacaagcgtttcagcggctccgtcaagctgccccatgtccctcgccccaagatgagggtctgcatgcttggtgatgcccagcacgtgggagaggctgaaaagattggtctggattccatggacgttgaagctcttaagaagatgaacaagaacaagaagcttgtcaagaggcttgccaagaagtaccatgctttcttggcctcagaggctattatcaagcagattccacgtctccttggtcctggtctcaacaaggcaggaaagttccccactctggtttctcaccaggagtctctggaagccaaggtgaatgagacgaaagccacaatcaagttccagctcaagaaggtgctgtgcatgggtgtcgctgttggcaacctgtcgatggaggagaagcagatccagcagaacatccagatgagcgtcaacttcctggtttccctgctcaagaagaactggcagaatgtgaggtgtctgtacatcaagagcaccatggggaagcctgtccgggtgttctaagctcgtgcccctgcccgcccgtctatatcgatgctacctccaatactggacctccttactatgttcatgcttaaatatgtcagtgtcgtgtcgtagtttttatcgaattttgcacgtgtcctggtgaatgaagatgatgaaagactgctgctgtttctcctaagttgccattctgatggaacaatatgctcatcaagatcatgcgagaaccggttatataatatgttgtggatgaaagttgtgtaccctcatatgcttgtccacgatgcaatctgtttgttgccgtgcctttttagttcatattttcacatatgtagggcgcgaataacttaagagtgctgcaaaacttgacgcttctaactgctccttgatctggcaaaactatgtacagtaatgtaagctgttttgtgaatttgaactgcaaaaacgt

SEQ ID NO: 1060 - DNA, 839 bp, Cynodon dactylon
ctcatcccacatataaccatccgcgccgccgccgccgccgccgcttctgcgtcttctctcttgctcctttgttcgcctcgcgcccagtcctccagggagttgagcggtagatttgccaccatgagtaagttgcaaaccgaggttctcaaggatggcatccccaatgtcctccaggatgcccaggagaagaacaggaagttccctgagaccattgagcttccgattggtccccagaactatgacccccagaaggacaagcgattcagcggctctgttaagctgccccatatcccccgcccaaagatgaaggtgtgcatgcttggtgatgcccagcatgtggaggaggctgagaagatggggcttgactacatggatgtcgaagctctcaagaaaatgaacaagaacaagaagctcgttaagaagcttgccaagaagtaccacgctttcttagcatcagaggccatcatcaagcagattccccgtctccttggtcccggtctgaacaaggcaggcaaattccctacactggttactcaccaggagtctcttgaatccaaggtcaacgagacaaaagccacggtcaagttccagctgaagaaggttctttgcatgggtgttgctgtgggcaacctatcgatggaggagaagcagatccagcagaacatccagatgagcgtcaacttcctcgtgtcccttctgaaaaagaactggcagaatgtgaggtgcctgtacatcaagagcaccatggggaaaccgtaccggttgttctaagttcttgtgaagttgatcagatactgggccctttgaactgagcttgtcttaaaacctagatatgttga

SEQ ID NO: 1061 - DNA, 1042 bp, Leymus cinereus x Leymus triticoides
  misc_feature (153)..(153): n is a, c, g, or t
  misc_feature (163)..(163): n is a, c, g, or t
  misc_feature (312)..(312): n is a, c, g, or t
  misc_feature (321)..(321): n is a, c, g, or t
  misc_feature (327)..(327): n is a, c, g, or t
  misc_feature (1030)..(1033): n is a, c, g, or t
ctccactcctccccaaaccctagaccaggcaggtcctcgctccccgccctctagcctcgtcgccccggcgagacccctctcgagttcccgctccccgccgccggtcatctcaccgtgtttctccctttctccgcaggtgaatcggcgaccggngatccatctncgcggcgagccatgagtaagctgcagaccgaggccctcaaggaggccatcacccaggtggtggcagaggccaaggagaagaacaggaagttcaccgagaccgtcgagctccagatcggcctcaagaactatgacccgcaaaaggacaancgtttcagnggctcngtcaagctgccccacgtccctcgccccaagatgagggtctgcatgctcggtgatgcccagcatgtgggagaggctgataagattggtcttgattccatggatgttgaagctcttaagaagatgaacaagaacaagaagcttgtcaagaggcttgccaagaagtaccatgctttcttggcctcagaggctatcatcaagcagattccacgtctccttggtcctggtctcaacaaggcaggcaagttcccgactctggtttctcaccaggagtctctggaagccaaggtgaacgagacgaaagcgacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagcccgtgctcctgccgtcgtctatatcaatgctacctacaatactggacttcattactatgtttaagcttaaatatgtcggtgtcgtgtcggtagtttttcttgaattttgcgtgtttcctggtgaagatgacgaaagaccactactgtttctcctgagttgtgattgtgatgcaacaaatatgctcatcaagatcatgccagannnnggttatata

SEQ ID NO: 1062 - DNA, 987 bp, Zea mays
ataagctcatataacaacatccgtcgccgccgtttccatcccattttctctcctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatcaagcaaattccccgtctccttggtcctggtctcaacaaggcaggcaagttccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccagatgagcatcaacttcctcgtgtctcttctgaagaagaactggcagaatgtaagatgtctctacatcaagagcaccatggggaaaccattcaggattttctaagtctgtttttttgtgaagtctgctctttatgatatttggtttttgaaccgaggttgtcttgaactaaaactcttgttagatcatgtttggttggtaggatatttgagtctgggcaggtgtcttactcttgcgccatgtctttgtaatctctctatataagttttttgagaggctcagtataatatgcgtattatacgttatacccaatcgtttctgttactgtgga

SEQ ID NO: 1063 - DNA, 1029 bp, Pseudoroegneria spicata
ctccactcctccccaaaccctagacacaccaggtgaatcggcgaccggcgatccatctccgcggcgagccatgagtaagctgcagaccgacgtcctcaaggaggccatcacccaggtggtggcggatgccaaggagaagaacaggaagttcactgagacggtcgagctccagatcggtctcaagaactacgacccgcaaaaggacaagcgtttcagtggctccgtcaagctgccccacgtccctcgccccaagatgagggtctgcatgctcggtgacgcccagcatgtgggagaggctgagaagattggtcttgatgccatggatgttgaagctcttaagaagatgaacaagaacaagaagcttgtcaagaggcttgccaagaagtaccatgctttcttggcctcggaggctatcataaagcagattccacgtcttcttggtcctggtctcaacaaggcaggcaagttcccgactctggtttctcaccaggagtctcttgaagccaaggtcaacgagacgaaagcaacaatcaagttccagctcaagaaggtgctgtgcatgggcgtcgccgtgggcaacctgtcgatggaggagaagcagatccagcagaatatccagatgagcgtcaacttcctggtttccctgctcaagaagaactggcagaacgtgaggtgcctgtacatcaagagcaccatggggaagccggtccgtgtgttctaagcctgtacccctgccgtccgtctatatcgatgctacctagaataccggacttactatgtttacgcataaatgtcagtgtcgtgtctgtagtttttatcgaattttgcgcgtgccctggtgaagatgacagaaagaccactactgtttctcttgagttgtgatgccgctggagcaatatgctcatcaaaatcatgccagaacctgttatatatatatatatgctgtggatgcatgttgtgtaccctgtatgtttgcccacgatgcgatctgtttgtcttcgtggctttctagtccaatctttaacttca

SEQ ID NO: 1064 - DNA, 761 bp, Avena sativa
cctccattcctcctcccccaaaccctaaaccaggtggatcggtgatcgtccgtcgtcggcaaccatgagtaagctgtcgaccgaggccctcaaggaggccatcacccaggtcgtgtccgaagccaaggagaagaacaggaagtttaccgagaccatcgagctccagatcggcctcaagaactacgacccgcaaaaggacaagcgtttcagcggctccgtcaagctaccccatgtcccgcgccccaagatgagggtctgcatgctcggtgatgcccagcatgtgggggaggctgagaagattggacttgactccatggatgttgaagctcttaagaagatgaataagaataagaagcttgtcaagaggcttgccaagaagtatcatgctttcttggcctcagaggctattatcaagcagattccccgtcttcttggccctggtctcaacaaggcaggcaagttcccgactcttgtttctcactcggagtctctggaagccaaggtgaacgagacgaaggccaccatcaagttccagctgaagaaggtgctgtgcatgggcgtcgcggtgggcaacctgtcgatggaggagaagcagatccagcagaacatccagatgagcgtcaacttcctggtctccctgctcaagaagaactggcagaacgtgaggtgcctgtacatcaagagcaccatggggaagccgtcccgggtgttctaagcccgtgctgctgcaagtctttcatcagcagtagcttaccatagtt

SEQ ID NO: 1065 - DNA, 1010 bp, Leymus cinereus x Leymus triticoides
ggtttctagagacgagagccactcctcctcgcgccgcccctccactcctccccaaaccctagtagaccaggtgaatcggcgacaggtgaatcgatcgatcttcgcggccagccatgagtaagctgcagaccgaggccctcaaggaggccatcacccaggtggtggcggaggccaaggagaagaacaggaagttcactgagaccgtcgagctccagatcggcctcaagaactatgatccgcaaaaggacaagcgtttcagcggctccgtcaagctgccccacgtccctcgccccaagatgagggtctgcatgctcggtgacgcccagcatgtgggagaggctgacaagattggtcttgattccatggatgttgaagctcttaagaagatgaacaagaacaagaagcttgtcaagaggcttgccaagaagtaccatgctttcttggcctcggaggctgtcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagcctgtgcccatgccgtccgtctatatcaatgctacctacaatactggacttccttactatgttcatctttaagtatgtcggtgtcgtgtcgtagtttttattgaattttgcgagtgtcctggtgaatgaagatgaaggaagagtactactgtttctcctgagttgtgattctgatggaacaatagctcatcaagatcatgccagaatctgttatataatatgttgtggatgcatgttgtgtgcca

SEQ ID NO: 1066 - DNA, 1016 bp, Ananas comosus
ctcttccgtagattagggtttctctcctcccaggcaaaagagaagtaggggaaatatcttccacagaggagaagaatcatgagcaagttgcagagtgatgcgctgaaagaggccatctctcaggttgttggtgattctcgagagaagaagcgcaagttcacagagactgttgagttgcagattgggctaaaaaactatgaccctcagaaggataagcggttcagcggctctgtgaagttgcctcatatcccacgcccaaagatgaaggtttgcatgcttggcgatgctcagcacgtggaagaggctgaaaaaattgggttggactacatggatgttgaagggctcaaaaagatgaacaaaaataagaagttagtgaagaagcttgccaagaaatatcatgctttcctagcatccgaggctataattaagcagattcctcgacttcttggtcctggactcaacaaggcaggcaaattccccacattggtcacacatcaggaatccttagaggccaaagttaatgagaccaaagcaacggtgaagtttcaactgaagaaggttctttgcatgggagttgctgttgggaattgcggaatggaggagaaacagattcagcaaaatgtgcaactcagtgtcaactttctggtctctctgttgaaaaagaattggcaaaacgtgagatgcttgtacctgaagagcactatgggcaagccgtatcgcgtgttctgagaagcttttgttctgttttgacattcaggatgttggaggggaatactcaaacctctttttcaattccttcatctattcctaggattgcaatttgaagctttaatttctctttcctggatttgattatcttgtttcattctgctagtcagatgcttttgtttttcgttgacatgttgctactcaagtatcaggagtggttttttttttttatcaaaatgtttaatttaagctacgtgatcagaaattggttgtgaaacatcaaattcactagtatttggatttggatt

SEQ ID NO: 1067 - DNA, 981 bp, Triticum aestivum
cgcgccgcaccctccccaaaccctaaccaacaccaggtaaggcccccgccgtcgatctctctccccgccgccgctcatctcattctcaccgcgttctccctctgcccgccgaccggcgacagccatgagtaagctgcagaccgacgccctcaaggaggccatcacccaggtggtggcggacgccaaggagaagaacaggaagttcaccgagaccgttgagctccagatcggcctcaagaactatgatccgcaaaaggacaagcgtttcagcggctctgtcaagctgccccatgtccctcgccccaagatgagggtctgcatgctcggtgacgcccagcatgtgggagaggctgaaaagattggtcttgattccatggatgttgaagctcttaagaagatgaacaagaacaagaagcttgtcaagaggcttgccaagaagtaccatgctttcttggcctcagaggctatcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgcctgtacatcaagagcaccatggggaagccggtccgtgtgttctaaagcctgtacccctaccgcccatctatatcaatgctacctagaatactggacttccttactatgtttacgcataaatatgtcggtgtcgtgtcgtagtttttatcgaattttgcgcgtgcctggtgaagatgacagaacgaccactacggtttctcttgagttgtgattcggctggagtgatgtgctcatcgaaatcatgccagaac

SEQ ID NO: 1068 - DNA, 1002 bp, Secale cereale
gccgccgccgctccccaaaccctagaccagccaggtgaatcggcgaccggcgaatcgacccgtcccggccggtcgagccatgagtaagctctcgaccgaagccctcaagggaggccatcacccaggtggtggcggatgccaaggagaagaacaggaagttcaccgagacggtcgagctccagatcggcctcaagaactacgacccgcaaaaggacaagcgtttcagtggctccgtcaagctgccccatgtccctcgccccaagatgagggtctgcatgcttggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgtctccttggtcctggtctgaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttatggccaaggcctcctgacactatttatggtcatattgtgaacattaaccaaaaaaattgtaattgtttcaaaaaattctgaatatttgtgtggatgtctgtgttactgtcgcaagtatgcttgacaattttcatgtgagaaggagcagtagtgttttgtcggtgaataaaaatacaaatttaggg

SEQ ID NO: 1069 - DNA, 1329 bp, Zea mays
atggacagcgacgccgccgcgatctgtggccacggcgtgggcaccacggcggacggtgacctctgcaccttttgtggcttccccatgtgtcgcccctgctacgagtacaatcgcgaggatgacacccaggtgtgcccgcagtgcaagaccaacaagcgccaccaagtagcaacatcctcgttgttggtctcgaggcttgtgccagcacttcctccactgcccgaagcagcttcctcacttaccaacagcaaatccttcgactcgttcggagaacttctccgtttcctctttgtgttcttcgccgcaaatgctatggcctcctttgatacccaacaatacatgtctgtcatatgcgtacgtcgagagcaactaagagtcactcgtgtgacaaaacattgcttacgttacgtcagccaggcctcatatgtttccattaagttgcagtctgaggttctcaaggatgccatctcccagatagttcaagatgccaagaagaataggaagttcactgagactgttgagcttcagattagtctgaagaattatgatccacaaaaggacaagcgtttcagtggctctatgaagttgcctcacatccctcatccaaagatgaaggtgtgcatgcttggtgatgcccagcacgttgaggaggctgagaagatgggacttgactacatggatgttgaggccctcaagaaaatgaacaagaacaagaagcttgttaagaagcttgccgagaaataccatgcttttttggcatcagagaccatcatcaagcaaattccccgtctccatggtcctggtctcaacaaggcaggcaagttccccactctggtcactcaccaggaatccctggaatccaaggtgaatgagacgaaggctacagtcaagtttcaactgaagaaagtcctttgcatgggtgtcgtggttggtaacctgtctatggaggagaagcagatccaacagaacatccagatgagcgtcaacttcctcgtgtctcttctgaagaaaaactggcagaatgtaagatgcctctacatcaagagcaccatggggaaaccatgcagggtgttctaagtctgcttttttgtgaagtctgctcttcatgatatttggtttttgaaccgaggttgtcttgaactaaaactcttgttagatcatatttggttggcaggatatttgagtccgggcaggtgttttccccttgtctttgtaatctctctatataatgttttttgagaggctcagtataatacgtgtattatacgttataccaattatacgttatacccaatcgtttttgttactgtggaaccatgagtttacgcc

SEQ ID NO: 1070 - DNA, 1066 bp, Secale cereale
ctccatccaggcgccgaatccagcggccgccacgccacccctctccccccaaagcctggggtttccacagaccacgagagccacagccattcctcctcctcctcctgccgccgccgctccccaaaccctagaccagccaggtgaatcggcgaccggcgaatcgacccgtccgtccccgcggcgagccatgagtaagctatcgaccgaagccctcaaggaggccatcacccaggtggtggcggatgccaaggagaagaacaggaagttcaccgagacggtcgagctccagatcggcctcaagaactacgacccgcaaaaggacaagcgtttcagcggctccgtcaagctgccccatgtccctcgccccaagatgagggtctgcatgctcggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgactccttggtcctggtctgaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttgtagtttttatcgaattttgcgcgtgtcctggttaatgaagatgatgaaagaccactactgtttcccctgagttgtgattccgatggaacaatatgctcatcaagatcattccagtacccgttatatataatgttgtggttgc

SEQ ID NO: 1071 - DNA, 1025 bp, Secale cereale
ttggggggggtttccacagaccacgagagccacagccactcctcctcctcctgccgccgccgctccccaaaccctagaccagccaggtgaatcggcgaccggcgaatcgacccgtcccggcggtgagccatgagtaagctctcgaccgaagccctcaaggaggccatcacccaggtggtggcggatgccaaggagaagaacaggaagttcaccgagacggtcgagctccagatcggcctcaagaactacgacccgcaaaaggacaagcgtttcagtggctccgtcaagctgccccatgtccctcgccccaagatgagggtctgcatgcttggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgtctccttggtcctggtctcaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttgtagtttttatcgaattttgcgcgtgtcctggttaatgaagatgatgaaagaccactactgtttcccctgagttgtgattccgatggaacaatatgctcatcaagatcattccagtacccgttatatataatgttgtggttgcatgtttaaaaaaaaaaa

SEQ ID NO: 1072 - DNA, 926 bp, Secale cereale
aatcggcgaaccggcgaatcgacccgtccgtccccgcggcgagccatgagtaagctatcgaccgaagcactcaaggaggccatcacccaggtggtggcggacgccaaggagaagaacaggaagttcaccgagaccgtcgagctccagattggcctcaagaactatgacccgcaaaaggacaagcgtttcagcggctccgtcaagctgccccatgtccctcgccccaagatgagggtctgcatgctcggtgacgcccagcatgtgggagaggctgacaagattggtcttgattccatggatgttgaagctcttaagaagatgaacaagaacaagaagcttgtcaagaggcttgccaagaagtaccatgctttcttggcctcggaggctatcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggtaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagctcgtgccccagccgccctatatcgatgctacctacagtactggacctccttactatgttcaagcttaaatatgtctacttgtcgtagcttttatcgaattttgtgcgtgtcctggttaatgaagatgatgaaagaccactactgtttcccctgagttgtgattccgatggaacaatatgctcatcaagatcattccagtacccggttatatataatgttgtggttgca

SEQ ID NO: 1073 - DNA, 909 bp, Secale cereale
ccgtcccggcggtgagccatgagtaagctatcgaccgaagccctcaaggaggccatcacccaggtggtggcggacgccaaggagaagaacaggaagttcaccgagaccgtcgagctccagatcggcctcaagaactacgacccgcaaaaggacaagcgtttcagcggctccgtcaagctgccccatgtccctcgccccaagatgagggtctgcatgctcggtgacgcccagcatgtgggagaggctgacaagattggtcttgattccatggatgttgaagctcttaagaagatgaacaagaacaagaagcttgtcaagaggcttgccaagaagtaccatgctttcttggcctcggaggctatcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggtaacctgtcgatggaggagaagcagatccagcagaatatccagatgagcgtcaacttcctggtttccctgctcaagaagaactggcagaacgtaaggtgtctgtacatcaagagcaccatggggaagccggtccgtgtgttctaagctcgtgccccagccgccctatatcgatgctacctacagtactggacctccttactatgttcaagcttaaatatgtctacttgtcgtagcttttatcgaattttgcgcgtgtcctggttaatgaagatgatgaaagaccactactgtttcccctgagttgtgattccgatggaacaatatgctcatcaagatcattgcagtacccattatatataatgttgtggttgcatgttttgtact

SEQ ID NO: 1074 - DNA, 984 bp, Secale cereale
cctctcccccaaagcctggggtttccaccgaccacgagagccacagccattcctcctcctcctcctgccgccgccgctccccaaaccctagaccagccaggtgaatcggcgaccggcgaatcgacccgtccgtccccgcggcgagccatgagtaagctatcgaccgaagccctcaaggaggccatcacccaggtggtggcggacgccaaggagaagaacaggaagttcactgagacggtcgagctccagatcggcctcaagaactacgacccgcaaaaggacaagcgtttcagtggctccgtcaagctgccccatgtccctcgccccaagatgagggtctgcatgcttggtgatgcccagcatgtgggagaggctgacaagattggtcttgattccatggatgttgaagctcttaagaagatgaacaagaacaagaagcttgtcaagaggcttgccaagaagtaccatgctttcttggcctctgaggctattatcaagcagattccacgtctccttggtcctggtctgaacaaggcaggaaagttcccgaccctggtttctcaccaggagtctctggaagccaaggtgaacgagacgaaagccacaatcaagttccagctcaagaaggtgctgtgcatgggcgtcgccgtgggcaacctgtcgatggaggagaagcagatccagcagaacatccagatgagcgtcaacttcctggtttccctgctcaagaagaactggcagaacgtgaggtgtctgtacatcaagagcaccatggggaagcccgtccgggtgttctaagctcgtgccccagccgccctatatctatgctacctacagtactggacctcctttctatgttcaagcttaaatatgtctactttttgtagtttttatcgaattttgcgcgtgtcctggttaatgaagatgatgaaagaccactactgtttcccctgagttgtgattccgatggaacaatatgcgcat

SEQ ID NO: 1075 - DNA, 1090 bp, Musa acuminata
gcaccagggccaccgttcccctccgccgccgccgtagtcgttccactctcgcagaggtcctggtctgaggccggcaagagaagctcgtctaaacaatgagcaagttgcagagtgatgtcctgagggaagcaatctcccaggttgttggtgattctcgggagaaaaagcgtaaattcactgaaacagtagagttacaaattgggctgaaaaattatgaccctcaaaaggacaagaggttcagtgggtctgtgaaattaccccatattcctcgtcccaaaatgaaggtgtgcatgcttggggatgctcaacatgtcgaggaggcagagaagataggactggactacatggatgttgaaggtttaaaaaagatgaacaagaataagaagctggttaagaaacttgctaagaagtaccatgctttcctagcatcggaggctatcatcaagcaaatccctcggctccttggacctggtcttaacaaggcagggaagtttcccacactggttactcaccaggaatcattggagtcaaaggttaatgagacaaaagcgatggtgaaatttcaactcaagaaagttctttgcatgggtgttgcagtgggaaattgcacgatggaggagaagcagatctttcagaatgttcagctcagcgtgaattttcttgtgtccttgctgaagaagaatttgcaaaacgtgaggtgcttgtacctgaagagcaccatggggaagccaaaccgagtgttctaactggctgctggtgatggttgatgaaatggaagttctacgctctttctcacatatttgatttatcaagcaccaatgaagaaaactgagaataccaatcaaaattttgcttatcaagcgatgcagaaagatgggagtgtttgaacaccatcaaagtgtgttcttaatgtcttgacagactttgtgcatctgatgctttcttgtggatttttctggcttctctgtgtattattattccctactgaaccatttagtttgtgtgttatcccatgaaagtggaacgatattaactttacaaacatttaattatatctatatacaataaattaatcaatattttcttatat

SEQ ID NO: 1076 - DNA, 952 bp, Avena sativa
cctccattcctcctccccaaaccctaaaccaggtggatcgtcgttcatcgatcggaagcagccatgagtaagctgtcgaccgaggccctcaaggaggccatcacccaggtcgtgaccgaagccaaggagaagaacaggaagttcaccgagaccatcgagctccagatcggcctcaagaactacgacccgcaaaaggacaagcgtttcagcggctccgtcaagctgccccacgtcccgcgccccaagatgagggtctgcatgctcggtgacgcccagcatgttggggaggctgagaagattggtcttgattccatggatgttgaagctcttaagaagatgaacaagaacaagaagcttgtcaagaggcttgccaagaagtatcatgctttcttggcctcagaggctattatcaagcagattccccgtctccttggtcctggtctcaacaaggcaggcaagttcccgactctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcgcgggttttctaagcttgtgctgctgccatctatctatcatcagcagtagcttaccatagttccttccttccttgccgtgtttacgcttaaatatgccgtggtttttgtcagctttgtctttgtgtgtcctggtcctagtgatggagatgaaagaatctggcagtagtgtttttgtttggacaagatccgatggctctgctcctcaagatatcgtgttagaacctgttacaaatatatttatgtatgctat

SEQ ID NO: 1077 - DNA, 887 bp, Avena sativa
cctccattcctcctccccaaaccctaaaccaggtggatcgtcgttcatcgatcggaagcagccatgagtaagctgtcgaccgaggccctcaaggaggccatcacccaggtcgtgaccgaagccaaggagaagaacaggaagttcaccgagaccatcgagctccagatcggcctcaagaactacgacccgcaaaaggacaagcgtttcagcggctccgtcaagctgccccacgtcccgcgccccaagatgagggtctgcatgctcggtgacgcccagcatgttggggaggctgagaagattggtcttgattccatggatgttgaagctcttaagaagatgaacaagaacaagaagcttgtcaagaggcttgccaagaagtatcatgctttcttggcctcagaggctattatcaagcagattccccgtctccttggtcctggtctcaacaaggcaggcaagttcccgactctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtttccctgctcaagaagaactggcagaacgtgaggtgcctatacatcaagagcaccatggggaagccggcgcgggttttctaagcttgtgctgctgccatctatctatcatcagcagtagcttaccatagttccttccttccttgccgtgtttacgcttaaatatgccgtggtttttgtcagctttgtctttgtgtgtcctggtcctagtgatggagatgaaagaatctggcagtagttgttttgtttggacaaga

SEQ ID NO: 1078 - DNA, 915 bp, Avena sativa
cctccattcctcctcccccaaaccctaaaccaggtggatcgtcgttcatcgatcggaatcaaccatgagtaagctgtcgaccgaggccctcaaggaggccatcacccaggtcgtgaccgaagccaaggagaagaacaggaagttcaccgagaccattgagctccagatcgggctcaagaactacgacccgcaaaaggacaagcgtttcagcggctctgtcaagctgccccatgtcccgcgccccaagatgagggtctgcatgctcggtgacgcccagcatgttggggaggctgagaagattggtcttgattccatggatgttgaagctcttaagaagatgaacaagaacaagaagcttgtcaagaggcttgccaagaagtatcatgctttcttggcctcagaggctattatcaagcagattccccgtctccttggccctggtctcaacaaggcaggcaagtttccgactctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtctccctgctcaagaagaactggcagaacgtgaggtgcctatacatcaagagcaccatggggaagccggcccgggtgttctaagcccgtgctgctgccgtctatctatcatcagcagtagcttaccatagtttccttccttgctgtgttgacgcttaaatatgccgtggtttttgtcagctttgtctttgtgtgtcctggtcctggtgatggagatgaaagaatctggcagtagtgtttttgcttggacaagaacctgttacaaatatatttatgtattctat

SEQ ID NO: 1079 - DNA, 924 bp, Avena sativa
tgcgccgccgccatccattccccctccccaaaccctaaaccaggtggatcgtcgttcatcgatcggaatcaaccatgagtaagctgtcgaccgaggccctcaaggaggccatcacccaggtcgtgaccgaagccaaggagaagaacaggaagttcaccgagaccattgagctccagattgggctcaagaactacgacccgcaaaaggacaagcgtttcagcggctctgtcaagctgccccatgtcccgcgccccaagatgagggtctgcatgctcggtgacgcccagcatgttggggaggctgagaagattggtcttgattccatggatgttgaagctcttaagaagatgaacaagaacaagaagcttgtcaagaggcttgccaagaagtatcatgctttcttggcctcagaggctattatcaagcagattccccgtctccttggccctggtctcaacaaggcaggcaagtttccgactctggtttctcactcagagtctctggaagccaaggtgaacgagacgaaggccaccatcaagttccagctgaagaaggtgctgtgcatgggtgtggcggtgggcaacctgtcgatggaggagaagcagatccagcagaacatccagatgagcgtcaacttcctggtctccctgctcaagaagaactggcagaacgtgaggtgcctatacatcaagagcaccatggggaagccggcccgggtgttctaagcccgtgctgctgccgtctatctatcatcagcagtagcttaccatagtttccttccttgctgtgttgacgcttaaatatgccgtggtttttgtcagctttgtctttgtgtgtcctggtcctggtgatggagatgaaagaatctggcagtagtgtttttgcttggacaagaacctgttacaaatatatttatgtattcta

SEQ ID NO: 1080 - DNA, 1043 bp, Triticum aestivum
gccgcccctccccaaacccaaaccctaggccgcaccaggtgaaccggcgcccggtgagtcggtccgtccccgcggcgagccatgagtaagctatcgaccgacgcactcaaggaggccatcacccaggtggtggcggatgccaaggagaagaacaggaagttcaccgagaccgtcgagctccagatcggcctcaagaactacgacccgcaaaaggacaagcgtttcagcggctccgtcaagctgccccacgtccctcgccccaagatgagggtctgcatgctcggtgacgcccagcatgtgggagaggctgaaaagattggtcttgattccatggatgttgaagctcttaagaagatgaacaagaacaagaagcttgtcaagaggcttgccaagaagtaccatgctttcttggcctcggaggctatcatcaagcagattccacgtctccttggtcctggtctcaacaaggcaggaaagttcccgaccctggtttctcaccaggagtctctggaagccaaggtgaacgagacgaaagcgacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagctcgtgcccctgccgccctatatcaatgctacctacagtactggacctccttactatgttcaagcttaaatatgtctacttgtcgtagtttttatcgaattttgcgcgtgtcctggttaatgaagatgatgaaagaccactactgtttcccctgagttgtgattctgatggaacattatgtttcatcaagatcattccagtacctgttatatataatgttgtggttgcatgttttgtacccttgtatgtttgtcgggtctctgacgcatctgtttgccgtcgtgcctttctatatgactagcataacttg

SEQ ID NO: 1081 - DNA, 940 bp, Musa acuminata
gggtcctcttgctgctgccgccgcctcgcggagttctcggtttgaaggagggacgagatacttatctgaacaatgagcaagctacagagtgatgtcttgagggaagctatttcccaggttgttggtgattctcgggagaagaagcgtaaatttacagaaactgttgagttacaaattgggctgaaaaattatgatcctcaaaaggacaaacgattcagcggatctgtgaagctacctcatattcctcgcccaaaaatgaaagtgtgcatgcttggtgatgctcaacatgttgaggaggcagagaagataggattggattatatggacgttgagagtttgaaaaagatgaacaaaaataagaagttggtaaaaaaacttgctaagaaatatcatgctttcctggcatcagaagctattatcaagcagattcctcgtctccttggccctggtcttaacaaggcagggaaatttcccacattggttacccaccaagaatctttggaggcaaaagttaatgagacaaaggccatggtgaagtttcaactcaaaaaggttctttgcatgggcgtagcagtgggcaactgtgcaatggaggagaagcagatctttcaaaacgtgcaactcagtgtcaatttcctagtgtctttgctgaagaagaactggcaaaacgtgaggtgcttgtacctgaagagtacaatggggaagccatacagagtattctaattgcgctacttcaaagttacgtgctagaattttgtctatgaagcaagtatggaaagatctgagggtaccaaagccattacagaactgtcttctatcaagtctccaatcgaactatttgtttattaagcagtgtcttctactgtgagagacattcttgtttgacttacagtatcatgttttgacttacattcccagtttgatcacttcatttcgttga

SEQ ID NO: 1082 - DNA, 854 bp, Musa acuminata
cttcccctcactctcgctgtctcggatcggaggaggggaccgatacacatccgaacaatgagcaaattgcagagtgatgttttgagggaagcaatctcccaggttgttggtgattctcgggagaagaaacgaaaattcactgaaacagttgagttgcaaattgggctgaaaaactatgatcctcaaaaggacaagcgattcagtggatccgtgaaactacctcacattccacgtccgaaaatgaaggtctgcatgctcggagatgctcaacatgttgaggaggcagagaaaattggccttgattatatggatgttgaaagtttgaaaaagatgaacaaaaacaagaagctggttaaaaagcttgcaaagaaataccatgctttcctagcatcagaggccatcatcaaacagatccctcgtcttcttggccctggtcttaacaaggcagggaaatttcccacactggttactcaccaagaatctctagaggctaaagttaacgagacaaaagcaatggtgaaatttcaactcaagaaagttctttgcatgggcgtggcagtgggtaactgtgccatggaggagaagcagatctttcagaacgttcaactcagcgtaaatttcctcgtgtctttgctgaagaagaattggcaaaatgtgagatgcttgtacctgaagagcaccatggggaagccataccgagtgttctaatcggctgatcgatgaattggaaattctactttcttttccaatttctagtttttttgtttattttgcagtattaaaggactgaggttatcaagttaggcatgtttggtgcagccaccgatgagatacttagcttttattgcatcggt

SEQ ID NO: 1083 - DNA, 979 bp, Musa acuminata
ggaatctttaatcgcgttctagttcgccgtgtaatcttttctgctgcgtgctagatctgtttgcttcgttcttggtttgaaggagggaagaggctctcgactaaagaatgagcaagttacagagtgatgtcctgagggaagcaatctcccaagttgctggtgattctagggagaagaaacgtaaattcactgaaacagtggagttgcaaattgggctgaaaaattatgatccccaaaaggacaagagattcagtggatctgtgaagctaccccatattcctcgccctaaaatgaaggtttgcatgcttggagatgctcaacatgtggaggaggcagagaagataggacttgactacatggatgtggaaggcttaaaaaagatgaacaaaaacaaaaagttggttaaaaaacttgcaaagaagtaccatgcttttcttgcatcagaggctattatcaaacagatccctcgtctccttggccctggtcttaacaaggcagggaagtttcctacattggttactcaccaggaatctttggagtctaaagttaacgagacaaaagcaatggtaaaatttcaacttaagaaagttctttgcatgggagttgctgtgggcaactgtgcgatggaggagaagcagatctttcagaatgtgcagctcagcgtgaatttccttgtgtctttgttgaagaagaactggcaaaatgtcaggtgcttgtacctgaagagcaccatgggaaagccgtatcgagtgttctaagcagctcctttgccccggctggtgaaggatgaaatagattgttgctgtcgcattcccttttcttttgtttatcaagcagtatggaaggactgagggtattaagccctttcgaagatcctatttcgtcattttaatcaaaattttgttatttgagccctgtggacggagggtgtcaacacctgcaaattagttggtttctgttgttacggaagagacggttc

SEQ ID NO: 1084 - DNA, 1753 bp, Zea mays
ccgatcccgccgccgacgcaacctacgggccacatggcgctcgagctgccgcgcaacccctcctccgcgcgagccgcagccggcccccgctcgcgtccccgtcgcctatactgcgtcgccccaccgcccacgcctcaaccgccctgaccccggcgcattctcctctcggtgccgactgccgagatctccctgggggagaggcgtgcccgctcttgacccgacgtccgcgatgacggtggcggctctgcaggcgatggacgcgctgtcgcggtgggggaccatgctgcgggactctgcggcgaagccaagggaacacggacaacatggtcaccatcctcggctccttcgaccaccgcctctccgcgctcgaggccccttgctccaccgtgcatttcaacatgaaatttgggttgagttcaatctggaacacatgtggaaaagcccaaatggcacaactaggaacattataaatgttcatatttttccttgcatgattaaccccctaattaagaaggctgaagaaactactttgatatctgacattgttgtagatttagcacacaagatttttatagagggcattgctagggtgatctcatctgggacgatgtgcaacagggaagggcggggagccgactgcttcgaccgagacatcaccagcttggaagagtgcccaagggtaatggaggagttgttggcggtctcgcttaggtgtatccctcctgtaaatgagaggcctaacatgaagccagtctgcgatgacctgtgctccataacagtccagaggaacacggacggcatggtcaccatcctcggctccttcgacaaccgcctctccgcgctcgatgccgcaatgcgccccacccaggtgaggacgcacgcgatccggacggcgcatgagaatatcgactggaccatcaaggccgtcgacgacatcctctcccagttcgatctcgctcgccggattagggacatgaaacagctgcgacttaggttccagttctttgcaagtgccatgtcattcaacatcatgccagaggagcagcaggtgaatgagagcttcttgcccagccattttcgcaatttctggcagcgattacagctaagtaagttgcagtccgaggttctcaaggatgccatctcccagatagttcaggatgccaagaagaataggaagttcactgagactgttgagcttcagattagtctaaagaattatgatccacaaaaggacaagcgtttcagtggctctattaagttgcctcacatccctcgtccaaagatgaaggtgtgcatgcttggtgatgcccaacacgttgaggaggctgagaagatgggacttgactacatggatgttgaggccctcaagaaaatgaacaggaacaagaagcttgttaagaagcttgtcaagaagtaccatgcttttttggcatcagagaccatcatcaagcaaattccccgtctccttggtcctggtctcaacaaggcagacaagtattccccactctggtcactcaccaggaattcctggaatccaaggtgaatgagacgaaggctacagtcaagtttcaactgaacaaaagtcctttgcatgggtgttgcggtcggtaacctgtctatggaggagaagcagatccaacagaacatccagatgagcgtaaacttcctcgtgtctcttctgaagaaaaactggtagaatgtaagatgcctctacatcaagagcaccatggggaaaccatgcagggtgttctaa

SEQ ID NO: 1085 - DNA, 1260 bp, Oryza sativa
gccttgtgaaaattgcgatagccgagtatttttcgagccggttcaaaaaggggagaaatagttgggcccccaatagtacaacgaagcccagcccaagaaaaagcacaaaaggaacaccaagtcgaactctcctcaaccctagcgcacagccgccgccacttcgccctccgcttccgccgccgccgcgccgccgccaccttcctcgttgcggaacagtgtgctcgcaccgccggcgccatgagtaagttgcagagtgatgctcttagggaggcaatctcacaaattactagtgaatcccgcgagaagcagcgcaagttcgtggaaaccattgaactgcagattggactgaagaactatgaccctcaaaaggataagcgtttcagtggatctgttaagttgcctcacatcccccgccctaagatgaaggtgtgcatgcttggtgatgcccagcatgttgaagaggcagagaaaatgggcctagactatatggatgtggaagctctcaagaagatgaacaaaaacaagaagctggttaagaagcttgcaaagaaatatcacgctttccttgcatctgaggccatcattaagcagattcctcgacttcttggacctggtcttaacaaggcaggcaaattcccaacgttggtgactcaccaggaatcacttgagtccaaggttaacgagactaaggctacagtgaagttccaactgaaaaaggttctttgcatgggtgttgctgtaggcaactgtgctatggaggagaagcaaattttccaaaatgtgcaaatgagcgtgaacttccttgtctctcttttgaagaagaattggcagaacgtgagatgcttgtacctgaagagcactatgggaaaagtgatccgggtgttctaaatggttttcttcatgctcctcgaatttctagagacttccctgcttggaacttttattgttttctcaactatcatttttttgtgcaacaagttcagaaatcatttttgatgttatcgattaacttgacttcaaccgttgaaatctttctgtggtactccaagtggtcggtaacctgctgtgcgaattattttttcctgcaccacattattgtctgagaaccagcctgtgaatcataattctttcaagaatggcaagattgtgacacttggcactgttatttctacctaccatcttagagatcgttgcgctaaagctatgatcgctttcaactttactttggaatcttgttgacatgttgtttgaccttcccgc

SEQ ID NO: 1086 - DNA, 918 bp, Secale cereale
gccgccgcgtcgacaaaatccgtaagggcgtcagctaatcggcggcagccatgagtaagctccaaagtgaagccgtgaaggatgccatcactcagattgttggggaggccagagaaaagaagcgcaagttcactgagactgtggagcttcagatcggtctcaagaactacgatccacaaaaggacaaacgtttcagcggctccgtgaagctgccccatatcccccgcccaaagatgagggtgtgcatgcttggtgatgcccagcatgtcgaccaggctgagaaaatgggacttgactacatggatgttgaaagtctcaagaagatgaataagaacaagaagcttgttaagaagctagccaaaaagtaccatgctttcttggcatcagaggccataatcaagcagatccctcgtctccttggccctggtcttaacaaggcaggcaagtttcccactctggtaagtcaccaggaatctcttgaagccaaggtcaacgagacaaaagctacaatcaagttccagctaaagaaggttctttgcatgggtgttgctgtgggcaacttgtcgatggacgagaagcagatccaacaaaacatccaaatgagcgtcaacttccttgtgtccctcctgaagaagaattggcagaatgtgaggtgcctgtacgtgaagagcaccatggggaagcgtgtacgtgtgttctaagtgggtgttctaagtgggtgtgctccagtgaaagttgataagatactgtcctgccgacccctgcttgtctttggattagatctgtttgactgataccaattttatgttttcctaagcgaatatcaacaagcattttcttgaacagaaatcatgggagcaatggaactgagttttctgttatgattctgcgttctgttgttagagatctatatatgat

SEQ ID NO: 1087 - DNA, 937 bp, Hordeum vulgare
tcctccctctctctcgaccgacgccgccgccgcgtcgacaaagtccgtaagggcgtcaactgatcggcggcagccatgagtaagctccaaagtgatgctgtcaaggatgccatcacccagattgttggggaggccagagaaaagaaacgcaagttcactgagactgtggagcttcagattggtctcaagaactacgacccacaaaaggataaacgtttcagtggctctgtgaagctgccccatatcccccgcccaaagatgagggtgtgcatgcttggtgatgcccagcacgttgaccaggctgagaaaatgggacttgactacatggatgttgaaagtcttaagaagatgaacaagaacaagaagcttgttaagaagctagccaagaagtaccatgctttcctggcatcagaggccataatcaagcagatccctcgtctccttggccctggtcttaacaaggcaggcaagtttcccactctggtaagtcaccaggaatctcttgaagccaaggtgaacgagacaaaagctacagtcaagttccagctaaagaaggttctttgcatgggtgttgctgtgggcaacttgtcgatggacgagaagcagatccaacaaaacatccaaatgagcgtcaacttccttgtgtccctcctgaagaagaactggcagaatgtgaggtgcctgtacgtgaagagcaccatggggaagcgtgtacgggtgttctaagttggtgttctccagtggctgtcctgtcgacccgagcttgtctttggattagatctgtttcactgataccaattttgtgtttacctaagcgaacatcaacaagtattttatcttgttagtcttttgttgaacagaaatcatgggagcaatagaactgcattttctgttaagattctccgttgtgccttttatatcaaagatctatgcgatc

SEQ ID NO: 1088 - DNA, 1183 bp, Triticum aestivum
ctcacccttgaccgccgccgccgccgccacgccaaaatccggcgtcaactgatcggcggcagccatgagtaagctccaaagtgacgctgtcaaggatgctatcacccagattgttggggaggccagagaaaagaagcgcaagttcactgagactgtggagcttcagatcggtctcaaaaactatgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtaggcaacttgtcgatggacgagaagcagatccaacaaaacatccaaatgagcgtcaacttccttgtgtccctcctgaagaagaattggcagaatgtgaggtgcctgtacgtgaagagcaccatggggaagcgtgtacgtgtgttctaagtgtgtgcgctccagtgaagttgataagatactgggctgtcctgccgacccctgcttgtctttggattagatctgtttcactgataccaattttctgtttgcctaagcgaatatcaacaagtattttatcgtactagtcttatcttgaacagaaatcatgggagcaatggaactgcattttctgtcatgattctgcgttgtgcctgttatcagagatctatatgcgatcttgattgtcatctgaatgtagattttacttggaagtgtttcctataagtgtgtttaaatggataacttatttggttagcctagcaaatctcaggaaaatagaagtttgttatctgtaaaaccggagaagtgggattttgtaaaaacgactgtcagtactatatgcttttggattttcagtgatcggttgatgtggttcagcttcaacctcggccgcgaccacgctaatcactaccccgc

SEQ ID NO: 1089 - DNA, 960 bp, Triticum aestivum
cgccgccgccgcttcgccaaaatccggcgtcaactgatcggcggcagccatgagtaagctccaaagtgacgctgtcaaggatgccatcacccagattgttggggaggccagagaaaagaagcgcaagttcactgagactgtggagcttcagatcggtctcaaaaactacgacccacaaaaggacaaacgcttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgttaacttccttgtgtccctcctgaagaagaattggcagaatgtgaggtgcctgtacgtgaagagcaccatggggaagcgtgtacgggtgttctaagtgtgtgcgctgcagtgaatttgataagatactgggctgtcctgccgacccctgcttgtctttggattagatctgtttcactgataccaattttgtgcttgcctaagcgaatatcaacaagtattttatctttctagtcttgtcttgaacagaaatcatgggagcaatggaactgcattttctgttatgattctgcgttgtgcttgttatcagagatctatatgcgatcttgatattcatctgaatgtagtttttacttg

SEQ ID NO: 1090 - DNA, 1017 bp, Triticum aestivum
ccgccgccgccgcctcgccaaaatccggcgtcaactgatcggcggcagccatgagtaagctccaaagtgacgctgttaaggatgccatcacccagattgttggggaggcgagagaaaagaagcgcaagttcactgagactgtggagcttcagatcggtctcaaaaactacgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgtcaacttccttgtgtccctcctgaagaagaattggcagaatgtgaggtgcctgtacgtgaagagcaccatggggaagcgtgtacgggtgttctaagtgtgtgcgctccagtgaagttgataagataccgggctttcctgccgacccctgcttgtctttggattagatctgtttcactgataccaattttgtgtttgcctaagcgaatatcaacaagtatttaatcgtactagtcttatcttgaacagaaatcatgggagcaatggaactgcattttctgttatgattctgcgttgtgcctgttatcagagatctatatgcgatcttgattgtcatctgaatgtagtttttacttgaaatgtttcctataagtgtgtttaaattggtgacttatttggttagcctagcaaat

SEQ ID NO: 1091 - DNA, 1094 bp, Triticum aestivum
acgccaaaatccggcgtcaactgatcggcggcagccatgagtaagctccaaagtgacgctgtcaaggatgctatcacccagattgttggggaggccagagaaaagaagcgcaagttcactgagactgtggagcttcagatcggtctcaaaaactatgacccacaaaaggacaaacgtttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtaggcaacttgtcgatggacgagaagcagatccaacaaaacatccaaatgagcgtcaacttccttgtgtccctcctgaagaagaattggcagaatgtgaggtgcctgtacgtgaagagcaccatggggaagcgtgtacgtgtgttctaagtgtgtgcgctccagtgaagttgataagatactgggctgtcctgccgacccctgcttgtctttggattagatctgtttcactgataccaattttctgtttgcctaagcgaatatcaacaagtattttatcgtactagtcttatcttgaacagaaatcatgggagcaatggaactgcattttctgtcatgattctgcgttgtgcctgttatcagagatctatatgcgatcttgattgtcatctgaatgtagattttacttggaagtgtttcctataagtgtgtttaaatggataacttatttggttagcctagcaaatctcaggaaaatagaagtttgttatctgtaaaaccggagaagtgggattttgtaaaaacgactgtcagtactatatgcttttggattttca

SEQ ID NO: 1092 - DNA, 892 bp, Zea mays
aaattctgcccattgattattgcagtaagctggagtccgaggttctcaaggatgtcgtctcccagatagttcaggatgccaagaagaataggaagttcactgagactgttgagcttcagattagtctgaagaattatgatcaacaaaaggacaagagtttcagtggctctgttaagttgcctcgcatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagaccatcatcaagcaaattccacgtctccttggtcctggtctcaacaaggcaggcaagtattccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccaaatgagcgtcaacttcctcgtgtctcttctgacgaaaaactggcagaatgtaatatgcctctacatcaagagcaccatgggaaaccattcagggtgttctaagtctgcttttttgtgaagtctgctcttcatgatatttggtttttgaaccgaggttgtcttgaactaaaactcttgttagatcatatttggttggcatgatatatttgagtccgggcagatgttctcccctttgtctttgtaatctctctatataatgttttttgagaggctcagtataatatgtgtattatatgttatacccaatcgtttctgttactgtgga

SEQ ID NO: 1093 - DNA, 1053 bp, Amorphophallus konjac
aagcgggtagagagagagcttagtgagactctcgtcttggcagcgctgcagccatgagcaagctacagagtgatgtgctgagggaagctattggccaacttgttactgactcaaaagagaagaagaggaaattcactgaaacaattgaactgcagattggtttgaaaaactatgatccccagaaagacaagaggttcagtggctcagtgaaactcccacatattcctcgccctaagatgaaggtctgcatgctgggcgatgctcagcatgttgaggaggctgagaagattgggttggactacatggatgttgaagctcttaagaaaatgaacaagaacaaaaagctggtgaagaaacttgcaaaaaagtatcatgctttccttgcatcagaagccataatcaagcagatccctcgccttttgggcccaggacttaacaaggcagggaagttccctaccttagtcacacatcaggagtccctagagtcaaaggtcaatgaaaccaaggcgatggtgaaattccagcttaagaaggtcctttgcatgggtgttgcagtgggaaactgtggaatggaggagaagcagatattccagaatgtgcaactctcggtcaacttccttgtgtcacttcttaaaaagaattggcaaaatgtaaggtgtctgtacctgaagagcaccatggggaagccagttcgtgtgttttaaggagttgctgagtctgtatctttaaattgcttggtgaaatatgaggtgaggacgcgttgatcatccttttttttggttctcgactattagttgaatgtcaaggacagttccgagcagcaagcgtaagccgtgggtgatgctttactttttgtagttgggatattactataattttctggcatatttctgtttggagtatgttctttcaattgttgggcttcggattcgggaaccgggcattcctttgaggaaattattttcttgattgagaaataacttgtctggctgatttggttgttatggtatttttgaacataagaatctaatgcttgtgataactcgagacaat

SEQ ID NO: 1094 - DNA, 989 bp, Elaeis guineensis
cggttgccgtcttcttcttcggcgcgcctagctctcggaaggactcagcgtagaagtggaagcaagagtaatccgtcggaaccatgagcaagttacagagtgatgttttgagggaagcaatctctcagatcacaaatgattctcgggagaagaagcgcaattttactgaaaccattgagctacagattggactgaaaaactatgacccccaaaaggataagcgtttcagtggatctgtgaagttacctcatatccctcgtccaaaaatgaaggtctgcatgcttggtgatgctcagcatgttgaggaggcagagaaaatagggcttgactatatggatgttgaagcactaaaaaaaatgaacaaaaacaagaagctggtcaaaaagcttgctaagaagtaccatgctttcctagcatcagaggcgatcattaagcagattcctcgtcttcttggtcctggtctcaacaaagcagggaagtttcccacgttggtgactcatcaggaatccctggaggcaaaagttaatgagacaaaagcaatggtgaaatttcagctcaagaaggttctatgcatgggtgttgctgtgggtaactgttcaatggaggaaaagcagatttttcagaatgtgcaactcagtgttaactttcttgtatcattgttgaaaaagaactggcaaaatgtgaggtgcttgtacctgaagagcaccatggggaagccataccgagtattctaagctgttctttgcctgggttgaaaatttgcgggacaagatgtagggaatacttggttttcattttgttcactcgggtcttgttaaatccaaaattttgttccttctggtgctagtgagattttagtgtttgatggctttttaagactttctgatggaattgcattattatgaattttcttcacttgtttcgattcaagaacaaaatgtaagaatattctcttatcatgatgtggttgttttgccagaaggatattg

SEQ ID NO: 1095 - DNA, 1103 bp, Elaeis guineensis
  misc_feature (160)..(161): n is a, c, g, or t
  misc_feature (163)..(163): n is a, c, g, or t
  misc_feature (165)..(165): n is a, c, g, or t
ctcccgccgcctgctcctctctctccgagctcttggtaagtctatttctccctctgcctccccttcccatcgcgaccaattccttttgtttcttgtcgtcctcgaatgtagaagccctagtagttgtattctttcctccaatccgatggcttctcttccnntntnggaaggagcgtcgaagtgaaagcaggagaaatccaccagaacaatgagcaagttgcagagtgacgttttgagggaagcaatctctcagctgacaaatgattctcgggagaagaagcgcaattttactgaaaccatcgagctgcagattggtctgaagaactatgacccccaaaaggacaagcgcttcagtggatctgtgaagttacctcatatccctcgtccaaaaatgaaggtctgcatgcttggtgatgctcaacatgttgaggaggcagagaaaatagggcttgactatatggatgttgaagcactaaaaaagatgaacaaaaacaagaagctggtcaaaaagcttgctaagaagtaccatgctttcctagcatcagaagcaatcattaagcagattcctcgtcttcttggtcctggtctcaacaaagcagggaagtttcccacattggtgactcatcaggaatccctggagtcaaaagttaatgagacaaaagcaatggtgaaatttcagctcaagaaagttttgtgcatgggtgttgctgtgggtaattgtgcaatggaggagaagcagatctttcagaatgtgcaacttagcgttaactttcttgtgtcattgttgaagaagaattggcaaaatgtgaggtgcttgtacctgaagagcaccatgggtaagccgtatcgagtattttaagtagtttttagcttggctggtaacctgtgagacagttgtagggaatacttggttgtcattttatttgttcgggtcttgttggcaacatctgtgagctcttaatccaaagttttgcttcttatggcgttaaggagattttgttgtttgagatctcttagaacttctgatggaatgcattattatgaatttcagttcatgttcattggttttgattcaaggagtgaaagaattcatcttgattgtg

SEQ ID NO: 1096 - DNA, 884 bp, Triticum aestivum
cgccgccgccgcttcgccaaaatccggcgtcaactgatcggcggcagccatgagtaagctccaaagtgacgctgtcaaggatgccatcacccagattgttggggaggccagagaaaagaagcgcaagttcactgagactgtggagcttcagatcggtctcaaaaactacgacccacaaaaggacaaacgcttcagcggctcagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctctgaaagccaaggtcaacgagacaaaagctacagtcaagttccagctaaagaaggttctttgcatgggtgttgctgtgggcaacttgtcgatggacgagaagcagatccaacaaaacatccaaatgagtgttaacttccttgtgtccctcctgaagaagaattggcagaatgtgaggtgcctgtacgtgaagagcaccatggggaagcgtgtacgggtgttctaagtgtgtgcgctgcagtgaatttgataagatactgggctgtcctgccgacccctgcttgtctttggattagatctgtttcactgataccaattttgtgcttgcctaagcgaatatcaacaagtattttatctttctagtcttgtcttgaacagaaatcatgggagcaatggaactgcattttctg

SEQ ID NO: 1097 - DNA, 993 bp, Distylium racemosum
gactgatcagcggaggtagaagcgaagaacgagcgaggcggctgttctctgtaaatcatgagtaagcttcagagcgatgtgttgagggaggccatcactcaggtgatggcggacagcaaggagaagaatcgcaagttcacggagacgatcgaattgcagattgggctgaagaactatgacccccagaaggacaaacgttttagcggttccgtcaaactcccccacatccctcgccccaaaatgaaggtctgcatgctcggtgatgcccagcatgttgaggaggctgagaaaataggtttggactacatggatgttgaagctttaaaaaagatgaacaaaaacaaaaagcttgttaagaagctggcaaagaaataccatgcttttcttgcatcagaagctatcatcaaacagattcctagactacttggtcctggtcttaacaaggccggtaagtttcctactttggtatcacaccaagagtctttggaggccaaggtgaatgaaacaaaagcaactgtcaagtttcaattgaaaaaggtgctttgtatgggtgttgctgtgggaaactgtggcatggaggagaagcaggtattccaaaatgtccagatgagtgtcaactttctggtttccttgctgaagaagaattggcaaaatgttcgttgtttgtacctgaagagcaccatgggcaagccttctcgaatattctaattgtggaacctaattctagcttttgatgattggaactttgaaattgtttgtagtcttgttggtttaggatacgtattttcaaacagtttactttgatatggtcttgcagttgagttttaatataactttgtgcagaggcagttgttgtcctgtaggcacaatttacattttgtaattgacggattattctattatcatcataaaatagttatgatggtaatttatgggttttttcaacggaatattctattatcattatatgatggtaatttttgtcttcttttc

SEQ ID NO: 1098 - DNA, 942 bp, Actinidia deliciosa
ctcacttgtcggcttatcacgaatccgaagtctagggtttcttctccggacataattcagaagggaaacagattcagccatgagtaagcttcagagtgaagcattgagggaggccatctctcagattgctaatgatgccaaggagaaaaagcgtaacttcactgaaactattgagctccagattgggctgaaaaattatgatccccaaaaggataagcgtttcagtggttcggtgaagttgcctcacatccctcgacccaaaatgaaggtttgcatgctcggtgatgctcaacatgttgaagaggctgagaagataggtttggaatatatggatgtggaagggctgaagaagcttaacaaaaacaagaaattggtcaagaaacttgcaaagaaataccatgccttcttagcgtcggaagctgtcattaagcagattccccgtctgttaggccctggtctcaacaaagcagggaagtttccaacccttgttactcaccaggaatctctcgagtcaaaagttaatgagaccaaagctacagtaaagttccaattgaagaaggttctctgcatgggagttgctgttgggaactgcagtatggaggagaagcagatctttcaaaatgtgcaaatgagcgttaattttctagtttcattgttgaagaagaactggcaaaatgtgaggtgcttgtacctgaagagtaccatggggaagccagtccgcgtcttttaaggagttcttcacctcagctgttgagggacggatttgttgtgagcaaattctcgaaattaaagtcccagattgagcaattttccctttttgttagttgtttgcatcaacactctgaaatgctatgaacattttaatggttgttttccaagttatttaactgaataatctttttctatggtttctgcgtatgagcaaagaacaaaaaaaaaaaa

SEQ ID NO: 1099 - DNA, 888 bp, Pseudoroegneria spicata
  misc_feature (100)..(100): n is a, c, g, or t
  misc_feature (104)..(104): n is a, c, g, or t
  misc_feature (758)..(758): n is a, c, g, or t
  misc_feature (772)..(772): n is a, c, g, or t
  misc_feature (824)..(824): n is a, c, g, or t
  misc_feature (828)..(828): n is a, c, g, or t
  misc_feature (855)..(855): n is a, c, g, or t
ccgcccccgccccgtcgacaaaatccggcgtcaactgatcggcggcagccatgagtaagctccaaagtgacgctgtcaaggatgccatcacccagattgntggngaggccagagaaaagaagcgcaagttcactgagactgtggagcttcagatcggtctcaagaactacgacccacaaaaggacaaacgtttcagcggttcagtgaagctgccccatatcccccgcccaaagatgagggtgtgcatgcttggtgatgcccagcatgtcgaccaggctgagaaaatgggacttgactacatgtatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacgaaagctacagtcaagttccagctaaagaaggttctttgcatgggtgttgctgtgggcaacttatcgatggacgagaagcagatccaacaaaacatccaaatgagcgtcaacttccttgtgtccctcctgaagaagaattggcagaatgtgaggtgcctatacgtgaagagcaccatggggaagcgtgtacgggtgttctaagtgggtgcgctccagagaagttgataagatactgggctgtcctgccgacccctgctngtctttggattagntctgtttctctgataccaattttgtgtttgcctaagcgaatatcaacaagtntttnatcgtactagtcttttcttgaacaaanatcatgggagcaatggaactgcattttctgtca

SEQ ID NO: 1100 - DNA, 922 bp, Phalaenopsis aphrodite
ttttttttccgcgaggcgggcgaggctccgaagaagccagcgatcacactgcgagggttagctgaagagtcggcgcagagagccgcttggaaaaaatgagtaagttgcaaagtgatgttttgagggaagccatctcccagcttctcaacgaaactcgtgagaagaagcgcaacttcacggaaaccattgagctgcaaattggactaaagaactatgatcccaaaaggacaagcgctttagtggttctgtgaagcttccacacattcctcgtccaaagatgaaggtttgcatgcttggtgatgcccagcatgttgaagaggctgagaagatagggctggattggatggatgttgaagctctcaagaaaatgaataagaataagaagcttgtgaaaaagcttgcaaagaagtatcatgctttcttggcctctgaggctataatcaagcaaattccccgccttcttggacctggccttaataaagcagggaagtttcctactctggttactcatcaggaatccttggaatcaaaagtaaatgaaaccaaagcaatggtcaaatttcagctgaagaaagttctgtgtatgggtgttgctgtgggcaactgcgcaatggaggagaaacagatctttcaaaatgttcagctcagcgttaatttccttgtttcccttctgaagaaaaactggcaaaatgtgaggtgcttgtatatgaagagcaccatgggcaagccatacagagtgttctgagttgagcagattccagtgggttttgcagacgctttttttattactgttttttattcttctaattgtgcttcgtagaacatcatctcctcttaatcatcaaagattttggcttctaccttttgttgaatttaactttgtttgccttatatttaattggaaacccctctgtgcttcagt

SEQ ID NO: 1101 - DNA, 968 bp, Zea mays
cgtatccggtacccgccgggtaatctcgtcccgttttcacccctagattaagctggagtccgaggttctcaaggatgtcgtctcccagatagttcaggatgccaagaagaataggaagttcactgagactgttgagcttcagattagtctgaagaattatgatcaacaaaaggacaagagtttcagtggctctgttaagttgcctcgcatccctcgtccaaagatgaaggtgtgcatgcttggtgatgcccagcacgttgaggaggctaagaagatgggacttgactacatggatgttgaggccctaaagaaaatgaacaagaacaagaagcttgttaagaagcttgccaagaagtaccatgcttttttggcatcagagaccatcatcaagcaaattccacgtctccttggtcctggtctcaacaaggcaggcaagtattccccactctggtcactcaccaggaatccctggaatccaaggtgaatgagacgaaggctacagtcaagtttcaactgaagaaagtcctttgcatgggtgtcgcggtcggtaacctgtctatggaggagaagcagatccaacagaacatccaaatgagcgtcaacttcctcgtgtctcttctgacgaaaaactggcagaatgtaagatgcctctacatcaagagcaccatgggaaaccatgcagggtgttctaagtctgcttttttgtgaagtctgctcttcatgatatttggtttttgaaccgaggttgtcttgaactaaaactcttgttagatcatatttggttggcatgatatatttgagtccaggcagatgttctcccctttgtctttgtaatctctctatataatgttttttgagaggctcagtataatatgtgtattatatgttatacccaatcgtttctgttactgtggaaccatgagtttccgccattgctgctgcgccctcggggtagcgcccctctgttt

SEQ ID NO: 1102 - DNA, 897 bp, Triticum aestivum
ttcgccaaaatccggcgtcaactgatcggcggcagccatgagtaagctccaaagtgacgctgtcaaggatgccatcacccagattgttggggaggcgagagaaaagaagcgcaagttcactgagactgtggagcttcagatcggtctcaaaaactacgacccacaaaaggacaaacgcttcagcggccaagtgaagctgccccatatcccccgcccaaagatgagggtgtgcatgcttggtgatgcccagcatgtcgaccaggctgagaaaatgggacttgactacatggatgttgaaagtctcaagaagatgaacaagaacaagaagctgtaaaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgttaacttccttgtgtccctcctgaagaagaattggcagaatgtgaggtgcctgtacgtgaagagcaccatggggaagcgtgtacgggtgttctaagtgtgtgcgctgcagtgaatttgataagatactgggctgtcctgccgacccctgcttgtctttggattagatctgtttcactgataccaattttgtgcttgcctaagcgaatatcaacaagtattttatctttctagtcttgtcttgaacagaaatcatgggagcaatggaactgcattttctgttatgattctgcgttgtgcttgtta

SEQ ID NO: 1103 - DNA, 1180 bp, Eragrostis curvula
ttcggaaaattcacctcagaaaggagggccatcctccctcggtcgtcgccgaggccaaggagaagaacaggaagttcaccgagaccgtcgaactccagatcggcctcaagaactatgatccgcaaaaggacaagcgtttcagtggctctgttaagctgccccacatccctcgccctaagatgaaggtctgcatgcttggtgatgcgcagcatgtggaggaggcagagaaaatgggccttgattacatggacgttgaagctcttaagaagatgaacaagaacaagaagcttgttaagaagcttgccaagaaataccatgctttcttagcctccgaggcgattatcaagcagattccccgtctccttggtcctggtctcaactaggcaggcaagttcccgactttggttactcatcaggagtctctggaatcaaaggtaaacgagacaaaagctacagtcaagttccaactgaagaaggttctttgcatgggtgtcgctgtgggtaacctgtcgatggaatagaatcagatccaacagaacatccaaatgagcgtcaacttcctggtttctttgctgaagaaaaactggcaaagcgtgatgtgcctgtacatcaagagcaccatggggaagccaaacagggtgttctgaattgcctgtgtgaaccgataccgtattgttttctgggatatgtttatgcccttaatctatacaactgtaacgagaatttgtgtctgtgacctcgtgacattgaaaaaaaaacaagtaaacctgttttcttacaacattttttccctctaaaaaaaaaaaaaaaaaaaactaaaagtaactctgtgttgaacctctggctttattcttatttccgcgggcccccttgccggcccgggaacattgggacttttgaccctttttactctataatggacttatattaaaatttacggggccctctttttttatccgatttggaatggaaaatacctcgggtgatacccaactttaaacccttctcaccacatttcccccttcctcccttgtggcgaaacaaagcaaaaaagccccacccgactccctccttactcaaatattgtcctaactttaaatagataaatgaaaccaccccccctacaatgccccacatatctcccttccgggtgttgttgtgggtttatccactcactttc

SEQ ID NO: 1104 - DNA, 942 bp, Chelidonium majus
cggctacatcaagaaaccctagttgagggtttgcacttcgttttctttctatctggacaccaatctgtggaggagttgcatattgaacaaatttgttaaaaatgagtaagctccagagtgatgtattgagggaggcaatcacccagattgttaatgatgccaaagagaaaaagcgcaactttaccgagactattgagctccagattggtcttaagaactacgaccctcaaaaggacaagcgtttcagtggttctgtgaagctgccacatatccctcgtcctaagatgaaggtctgcatgcttggggatgctcagcacgtcgaagaggcagagaagataggtttgtcctacatggatgtcgaagggttgaagaagctcaacaaaaacaagaaattggtcaagaagcttgcaaagaaataccatgcatttcttgcatcagaagctgtaattaagcagattccccgtcttcttggccctggtctcaacaaggcaggaaagtttccaactttggttactcaccaggaatccctggaatcaaaggttaatgagaccaaggctatggtgaagttccaattgaagaaggttctttgcatgggtgtagcagtagggaaccttggaatggaggagaagcagatcttccaaaatgtgcaactcagtgtcaacttccttgtatctttgttgaaaaagaattggcaaaatgtgaggtgcttgtacctgaaaagtacaatggggaagccaaaccgcgtgttttaaggaattcattttacatactattagagctgttgtgtagtgagagcaagacctgagtttaattttgtcaaagatgcttaaattttgattttgagattccttttctcttttactttttctcaatgatatttagtttgattactatcagcagcaatttaatagtttttaacattaatgtgatgttttggttatg

SEQ ID NO: 1105 - DNA, 1037 bp, Chelidonium majus
ccaattctaacatttgctgcctcttagtattctccattttctcataaatctctccaaatttctgaatagaatccgcaagcaacctaaatgaagacctctcaacaccattctccttaaatctttagggtagaaatttgtagaggatctcaaggaatagtttcacgatgagtaagcttcagagtgaagtgttgagggaagcaatcacccagattaatggtgaagctaaggagaaaaagcgtaacttcactgagactgttgagctccagattggtcttaagaactacgacccccaaaaagacaagcgtttcagtggttccgtgaagttgccacacattcctcgccctaagatgaaagtgtgcatgcttggagatgctcagcatgttgaggaggcagagaagattgggctggcctacatggatgttgaagggttgaaaaagcttaacaagaataagaaattggtcaagaagctcgctaagaaataccatgcttttctagcatcagaggctgttattaagcagatcccccgtctccttggccctggtctcaacaaggcaggaaagttccctactcttgtgactcaccaggaatcgttggagtccaaagtgaacgaaaccaaggctatggttaagtttcaactgaagaaggttctctgcatgggtgttgctgtgggtaaccttggaatggaagagaagcagatcttccagaatgtgcaactcagtgttaacttccttgtgtccttgttgaagaagaactggcaaaatgtgaggtgtctatacttgaagagtaccatggggaagcccgtccgcatcttctaagccctttatttattaattacaagaggtgtagtaagagatttagcgtttgcaagagtagacattttctgagaatgcttgcatatctttttgttttatgctcaaatttcgtttttgttcacttgacatttttagttcagtgattggaaaatcttgaaatattaagtgcttttttcatgttgtccaatgggatagtgttattagtagcaattcatacacttgttt

SEQ ID NO: 1106 - DNA, 887 bp, Avena sativa
ctccctcccttcgaccgccgccgcaccatcgacgaaatccgtcgtcgactgaccggcggcaaccatgagtaagctttcaagtgaggcggtcaaggatgccatcacccagattgttggggaggccagagaaaagaagcgaaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgttaagaagctagccaagaagtaccatgctttcttagcatctgaagccatcatcaagcagatcccccgtctccttggtcctggtctcaacaaggcaggcaagttccccacactggtgagtcactctgagtctcttgaagccaaggtcaatgagactaaagctacagtcaagttccagctgaagaaggttctgtgcatgggtgttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagcggtcttgataggatactctgtactgtcgacccgagtttgtcttcgatttagatctgtttcactgatgccaattttgtgtttatctaagcgaatatcagcaaagtattctgtctctggtagtctttttgaacttgttgagaaatggaactgtatttctgttatgattttga

SEQ ID NO: 1107 - DNA, 1058 bp, Elaeis guineensis
cgtatcgccggaacctccactgagacgcgctctctgattagggtctcttcccttcaggaaggagagaagctaatagactatccctttgaggaggagctcgacaaagaaaaactatgagcaagctgcagagtgatgtgttgagagaggctatctctcagattgctaacgatgctagggagaaaaagcgcaacttcattgagaccattgagctgcagattggcctaaaaaattatgatccacaaaaggataagcggttcagtggttctgtgaagttgccacatattccacgtccaaagatgaaggtttgcatgcttggtgatgctcagcatgtggaagaggctgagaaaattggactggattatatggatgttgaagggctgaagaagatgaacaagaataagaagttagtcaaaaagcttgcaaaaaaatatcatgcatttttggcatctgaagctattattaagcagattcctcgacttttaggccctggtcttaacaaggcaggtaaatttcctacattggtcacacatcaggaatctttagaggccaaagtcaatgagaccaaagcgatggtgaagtttcaactgaagaaagttctttgcatgggagttgctgttgggaattgcgcaatggaggagaagcagatttttcaaaatgtgcaacttagcgttaacttcctggtgtctttattgaagaagaattggcaaaatgtgagatgcttgtacctgaagagcaccatgggcaaaccttatcgcgtgttctaagaaaaggcgtgcaaaatctgatgcttgcttaccaatacttggttgagctgctcgagctctttcttttattattgagtcttctcttcgctctctctcttcttagttttgcagtttgaactttctttgaagtgtttatggtcgcctgttgagatgatagttgttgcgtaagcatttcttaccatctggaagttttgtttttcaccacaaccttagtcgatggggtatggttcaaattcagatattgttataccagtttggtttgctgccatctttaaatgataagcatggggtatt

SEQ ID NO: 1108 - DNA, 2860 bp, Oryza sativa
acatgggacaactggtattcactaatctagtagactaacagtacagctaaatcaaggtcaagtaggaaactacagtaagagataagatatttttaacaatttaattagaccatgtgacataaaaaagaagaagaagaagaagaagaaaaaccacttcatgtcgagcagtaaaaaaccattgttttataaggactagccagccaacaaaggtggatgtaaacaaggggtattgttatatttacctttctgccatcttccaacaggagccttaatgctatgaccgaggtaattctctcggtgcttgtcaaccttaacatcatcccatttgaattctgcaaggaacaaaaggagaaaagtatttagatttactgagcttttctaataattgtatgttcaacccatataacaaaaaagctcgtaagctacaatgcaaagtgcaagatggagatgacacaatggcagtggaacagaacaacatgtagaagagcttatagcaaaaacaaacgatcaaaatgtaggcctattcatgttggcaggtgtaggagtagtccagtgcacgcttttctgtttgagaaaaggtagctttatgttcatagtacaaaatgaagaaccacaggtgcaattggaggagctaacgggctgcactcattatttatagcgcttgtaaagttgaatagtaagcataaggttatacaattagggcaccgatgatgcccataagtgatgataatctagtgagtttatcatatacaaagtagttatatagtacaagcctataaatgaaccccccccccccccaaaaaaaaagtgatgattttctctttcagatgcagcaattgtaatcaatgtaatttggatcattttctcacctcattgtatcttgtagttatctagcagctttttgctcattcagcatgaggatgaaccttagcattataaagcataaaacacaacgaaatacagagagtaaaactgaatattccatgatatcctagagctatattcatgatatcctagagctcggagcacattaataagtgccgtacattgcagcaaacaaatgcatatccataatatatgcccacagaagttgaaaaactcgtgtaaattttggaaagctcatacatccagcatatagaagtgctaatactaattttatagtgtcatgtttcatcctgatgactggtattgccatgccaccattcattaaggtaattttggcagcagtacgttgtaaccccagtagttgttgtcccttgatgatccgactgtcagtctgtcacacgaggatcccttgcaatggggtcatccattcatcttatgaccattgtttttaaactaaaaaacaatgtcggataccaatgaggaacttggtatcaattggatagagaagagataaaggtgaacacgcgtgccgaagggtgctgaatgcgggcaggcatacgtgcgtgaccgcgccatgtgcagtttccatcttataacctttcaaaggaacatgattcaataacaatatggcagacacagaattcctcctgatgcaagatcatacaagcaaacagatgagttggaaggtaagatcctacgcactaaccacatagacacaagagacgaactagctaatcgaatccagtgcaacacggacgagttggaaccaacaagtaagaccggacgagatgcaatcaaacgcgaggaaggagcatcgacaaatcaacaactagaaccttacagccacagcgagtccctagcaacagcatcgaaaccctagcgagtgtttcacggaagtaaaaaaattacgcggcagaattagggcccgcagccagcgattgagatctcacggcgagtggatttgggaaaggtaggagaaggagagagcttacgatcccgtccgccgcggacgccgcctctcgtcgggtggtacatctccgcccggtcgcgccgccggtggggtggggaattcggcggaggaagacgacgacgatttgcgtagtggaggtttttttccttttttttttttttttgagattgagatgcgcgaccgccatatgtggaatgggccctttatgtttcggcccacgacgaaaggaagcccaccggcgtcaatctccaccgtccgatccgatcggacggtcgaaacggcacagagcatgcagccacaaaaaccctaggtcgggagcacgcatcctcactcgccgccttctctcctctcgcgccgtttcgctccctgaccctccgccgccgccgccgccgatcatcatgagtaagttgcagagcgaggttctcaaggaagccatctcccaggttgttggggaatccaaggagaagggcaggaagttcaccgagaccgttgagcttcagattggtctcaagaactatgacccgcaaaaggacaagcgtttcagcggctccgtcaagctgccccatatcccccgccccaagatgaaggtctgcatgcttggtgatgcccagcatgtcgaggaggctgagaagattgggcttgactacatggatgttgaggctcttaagaaaatgaacaagaacaagaagctggttaagaagcttgccaagaagtaccatgctttcttagcatcagaggccatcatcaagcagattcctcgtctccttggtcctggtctcaacaaggcaggcaagttccctacattggttactcaccaggagtctcttgaatccaaggtcaacgagacgaaagctacagtcaagttccagctgaagaaggttctgtgcatgggtgttgctgtgggtaacttgtcaatggaggagaagcagatccagcaaaacatccaaatgagcgtcaacttcctcgtgtcccttttgaaaaagaactggcagaatgtgagttact

SEQ ID NO: 1109 - DNA, 1246 bp, Aristolochia fimbriata
tctctttgcactcttgtgacgccgccgcatcggctctgaagcacccctgctccgggagtttagcaccgctattttgtagtgaaatatatacttggagcaacgatgagtaagcttcagagtgatgtcttgagggaggccattggtcaggtcatggatgttgcaaaggataaaaaccgtaactttaccgagactattgagctccaaattggactcaagaactatgacccacagaaggacaagcgtttcagtggctctgtgaaactgcctcatattcctaggccaaaaatgaaagtttgcatgcttggtgatgcacagcatgttgaagaggctgagaagataggtttagattatatggatgttgaagcactgaagaaaatgaacaagaataagaagctagtgaaaaagcttgcaaagaagtaccatgctttccttgcttctgaggcaattattaagcagattccaaggcttcttggtcctggtcttaacaaagctggaaagttccctactctggtctctcaccaggagtctctggagtcaaaggtaaatgagaccaaagcaatggttaagtttcagcttaagaaggtgctgtgcatgggtgttgctgttggcaattgtggaatggaggagaaacaagttttccagaatgtgcagctcagtgtcaacttccttgtttctctccttaaaaagaactggcagaatgttaggtgcttgtatctgaaaagtacaatgggaaagcctgtccgtgtgttctaatctggatccatattgctttactgagagtgaaacccggcgaaaccgagttttgattgtaggttaatctgtttttctgtttttcattccagtgaagaatagatacatacacataaattgatttgtttggagtgacaagggtgtgtcattatgaaaaaatttcttagctctgtggtaggtatttttgttttttttattgtttcttcaattttgacaattagtccatttccctgcgataatgttgccagtttattttgtgctggatgtcgtaattagaggcttcagcgagattgggaaacttgtgtatgagttgagtccgagcaaaatatgtaatcaccttttcttgtgttaagaaagcagttgtttctcgtttctctcgttctggaaattccttacattttgtttctcgtttatgcttgtgtcatccttgttgggaatgtgcaaggattatctactctaattctttctcccgaattaaatgaatcagttttcgtaa

SEQ ID NO: 1110 - DNA, 1055 bp, Brachypodium distachyon
ctttctctcttcgctactccctctccgccgccgcaccgaaacacggcgtgagactcatcggcggcaaccatgagtaagctccagagtgaggcggtcaaggacgccatcacccagattgtgggtgacgccagagagaagaaaaggaagttcaccgagactgttgagctccagattggtctcaagaactacgacccgcaaaaggacaagcgtttcagcggctccgtgaagctgccccatatcccccgccccaagatgagggtgtgcatgcttggtgatgcccagcacgttgaccaggctgagaagttggggcttgcctgcatggatgttgaaagcctaaagaaaatgaacaagaacaagaagcttgttaagaagcttgccaagaagtaccatgctttcttagcatcagaggccatcatcaagcagatcccccgtctccttggtcccggtctcaacaaggcaggcaagttccccacactggttagtcaccaggaatcccttgaagctaaggtcaatgagacgaaagctaccatcaagttccagctaaagaaggttctgtgcatgggtgttgctgtgggtaacttgtcgatggatgagaagcagatccagcaaaacatccaaatgagcgtcaacttcctcgtgtccctcttgaagaagaactggcagaatgtgaggtgcctgtacgtgaagagcaccatggggaagcgcgtgagggtgttctaagtgggtgtgatcaagcgaagttgataagataccggactgtcgacctgagcttgtctttaaattagatcttttgcactgatatcaattttgtgtttgcctaagcgaatatcaaagaagtatttgagctcttgtgttagtcttttcttgaacagaaatttatgggagaaatcgaactgtgttttgagttatcgtttttaaggttctacatttgttcttgttgaagcggctatctgattccgattttttatctctgtttatgcttgcgtaagtttgtgtcttggtggatttgacgaaacaagagttttttgtctatgtagtaggaattggtaatacca

SEQ ID NO: 1111 - DNA, 2312 bp, Brachypodium distachyon
cgccttccccgtccgctctttctctcttcgctactccctctccgccgccgcaccgaaacacggcgtgagactcatcggcggcaaccatgagtaagctccagagtgaggcggtcaaggacgccatcacccagattgtgggtgacgccagagagaagaaaaggaagttcaccgagactgttgagctccagattggtctcaagaactacgacccgcaaaaggacaagcgtttcagcggctccgtgaagctgccccatatcccccgccccaagatgagggtgtgcatgcttggtgatgcccagcacgttgaccaggctgagaagttggggcttgcctgcatggatgttgaaagcctaaagaaaatgaacaagaacaagaagcttgttaagaagcttgccaagaagtaccatgctttcttagcatcagaggccatcatcaagcagatcccccgtctccttggtcccggtctcaacaaggcaggcaagttccccacactggttagtcaccaggaatcccttgaagctaaggtcaatgagacgaaagctaccatcaagttccagctaaagaaggttctgtgcatgggtgttgctgtgggtaacttgtcgatggatgagaagcagatccagcaaaacatccaaatgagcgtcaacttcctcgtgtccctcttgaagaagaactggcagaatgtgaggtgcctgtacgtgaagagcaccatggggaagcgcgtgagggtgttctaagtgggtgtgatcaagcgaagttgataagataccggactgtcgacctgagcttgtctttaaattagatcttttgcactgatatcaattttgtgtttgcctaagcgaatatcaaagaagtatttgagctcttgtgttagtcttttcttgaacagaaatttatgggagaaatcgaactgtgttttgagttatcgtttttaaggttctacatttgttcttgttgaagcggctatctgattccgattttttatctctgtttatgcttgcgtaagtttgtgtcttggtggatttgacgaaacaagagttttttgtctatgtagtaggaattggtaataccatggcggagtgtagttatcagcagccatttccttcatacaagcctatgaaacgaaaacttgtaaggtagcttgtttacatgcatttacaaaacagtctctaactcaaactcgtaaaactttgcgtagatgctaagggacgatgaaggggatgaccatggacaggaagctgtcatatgtgagagcagccgagccagtgtagcgcgaatccttctccttgaacttttcagtcagaccctgcgcgtaacaacagcgaacatgtcttgtcagaaatgatatgaaacttgcagattcattacatgatccaaacatgtacaattgatttgcaaacataccttgacaaccatcccacaccttgagaaatcgaaacccggaaagcacatgaatttcagttagtcatctgttaagacatgaagaatgctgaaacctggagataatctcgtatgacagacagaatgtactcactctacaaagttgtcgaagtcgagcgcgccgcgtcgggaaacaccattgttgtagtttgcgatgagaagctcgatgaccgaaggtggaaccgcgtaccccaggccgcgaagagcttctctcaactcatcggagtcgatcttcccgctccggtccctgtcgtatctgtcgaaaatgccctggatggtgccatcaagtagagaattaagccggttgctgttgcaagatgtaaggaacgacagactacagcctgccaatagttctttctttcttattgacttttccccatcatacaattctcaagttatctgtcgaaaatgctctatagattctcaagttatctgtcgaaaatgctctagatggtgacatgaagaatagttaagcccccaatagctgactgtggacggaattaataatggaggaaatgtttgatgctatgaaatagtttgaccaacactacactaggatatagtatcctgttcccctgttgacttgccccatgatacaaaaccctcaaattagttcgttagtgtgaatgtgaataattccaattacataatgttgctgattggcggaaccgactgttgttccatacagagaaacaggtcctccaccaggccaccatttgcagttaaaaacacactcacattattcagcagattcatgtatgtatgtacagcgaatgacaagttggctgaataatttggtgactccaaaactgcaaatcgcaagcagtgcatgcattccgtttcgcaattaaactaaaccatacaagattgaa

SEQ ID NO: 1112 - DNA, 1056 bp, Nuphar advena
gccctctaccgaataaggttgagctgctgagtcttcttctctctcgtctctctctctgctccgatcccgctagggtttctctgggctcgtgctgaaggtattgcggggaagtcggcaagatgagtaagctccagagtgatgcattaagggaagctatcactcaggtggttggcgaagcaagagacaaaaagcgcaagtttactgagacaattgagcttcaaattggtttgaaaaattatgatccacagaaagacaaacgtttcagtggatctgtgaagctacctcacattccccgtccaaaaatgaaagtttgcatgcttggtgatgctcagcatgtggaggaggctgagaagataggattagattacatggatgttgaaggtttgaagaagatgaacaagaacaagaagttggtgaagaagcttgccaagaagtaccatgcttttcttgcttctgaagctattatcaagcagattccaaggcttcttgggccaggtcttaacaaagctgggaagtttccaacccttgtttcacaccaggagtctctggaatcaaaggtaaatgaaaccaaagcgatggttaaattccaactcaagaaggtcctttgcatgggagttgctgttggaaattgtggcatggaggagaagcagatcttccagaatgtgcaacttagtgtcaacttccttgtttcactgttgaaaaagaactggcaaaatgtgaggtgcttgtatctgaagagtactatgggcagggcaattagagtattctaagcggtacatctggtctaccaccgagcaattccttggctactagcactgaagcaaaaaaaagaaaagtttctttgcagtttttgcacatttttgttataggtgaatctgtttgttcttgttcctgtttaaatgatttttctctgggaaactatattagatagactacatttcctttctgtaactggtgtatccagtttgagcgggacaggattagtatgatatgttgaagttcaaatattgttagagattggaattttcgagtagcctatcatttcatttgttgtgt

SEQ ID NO: 1113 - DNA, 921 bp, Avena sativa
gcccctccctcccttcgaccgccgccgcaccatcgacgaaatccgtcgtcgactgaccggcggcaaccatgagtaagctttcaagtgaggcggtcaaggatgccatcacccagattgttggggaggccagagaaaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgtcaagaagctagccaagaagtaccatgctttcttagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcatgggggttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagtggtcttgctccagtgaagttgataagatactctgtactgtcaacctgagtttgtctttgttttagatctgtttcactgatgccaattttgtgtctatctaagcgaatatcagcaaagcattctgtctctggtagtccttttgaacttgttgagaaatggaactgtatttctgttatgattttgaatgctcacgttgtgcc

SEQ ID NO: 1114 - DNA, 1024 bp, Elaeis guineensis
tctcttcccttcaggaaggagagaagctaatagactatccctttgaggaggagctcgacaaagaaaaactatgagcaagctgcagagtgatgtgttgagagaggctatctctcagattgctaacgatgctagggagaaaaagcgcaacttcattgagaccattgagctgcagattggcctaaaaaattatgatccacaaaaggataagcggttcagtggttctgtgaagttgccacatattccacgtccaaagatgaaggtttgcatgcttggtgatgctcagcatgtggaagaggctgagaaaattggactggattatatggatgttgaagggctgaagaagatgaacaagaataagaagttagtcaaaaagcttgcaaaaaaatatcatgcatttttggcatctgaagctattattaagcagattcctcgacttttaggccctggtcttaacaaggcaggtaaatttcctacattggtcacacatcaggaatctttagaggccaaagtcaatgagaccaaagcgatggtgaagtttcaactgaagaaagttctttgcatgggagttgctgttgggaattgcgcaatggaggagaagcagatttttcaaaatgtgcaacttagcgttaacttcctggtgtctttattgaagaagaattggcaaaatgtgagatgcttgtacctgaagagcaccatgggcaaaccttatcgcgtgttctaagaaaaggcgtgcaaaatctgatgcttgcttaccaatacttggttgagctgctcgagctctttcttttattattgagtcttctcttcgctctctctcttcttagttttgcagtttgaactttctttgaagtgtttatggtcgcctgttgagatgatagttgttgcgtaagcatttcttaccatctggaagttttgtttttcaccacaaccttagtcgatggggtatggttcaaattcagatattgttataccagtttggtttgctgccatctttaaatgataagcatggggtatttggttggga

SEQ ID NO: 1115 - DNA, 1098 bp, Oryza sativa
aaactgctctcttcctcgccgccatctagggtttcctctccgccgcgccgcctccctcgtacctcgtcgcggatctgtgctcgcaccaccggcggcgccatgagtaagttgcagagtgatgctctgagagaagcgatctctcaaattgctaatgactctcgtgagaagcagcgcaaatttgtggaaaccattgagctgcagattggactgaagaactatgaccctcaaaaggataagcgtttcagtggttctgttaagctgccccacatccctcggcctaagttgaaggtttgcatgcttggtgatgctcagcacgtcgaagaggcagagaaaatgggcctagactatatggatgtggaagccctcaagaaaatgaacaaaaacaagaagctagttaagaagcttgcaaagaaatatcatgctttccttgcttctgaggctatcatcaagcagattcctcgacttcttggtcctggtcttaacaaagcaggcaaattcccaactctggtgacgcatcaggaatcacttgagtccaaggttaatgagactaaggctacagtgaaattccagctgaagaaggttctctgcatgggtgttgctgttggcaactgtgctatggaggagaagcagatcttccaaaatgtgcagatgagcgtgaacttccttgtttcccttttgaagaagaattggcagaacgttaggtgcttgtacctgaagagcaccatgggaaaggtgtaccgagtgttctaagttattttctttaggcttctagatgttttggagactaagctacttgaaacttttgctactttcccagtcatcaaattttgtgcaacagctgaggattaaggaattcggatttaattgtcctgtactaagttgcctctctctttggttgaacatcattacattttatccatcgagatcattctgtgatgacccaaaatcctgctgtgcagaccttttattgtcctgatctttattagtcttagcagcatgagttagtgagaacattaggtgctcatatctttcttgcctgtttgttaaagaaaattattggatgcacacatcacaatggaattttagagataccgatac

SEQ ID NO: 1116 - DNA, 1073 bp, Oryza sativa
tagggtttcctctccgccgcgccgcctccctcgtacctcgtcgcggatctgtgctcgcaccaccggcggcgccatgagtaagttgcagagtgatgctctgagagaagcgatctctcaaattgctaatgactctcgtgagaagcagcgcaaatttgtggaaaccattgagctgcagattggactgaagaactatgaccctcaaaaggataagcgtttcagtggttctgttaagctgccccacatccctcggcctaagttgaaggtttgcatgcttggtgatgctcagcacgtcgaagaggcagagaaaatgggcctagactatatggatgtggaagccctcaagaaaatgaacaaaaacaagaagctagttaagaagcttgcaaagaaatatcatgctttccttgcttctgaggctatcatcaagcagattcctcgacttcttggtcctggtcttaacaaagcaggcaaattcccaactctggtgacgcatcaggaatcacttgagtccaaggttaatgagactaaggctacagtgaaattccagctgaagaaggttctctgcatgggtgttgctgttggcaactgtgctatggaggagaagcagatcttccaaaatgtgcagatgagcgtgaacttccttgtttcccttttgaagaagaattggcagaacgttaggtgcttgtacctgaagagcaccatgggaaaggtgtaccgagtgttctaagttattttctttaggcttctagatgttttggagactaagctacttgaaacttttgctactttcccagtcatcaaattttgtgcaacagctgaggattaaggaattcggatttaattgtcctgtactaagttgcctctctctttggttgaacatcattacattttatccatcgagatcattctgtgatgacccaaaatcctgctgtgcagaccttttattgtcctgatctttattagtcttagcagcatgagttagtgagaacattaggtgctcatatctttcttgcctgtttgttaaagaaaattattggatgcacacatcacaatggaattttagagataccgataca

SEQ ID NO: 1117 - DNA, 917 bp, Avena sativa
ctccctcccttcgaccgccgccgcaccatcgacgaaatccgtcgtcgactgaccggcggcaaccatgagtaagctttcaagtgaggcggtcaaggatgccatcacccagattgttggggaggccagagaaaagaagcgcaagttcactgagactgttgagcttcagattggtctcaagaactatgacccgcaaaaggacaagcgtttcagcggctctgttaagctgccccatatcccccgcccgaagatgagggtgtgcatgcttggtgatgcccagcatgttgaccaggctgagaaattgggacttgactccatggatgtggagagtctcaaaaagatgaacaagaataagaagcttgtcaagaagctagccaagaagtaccatgctttcttagcatctgaagccatcatcaagcagatcccccgtctccttggtcctggtctcaacaaggcaggcaagttccccacactggtgagtcactccgagtctcttgaagccaaggtcaatgagactaaagctacagtcaagttccagctgaagaaggttctgtgcatgggggttgctgtgggtaacttgtcgatggatgagaagcagatccaacagaacctccaaatgagcgttaacttccttgtgtcccttctgaagaagaactggcagaatgtgaggtgcctgtacgtgaagagcaccatggggaagcgtgtccgggtgttctaagtggtcttgctccagtgaagttgataagatactctgtactgtcaacctgagtttgtctttgttttagatctgtttcactgatgccaattttgtgtctatctaagcgaatatcagcaaagcattctgtctctggtagtcattttgaacttgttgagaaatggaactgtatttctgttatgattttgaatgctcacgttgtgcc

SEQ ID NO: 1118 - DNA, 941 bp, Humulus lupulus
ggaaaagttctaagcttcaaacatgagtaagcttcagagtgaagtcctcagagaggctattgctaccataatgaacgaatcaagggaaaagaagcgtaacttcactgagacaattgaactccagattggtttgaagaactacgatcctcaaaaggacaagcgtttcagtggttccgtgaagttgccccacattcctcgtcccaagatgaaggtttgcatgcttggagatgctcagcatgttgaggaggctgagaaaataggtttggactacatggatgttgaagggttgaagaagttgaacaagaacaaaaagctggttaagaagcttgcaaagaagtaccatgcctttttagcatcagaagctgttattaagcagattcctcgtcttttaggccctggtctcaacaaggccggtaaatttcccacccttgtaactcaccaagaatccctggagtctaaagtcaatgagactaaggccatggttaagttccagctgaagaaggttctctgtatgggtgttgctgttggaaacctctccatggaggagaagcaggtcttccaaaacgtgcagatgagtgttaatttccttgtttcactcttgaagaagaactggcaaaacgtgaggtgcttgttcctgaagaccaccatggggaagccacaacgcgtgttttaaacttttaatctatttttacatgtatggtggagttttgtagtgaggttttatgaggttgatacttatataaagtattcagatggaattctcaaagttgctgcattacttagctgtttaaggtttataacatcgacatatgttatgttaaaattactttttttattcttgttggataatcaattttttttgtctactcgtgcccctaatttttggaacacaagatacaattgtctttaatatttcgagaacgacaagccgtttagatttc

SEQ ID NO: 1119 - DNA, 1311 bp, Pinus pinaster
attggggggccccgtacatcacatgaatgccatgaaatctatgtaaccttaagccctagcagccacattagaccttaacatgtaattcatgtaaccctaaatctctgtggtcacattagccctatataatgtcagtatattagggtttttatctctcagttcgatcctaaaccctaattgagggccggtcgtgtctaggagagcgcgtgcagaggaaggcgcaaggccagggcaaaaatgagtaagcttcagagtgatgcgttgagggaggccatctcccagatcatgggagatactaaggagaaacaacgtaaattcacagagacaatcgagttacagattggcctaaaaaattatgatcctcaaaaggacaagcggttcagtggttctgttaagttacctcacattcctcgccctaagatgaaggtttgcatgcttggagatgctcagcatgtggaagaggctgaaaaattaggcttggattatatggatgttgaaggactaaagaaaatgaacaaaaacaagaaattggttaagaaacttgcaaagaaatatcatgcctttcttgcttcagaagcaatcattaaacagatacctcggcttcttgggcctggtctcaacaaggctggcaaatttcctacccttgtatctcaccaagagtccctggagggaaaagtgaatgaaaccaaagcaactgtcaaatttcaattaaaaaaggttctatgcatgggggttgctgtggggaactgtggaatggaagaaaaacagatttttcagaatgtgcaattgagtgttaacttccttgtatcactactgaagaagaactggcagaatgttaggtgcctatatttgaagagtaccatgggaaagcctaaccgtgttttctgagtggagcagagtggagatattataatgacactttatttttgtgtaactattaaacataggttatttttacttaatttctaccaaactaattgattttgatgcaaatattgaggaattgagaaatgtaagtgctggtaaattgctgttttgaacaatagaatttgttttctattggaatagctcgggtcatggttttagactttaagcctgacattcaatgttctaaaatcatgttgtggtattgaagtctatctagatttttaattagtgacattattgttagagagccttttgttcaattggaaattatctcatgcaaggggattgtttctttgttgtaaatttatttgatttgtgttcctgatatgccttatttgtggcatcttggaattgttctacaacgataaatctcagacacgcgag

SEQ ID NO: 1120 - DNA, 719 bp, Elaeis guineensis
acttctcccgccgccttctcctctctctccgagctcttggaaggagcgtcgaagtgaaagcaggagaaatccaccagaacaatgagcaagttgcagagtgacgttttgagggaagcaatctctcagctgacaaatgattctcgggagaagaagcgcaattttactgaaaccatcgagctgcagattggtctgaagaactatgacccccaaaaggacaagcgcttcagtggatctgtgaagttacctcatatccctcgtccaaaaatgaaggtctgcatgcttggtgatgctcaacatgttgaggaggcagagaaaatagggcttgactatatggatgttgaagcactaaaaaagatgaacaaaaacaagaagctggtcaaaaagcttgctaagaagtaccatgctttcctagcatcagaagcaatcattaagcagattcctcgtcttcttggtcctggtctcaacaaagcagggaagtttcccacattggtgactcatcaggaatccctggagtcaaaagttaatgagacaaaagcaatggtgaaatttcagctcaagaaagttttgtgcatgggtgttgctgtgggtaattgtgcaatggaggagaagcagatctttcagaatgtgcaacttagcgttaactttcttgtgtcattgttgaagaagaattggcaaaatgtgaggtgcttgtacctgaagagcaccatgggtaagccgta

SEQ ID NO: 1121 - DNA, 872 bp, Phalaenopsis aphrodite
gccacttttcattctctccgacgaaaaatttagcagctaagtccggcttggaactatgagtaagttacaaagtgatgttttgagggaagcaatatcccaacttgtcaacgactctcgtgaaaaaaagcgcaactttacggaaactattgaactgcaaattggactgaaaaattacgatcctcaaaaggataagcgctttagtggctccgttaagctgccccatattcctcgtcccaagatgaaggtctgcatgcttggcgatgcccaacatgttgaagaggctgagaagataggtttggagtggatggatgttgaagggctgaagaaaatgaataagaacaaaaagcttgtcaaaaagcttgctaagaaatatcatgctttccttgcgtccgaagccatcatcaaacaaattccccgccttcttggccccggtctcaacaaagcaggaaagtttccgacactcgtgactcatcaggaaactctcgaatcaaaagtcaatgagaccaaagcaatggttaagtttcagctgaagaaagttctctgtatgggcgttgctgttggaaattgtgcgatggaagaaaagcagatctttcagaatgttcagctcagtgtgaattttttggtctctcttctgaagaaaaattggcaaaacgtgaggtgcttgtatctgaagagcacaatgggcaagccttacagagtgttctgagcagcttatgaggagttttgcctaggagaaaattatggagacaattacatttttgttttattaaaatatttgcacatctatcccttttttggtgcctgctttatgttgtgaatgattttctgttgctttaatgagatttttctcccttaaaaatattatatttacc

SEQ ID NO: 1122 - DNA, 872 bp, Sarracenia psittacina
ttgctcattcatcggcgatcacatactctagtccagggtttttgttatcagtacataagtctgaggaaaggaaatagtttcagtcatgagtaaacttcagagtgaagccttgagggaagcaatttctcaaatttctaatgatgccaaggagaaaaagcgtaacttcactgaaaccattgagctgcagattgggcttaaaaactatgatcctcaaaaggataagcgtttcagtggttctgtaaagttgcctcacatccctcgtcccaagatgaaggtttgcatgcttggtgatgctcagcacgtggaagaggctgagaagataggtttggagtatatggatgtggaagggctgaagaagcttaacaaaaataagaaactggttaagaaacttgctaagaaataccatgccttcttggcatcagaagctgtcatcaagcagattccccgtctattaggcccaggtctcaacaaagcagggaagtttccgacccttgttagtcaccaggaatctctcgagtctaaagtcaatgaaactaaagcaacagtaaagttccaactgaagaaggttctctgcatgggagttgctgttggaaactgcagtatggaggagaaacagatctttcaaaacgtgcaaatgagtgttaattttctagtttcattgttgaagaagaactggcaaaatgtgaggtgtttgtacctgaagagtaccatggggaagcccgtccgcattttctaagctgtttttttcccctcgttgattattcgattctatggagggattttgtttgagcaaattatcatgtaagatcttcctggattgagcaattttcctttttgtttgcctgctgctgttgaatgcattgaaaccatta

SEQ ID NO: 1123 - DNA, 1199 bp, Picea glauca
atcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacggagacgattgagttacagattggccttaagaattatgatcctcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcctctgccatttctgtattcggtacataacaaaataaatcctagatactgtttttggttggaagttatctaatgtaaggggattgtttcttttgttagaaaaaaaaaaaaaaaaaaaaagtaactactaccgtagtatacctactacgtacgttctacgtaggaactta

SEQ ID NO: 1124 - DNA, 1183 bp, Picea glauca
actcacattagccccttttataaagtcgatatattagggtttttatctcttctttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacagagacgattgagttacagattggccttaagaattatgatccgcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcacgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcctctgccatttctgtattcggtacataacaaaataaatcctagatactgtttttggttggaagttatctaatgtaaggggattgtttcttttgt

SEQ ID NO: 1125 - DNA, 1112 bp, Tabernaemontana elegans
tatatctcaatatcgccgcggccaccgaagtgcccgtcctcccctttaccagtactccactggagcgcaatccgggagtgaagagtgacgaatttcggagattttaaatcatgagtaagcttcaaagtgatgccctcagagaagccatttctcagataaaaaatgatgctgctgagaaaaagcgcaagttcactgagacaattgagctccagattgggctgaaaaattatgatccccagaaggacaaacggtttagtggctctgtgaagttacctcacattcctcgccctaagatgaaagtttgcatgctgggagatgctcagcatgtggaggaggctgaaaaaattggtttggagtacatggatgtcgaaggtctgaagaagcttaacaagaacaagaaattggtgaagaagcttgcaaagaaatatcatgctttcttggcttcagaggctgtgatcaagcagattccccgtctcttagggcctggtcttaacaaggctggcaaattccctaccctcgttacccatcaggaatcacttgaatccaaagttaacgagaccaaggccacagtcaagtttcaattgaagaaggtgctttgcatgggagttgcagttgggaattgcgatatggaggaaaagcaaatctttcaaaatgtgcaaatgagtgtgaacttccttgtttccttgttgaagaagaattggcaaaatgtgaggtgcttgtacctgaagagtaccatggggaaaccacagcgcatcttctaaggagagagtttcctctttgctgctgctgctgctgctttgatgagttttatgatgatatgcatctaatatattgtttttagtatgctggcaattttgttaccttaggtatttgtttagtggttgtctcattttgaaacagtgacccagactatcaactcttttctgttattagtttcattaccgcatactaagattttaaatcttattacctgttccttagggccagaaaataactacgaaatttagcagtggatggaactttcctgcaaatggtattgctttgtatgagtaggctctcgtggcttttgcttgtatggaattttggaattatgttttggtcaattttgcttt

SEQ ID NO: 1126 - DNA, 968 bp, Persea americana
ctatttgtttcttcacagccgtcgctcttcttgttcctctttcatctgagagcggagtcataatcagaggaatctcagaagggagaagtttccagtcatgagtaagctccagagtgatgtgttgagggaggccatctctatagttgttgctgatgccagagagaaaaagcgcaactttacagagaccatcgagctgcagattggtctgaaaaactatgatccacagaaggacaagcgttttagtggttctgtgaagttaccacatatacctcgtcctaaaatgaaagtctgcatgcttggtgatgctcagcatgttgaagaggcagagaagatggggctggagtatatggatgttgagggactgaagaagatgaacaaaaataagaaacttgttaagaagcttgcaaaaaaataccatgcttttctagcatcagaagccatcatcaagcagatccctcggcttcttggtcctggtctcaacaaagcaggaaagttccctacactggtgtctcatcaagaatcgctagagtcaaaggttaatgagacaaaagcaatggtgaaattccaactgaagaaggttttatgcatgggagttgccgtgggcaattgtggcatggaagagaagcaaatatttcaaaatgtacagctcagcgtcaactttctggtatcattgctgaagaagaattggcaaaatgtgaggtgcttgtatctgaagagttcgatgggaaaaccaaaccgcatcttctgagttcccatttgctgtatccaagagtacttgctaatttgaggcttttttttagcattattggaggatactctgattatcgttttgggttttttgtgttttttgtttgatgaacttcccacctcagtattagtttactgtgtactacagcttaatgttgacaatgtggtgttttcatctgctacacaggaggttccattaacgtatttgcgtttatttactg

SEQ ID NO: 1127 - DNA, 912 bp, Panax ginseng
ccttacggccggggactccggcgttttctttcggttttgaagtctgaagggtgtagaaagtttcaatcatgagtaaacttcagagtgatgcccttagagaagccatcactcagatttctaatgaggccaaggagaaaaagcgtaatttcaccgagaccattgaactccagattggtctgaaaaactatgatcctcagaaggataagcgtttcagtggttctgtgaagttgcctcacatccctcgtcctaagatgaaggtttgcatgcttggtgatgctcagcatgtggaagaggctgagaaaattggtctggaatacatggatgtggaaggcctgaagaagcttaacaagaacaagaagttagttaagaaacttgctaagaaataccatgctttccttgcttctgaggccgtcattaagcagattccccgtcttttgggtccagggcttaacaaagcaggtaagttccctacactagttacccaccaggagtccctcgagtctaaagttaatgagacaaaggcgacagtaaagttccaactgaagaaggtgctctgcatgggagttgctgttgggaacctcagtatggaggagaagcaaatcttccaaaatgtgcagatgagtgtgaatttcctggtttcattattgaagaagaattggcaaaatgtcaggtgcttgtacctaaagagcacaatgggaaagactgtccgcatcttttaaggagttgtcttctttttggttgaagctttttagcaaagtcagtgtatgagataatattttcccaaaaattccctaaattttcttttttcaagttagctgttattcttgatgctattgaacttgataactatagtgattgctttgttttgatgttttttgttggtatgagatattattaatgtctatgagcatg

SEQ ID NO: 1128 - DNA, 993 bp, Arachis hypogaea
ggtttgtggcggctacggtaacttgcgcgctctctcaatgcgttagctacaacacattacacaatatccgcattttcgttataatagcaacttgttctatttgcagaataatcttttgtggcggcacctcaaacaccaaacctctgctccttacaatgagtaagctacagagtgatgcactgagagaggccatatctcagctcgttgcgaatgcgaacgagaagaagcgcaaattcactgagacagttgaacttcagattggtttgaagaactatgacccccagaaagacaagcgtttcagcggttccgttaagcttcctcatattcctcgccccaagatgaagatctgcatgcttggtgacgctcagcacgtcgaagaggctgaaaaaattgggctggattggatggatgtcgaggcactgaaaaagcttaataagaacaagaaacttgtgaagaagcttgctaagaagtatcatgcttttctagcttctgaagctgtcatcaagcaaattcctcgcctcttaggccctggtttgaacaaggcaggtaagtttccaacattagtgacacatcaggaatccttagagtcaaaagttaatgaaacaaaagcaatggtgaagtttcaacttaagaaagttctttgcatgggtgttgctgttggaaattgctcaatggaggagaaacagatattccagaatgtacaactcagtgtcaatttccttgtttcattattgaagaaaaactggcaaaatgtgagatgcttgtacctcaagagtacaatggggagtgcaatccgcgtattttagattgtttagatatgggtagtttgcattggctaaacctcatgagttgtggacatgttaacgggatgttattgctgacagttaatgcccccatttttttttctgacattcttaagattctttgatatcaattgttttatgataatccttgttttctgtgtcattaatgactggccacaaaagattcata

SEQ ID NO: 1129 - DNA, 1313 bp, Pinus taeda
atgtaatctatgtaacctgaagccctagtagccacattagaccttgacatgtaattcatgcaaccctaaatctctgtggtcacattagccctatataaagtcagtatactagggtttttatctcttagttcgatcctaaaccctaatcgagggccggtcctgtgtaggagagcgcgtgcagaggaaggcgcaaggcgagggcaaaaatgagtaagcttcagagtgatgcgttgagggaggccatctcccagatcatgggagatactaaggagaaacaacgtaaattcacagagacaattgagttacagattggcctcaagaattatgatcctcaaaaggacaagcggttcagtggctctgttaagttacctcacattcctcgccctaagatgaaggtttgcatgcttggagatgctcagcatgtggaagaggctgaaaaattaggcttggattatatggatgttgaaggactaaagaaaatgaacaaaaacaagaaattggttaagaaacttgcaaagaaatatcatgcctttcttgcttcagaagcaatcattaaacagatacctcggcttcttgggcctggtctcaacaaggctggcaaatttcctacccttgtatctcaccaagagtccctggagggaaaagtgaatgaaaccaaagcaactgtcaaatttcaattaaaaaaggttctatgcatgggggttgctgtggggaactgtggaatggaagaaaaacagatttttcagaatgtgcaattgagtgttaacttccttgtatcactactgaagaagaactggcagaatgttaggtgcctatatttgaagagtaccatgggaaagcctaaccgtgttttctgagtgtggatcagagttgagatattataatgacagtttatttttgtgtaactattaaacataggttatttttacttaatttctaccaaactaattgattttgatgcaaattttgaggaattgagaaatgtaagtgctggtaaattgctgttttgaacaacagaatttgtttttctattggaatagctcgggtcatggttttagactttaagcctgacattcaatgttctaaaatcatgttgtggtattgaagtctatctagattttttaatagtgacattattgttagagagccttttgttcaattggaaattatctcatgtaaggggattgtttcttgtgttcctgatatgcctatcttgtggcatcttggaattgtttctacaactataaaatctcaattttttttgaatgtaacttgtggcatcttggaattgtttctaaaaaaaaaaaaaaaaa

SEQ ID NO: 1130 - DNA, 1005 bp, Pseudotsuga menziesii
cgtaggagagcggagacagaggaaggctccaggtgaacaaatatgagtaagcttcagagtgatgcgttgagggaggccatctcccaggtcatggcagatagtaaggagaaacaacgtaaattcacggagacgattgagttacagattggcctcaagaattatgatcctcaaaaggacaagcggttcagtggctctgtgaagttgcctcacattcctcgccctaagatgaaggtttgcatgcttggagatgcccagcacgtggaagaggctgaaaaattagggttggattatatggatgttgaaggactcaagaaaatgaacaaaaacaagaaattggtcaagaagcttgctaagaaatatcatgcctttcttgcttcagaagcaataatcaaacagatacctcgacttcttgggcctggtcttaacaaggctgggaaatttcctacccttgtttctcatcaagagtccctggagggaaaagtaaatgaaaccaaagcaacggtgaaattccaattaaaaaaggtactatgtatgggggttgctgtgggaaactgtggaatggaagaaaagcagatttttcagaatgtacaattgagtgttaacttccttgtatcgctactgaagaagaactggcagaatgtaaggtgcttatatttgaagagtaccatgggaaagcctaaccggattttctgagtgtggagcagagtagagatattacaatagcactttctttttgtaaactattaaacataggttgtttatttaagttcaactgaactaattaattttgatgcaactattgaggaatagaggtagagatatgctggtaatttgctgttttgaatgatagaatttgcttttgtctattgaaattcctttggtcatggttttagacttaaacctaacattcattgttttataatcatgtgatggtgaagtctatcttgtttttcttagtatcatattgttaaagaaagtgctattgtaaactattaaacataggtt

SEQ ID NO: 1131 - DNA, 993 bp, Glycine max
tagggtttttatgaaccccgtcgctcagtaattgtacccggataggcggctaagaataataatctgagacgaccaacctcagcctcttaccatgagtaagctacaaagtgatgcactgagagaggcaatttcccaggtggtgagtaattcaaaggagaaaaatcgtaaattcaccgagactattgagctgcaaattggattgaagaactatgatcctcagaaagataagcgtttcagtggttctgttaagcttccgcatattcctcgccctaagatgaaaatctgcatgctcggtgatgctcagcacgttgaagaggcggaaaaaattgggctggactacatggatgtggaagcactgaagaaactcaataaaaacaaaaaacttgtgaagaagcttgccaagaaatatcatgtttttctagcttctgaagcagtcatcaagcaaattcctcgtcttttggggcctggtttaaataaggcaggtaaatttccaacattagtgactcatcaggagtccttggagtcaaaagttaatgaaacaaaggcaatggtgaagtttcaacttaagaaagttctttgtatgggtgttgccgttggaaattgcacaatggaggagaaacagatattccagaatgtacaactcagtgtcaatttccttgtttcattattgaagaaaaactggcaaaacgtgaggtgcttatacctgaagagtactatggggagcgcaatccgcgtattttaaattcatatatatcttccatttaaatataatcatgggcgaagcctcttatgttatggacatgtaagcgagacattattggtgactgtcgatgccttttctttggcttttttcatattcttttgacgtcaattttgatgtcttgaaaaaaattaccagtaccttgttcatttggtttttatttggtgtgcttgctttgctattaacatttgataggacacgtgggtggctttatgaattgctttgcaatgttc

SEQ ID NO: 1132 - DNA, 1279 bp, Picea glauca
cttggtagttcacatgaattccgagtcatttatgtaacctcgacccttgtagtcacgttagccctttacatgtaatttatgtaaccctaaacccctgtagtcacattagccctttataaagtcgatatattagggtttttatctcttctttcgaatcctaaaccctagtcgagggccggtcgtgcgtaggagagagcagacagaggaggacgctaggcgaaggcaaatatgagtaagcttcagagtgatgtgttgagggaggccatctcccaggtcatggcagatagtaaggagaaacaacgtaaattcacggagacgattgagttacagattggccttaagaattatgatcctcaaaaggacaagcggttcagtggctctgtaaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaacaaatcaattttaatgcaactacttacgaattgaggaagagatgtgctggtaaattgctgttttgaacaataagagttgtttttctattgaaatagctctggtcatggttttagaccttaaacctaacattcaatgttttaaaatcatgccgtggtcgtgaagtctatcttgattttcttataatgtcatattgttagagagaattgtgcttaccttcgtctgccatttctgtattcggtacataacaaaataaatcctagatactgtttttggttggaagttatctaatgtaaggggattgtttcttttgtt

SEQ ID NO: 1133 - DNA, 1275 bp, Picea glauca
catgaattccgagtcatttatgtaacctcgacccttgtagtcacgttagccctttacatgtaatttatgtaaccctaaacccctgtagtcacattagccctttataaagtcgatatattagggtttttatctcttctttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacggagacgattgagttacagattggccttaagaattatgatccgcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcctctgccatttctgtattcggtacataacaaaataaatcctagatactgtttttggttggaagttatctaatgtaaggggattgtttcttttgttgaaaaaa

SEQ ID NO: 1134 - DNA, 1058 bp, Abies balsamea
ccctaatcgagggccggtcgtgtgtacgagagcgccgagagaggaaggcgatagacgaaggcaaatatgagtaaacttcagagtgatgcattgagggaggccatctcccaggtcatggcagatagtaaggagaaacaacgtaaattcacagagacgattgagttacagattggcctcaagaattatgatcctcaaaaggacaagcggtttagtggctctgtgaagttgcctcacattcctcgccctaagatgaaggtttgcatgcttggagatgcccagcatgtcgaagaggctgaaaaattagggttggattatatggatgttgaaggactgaagaaaatgaacaaaaacaagaaattggttaagaagcttgcgaagaaatatcatgcgtttcttgcttcagaagcaatcatcaaacagatacctcggcttcttgggcctggtctcaacaaggctggcaagtttcctacccttgtatctcaccaagagtccctggagggaaaagttaatgaaaccaaagcaactgtcaaattcccaattaaaaaaggtactatgtatgggggttgctgtaggaaactgtggaatggaggaaaaacaaatttttcagaatgtgcaattgagtgttaacttccttgtatcactactgaagaagaactggcagaatgtaaggtgcttatatttgaaaagtaccatgggaaagcctaaccggattttctgagtgcggagcagagtgaatatattacaatggcacttcttttttgtataacaattaaatataggttatgttaatttaatatctaccagactaattaattttgatgccgactcttgagcagttgaggaggagatgtgctgttaaattgctattttgaacgatagaatttgtttttccattgaaatagctctggtcatggttttagaccttaaaccttacattcaatgttttaaaatcacgtcgtgatggcgaagtatatcttgtttttaatatgatgtcagattgtcgagagaattgtgcttaccttccctctcattcctgtatgtcacataacaaaataaat

SEQ ID NO: 1135 - DNA, 1091 bp, Picea glauca
cttctttcgaatcctaaaccctagtcgagggccggtcgtgcgtaggagagagcagacagaggaagacgctaggcgaagacaaatatgagtaagcttcagagtgatgtgttgagggaggccatctcccaggtcatggcagatagtaaggagaaacaacgtaaattcacagagacgattgagttacagattggccttaagaattatgatccgcaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaaccaaagcaactgtcaaattccaaattaaaaaaggtactatgtatgggggttgctgtgggaaactgtggaatggaagaaaaacaaatttttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttcctttttgtataactattaaacataggttatgtttatttagtttcgaccaaactaatcaattttaatgcaactacttaggaattgaggaagagatgtgctggtaaattgctgttttgaacaataagagtttgtttttctattgaaatagctctggtcatggttttagaccttaaacctaacattcaatgttttaaaatcatgccgtggtcgtgaagtctatcttgattttcttataatgtcatattgttagagagaattgtgcttaccttcgtctgccatttctgtattcggtacataacaaaataaatcctagatactg

SEQ ID NO: 1136 - DNA, 1091 bp, Elaeis guineensis
gtttaatacgcatggccagaacctccaggggacgctctctctgtgactggtgcccaaacctaaagaaggatagaagctaatagggcaattcctttgaggagtcgtccaacaaaggagaagaaccatgagcaagctgcagagcgatgtgttaagagaggctatctctcagattatgaatgatactaaggagaaaaagcgcaacttcactgagaccattgagctgcagattgggctaaaaaattatgacccacaaaaggataagcggtttagtggttctgtgaagttgccacatattccgcgtccgaagatgaaggtttgcatgcttggtgatgctcaacatgtggaagaggctgagaaaattggactggactacatggatgttgaagggctaaagaagatgaacaagaataagaagttggtcaagaagctcgcaaagaaatatcatgcatttttagcatctgaggctattattaagcagattcctcgacttttgggccctggtcttaacaaggcaggtaaatttccaacattggttacacatcaggaatctttagaggccaaagtcaacgagaccaaagcaatggtgaagtttcagctgaagaaagttctttgcatgggtgttgctgttgggaattgcgcaatggaggagaagcaagtatttcaaaatgtgcaactcagtgtcaacttcctggtgtctttgttgaagaagaattggcagaatgtgagatgcttgtacttgaagagcaccatgggaaaaccttaccgcgtgttctaagaaaactctttgcaaatctgatggttgattaacaatgcttgggttgacctgccagatttctttcttttattatcattatcatgccaaatctcctctctcccccccctagttctttagtttgaactttctttaaatgttcatctgttaaaatgagagttgtaggtcaagtttttttttatttttttgcttataaactgaaagttctgttttggcctcatatttgagaaacttagttgatggttatggttcaaattcagatattgttataccagtttggtttgccaccattattaaatgatcggtgaaattcaccata

SEQ ID NO: 1137 - DNA, 1108 bp, Lippia dulcis
ccccgacagtcttgcaaaccctaattgagggttttctcatcaggagttagctgggaagatacagatatcttgaatcatgagtaagcttcagagcgatgcccttagggaagccatctctgtgatcacttctgatgctaaggagaagaagcgtaacttcactgagacagtcgagctgcaaattggtctgaagaactatgaccctcagaaagacaaacgtttcagtggctctgtcaaactacctcatattcccaggcccaaaatgaaaatttgcatgcttggtgatgcccagcatgttgaagaggcagcaaaaattggtttggagtccatggatgttgaggctctaaagaaattgaacaagaacaagaagttggtgaagaagctggctaagaagtatcatgctttcttagcttccgaagctgttatcaagcagatcccccgtcttttggggcctggtctcaacaaagcaggcaagtttcccacccttgtgactcaccaagaatctcttgagtcaaaggtgaatgagacgaaggctacagtgaagttccaattgaagaaggtgctctgcatgggagtcgctgttggaaacttggacatggaagagaagcaaatcttccagaacgtgcaaatgagtgttaacttcctggtttctcttttgaagaaaaactggcaaaatgtgaggtgcttgtacttgaagagtaccatgggaaaaccacagcgtatcttttaagagaattgttttctgttacaagttcttagcaaagtcagagttgtatgttcgttaagactatgaactatttcccttgcatgggaatttttgtgttttctatcgttgttgtcgagatgcttttgtttgttgatcagatgcttgttatatgctcaaatagccatatttcttgtttgccggcgcagttcgattatttcaagtgatcatcttaagttaaattgtgcgattagatatcagtatttcacatctatatttaggttggcatttgatatgtgaatctgtattttacattacatttaaggtagaaaattgtcgaatgggttgataaggtattgtgctaatatttcttttggaaaattctccaaatatattctatcaaagatt

SEQ ID NO: 1138 - DNA, 950 bp, Papaver somniferum
ttctaccaggaaaataaccatgagtaagcttcagagtgaagtgttgagggaagcaatctcccagatcaataccgaagctaccgctaagaagcgaaagttcaccgagacagtggaacttcaaattggtcttaagaactatgaccctcaaaaggacaagcgtttcagtggttcagtgaagttgccacatataccccgccctaagatgaaagtctgcatgcttggagatgctcagcatgttgaggaggctcagaagatcggtcttgagtacatggatgttgaaggtcttaagaagcttaacaagaacaagaagttggtcaagaagcttgcaaagaagttccatgcttttctagcctcagaagctgttatcaagcaaattccccgtcttcttggacctggtcttaacaaggcaggtaagttcccaactcttgtgactcatcaagagtcattggaggccaaggtgaatgaaaccaaggctatggttaagtttcaattgaagaaagtgctctgtatgggtgttgctgttggtaaccttggcatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcattacatttctataattgtaagggcaattcctacacgctcttcatgttttgtgagatccctggatgtagggaatgccccaagtcccgagactctgtaatcagatataggtagtttgcatgagtagcagactttttctgaaaatgctcagtaatctttttgtttaattcctgaattcgttttttctgtttttacttggtagttcagggatacttaaatcttgaaagataatgatttggcttttctttatgacttgttaaatagatggttggctttacca

SEQ ID NO: 1139 - DNA, 1061 bp, Aristolochia fimbriata
agtggtaacaacgcatccgacgcgggggggtttttgttcgtgtaactcccctgcttcctatctccaaaaccctgtgagagtttacacttcgaagactctccaccgcaggaaggagactcctcgcgtgcatattttggttttccgtctgcgaagatgagtaagcttcagagtgatgttctgagagaagctattggccaggttatggctgatgccaaagagagaaaacgtaacttcactgaaactattgaacttcaaattgggcttaaaaactatgaccctcagaaggacaagcgtttcagtgggtcagtcaaacttcctcatatcccaaggcccaaaatgaaagtgtgcatgctgggggatgcacagcatgtcgaagaggcagaaaagataggaatggactacatggatgtggaaggcctgaagaaacttaacaaaaacaagaaactagtcaagaaattggccaagaaatatcatgctttccttgcttcagaggcaatcatcaagcaaattcctaggcttctgggtcccggtctgaacaaagccggtaaatttcccaccctggttacccaccaggagtcgctggaatcaaaggtgaatgaaacaaaggcaatggtcaagttccagcttaagaaggttctgtgtatgggagtggctgtagggaactgcggaatggaagagaagcaagttttccagaatatccagctcagtgtgaatttcctggtttctctcttgaagaagaattggcaaaatgttcgatgcttgtatatcaagcgtacaatggggaaaccgtaccgggtgttctaaaagctgtgtcatttgctgaacgagaatttggagctgcttacacacttgtctttgctagaacttatattgagcagtttttggtttaggagtgagtttagtatttcttatgagtttctgtgtaaactttgaaagttctgctaccttttattttgacgtgaaagtttttgatacatttttcaagtgtagtatggcaaagatgaatctgctatataatttcgtttcaaactccaaggttggcttacggtttatcgaaaagt

SEQ ID NO: 1140 - DNA, 1654 bp, Theobroma cacao
aaaacgtatttgaaataaaaaaagaactaaactattgtatcaaaataaggaatgtgcttggtcataacaaaaatagaaccggtctagtattaatttgggctcggcctaatctaaacaaaaccaagtctcatcccgaaagaatttgggctagaccttacccgtggcccaatatcagtttattacaatagctagctagggttttaacacatttgctgatttcctatatatctctccacagcctcaaaaatcaaggctgcggctagggtttctcacatctctggtaaatattatagttttattcgtggaaataacagagattcagggatgagtaagcttcagagtgatgcccttagagaagctatttccaccattgtggctcagtccaaggaaaaaaaccgtaagttcactgagaccattgaactccagattgggctgaaaaactatgatccccaaaaggacaagcgtttcagtggatctgtgaagctgccacacattcctcgccctaagatgaagatctgcatgcttggagatgctcaacatgttgaagaggcagagaagataggcttggattatatggatgttgaagcactgaagaagcttaacaagaacaagaagttggtcaagaagcttgccaagaagtatcaggcctttttggcatctgaagctatcatcaagcagatccctcgtctcttgggtcctggtctcaacaaagcagggaaattcccaacccttgttactcaccaggaatccctagagtccaaggtgaatgagaccaaggcaatggtgaagttccaactgaagaaggttctttgcatgggagttgctgttgggaatgtagctatggaggagaagcagatcttccaaaatgtgcaaatgagtgtcaatttccttgtttcattgttgaagaaaaactggcaaaatgtgaggtgcctctacctgaagagtaccatgggcccttcaaacaggatcttttgagatgatatttactttctattagtgttatgtacggagtgaaagtagttgttgggattaatagtaaatcagttttttactcagaatgttcaaattttgtgttatgttttgttgctggaatccgtagaaatattatgaatttgagaccttggaagttttgttttgcatatcaactgagtttttccattaatgttaaaaatttcaatctttcaaatatgcctccggaaaagaaatcctctacaaacagttggcagccaagatgggttaatggctattggctgccttgcatgctgcttctactattccgttcattttttgacgataagttgttgagttatgatgcttgatcgtgaatttagtataaacctcccttaccattgtaccgttcaaattgcatacattatcggtaatgatcctttctggaagctcatattgacatattatctctctttttatgaacttgcacatcactttttgcctcacattagcataggaagctgcttctacccatttgtgaagtaatcaagggccaccaatataaattgatgtccattagaagcttttgctagtaatgagcccaatcacatacattcctcatattgaaaaaggccacagtgttgtgaagacgtgtaatggagatggtggagcgtggattttattagcataaattgggcatttgtgg

SEQ ID NO: 1141 - DNA, 966 bp, Cyamopsis tetragonoloba
cacgaggctgtattcttcctgaatttgccgcagacgagagttttggaagatgagtaagcttcagagtgatgctctgcgagaggctatctcaggaatcatgactgattccaaggagaaaaatcgcaaatttgtggagactattgaactccaaattggtttgaagaactacgatccacagaaggataagcgttttagcggctctgtcaagttgcctcacatccctcgccctaagatgaaaatttgcatgcttggtgatgctcaacatgttgaagaggctgagaagataggcttggactacatggatgtcgaagcattgaagaagctaaataagaacaagaagttggtgaagaaacttgctaagaagtaccatgcttttttagcttctgaagctgtcattaagcagattcctcgtcttttgggtcctggtctcaacaaggcagggaagttccctacacttgtcactcaccaggagtcccttgagtcgaaggttaatgagactaaggccatggtcaaatttcaactcaagaaggttctctgtatgggtgtagctgtcggcaatgtcagcatggaggagaagcaaatcttccaaaatgtgcagatgagtgtcaactttctggtctccttgttgaagaagaattggcagaatgttaggtgcttgtatctgaagagtaccatgggaaaatcctacagggtgttttgatgtgttttctcttcattttaatttccgtgaaattgtgttgcgcccaatgcactttatatcttgataactggataaaaatttcatgttacagttttgttgaggttttatggttagtgttgtgttttcatgttcaaacattggataatgatagacttgctactttagcggctgctctcgtctcgtattttcctgttttatggtgcaaccgttccaggtttgtttttatatatttattcataaaggatgatatagattatttaatagta

SEQ ID NO: 1142 - DNA, 1060 bp, Cycas rumphii
  misc_feature (22)..(22): n is a, c, g, or t
  misc_feature (24)..(24): n is a, c, g, or t
  misc_feature (1002)..(1002): n is a, c, g, or t
tggatccaaagaattcggacgngnttgtctttgagaggtggagaaggggagagcagaggagctgaggttgatatcatcataggagatgagtaagcttcagggtgatgtgctgagagaagccatcgcacaggtgatggcagacagcaaggagaagaagcggaagttcagcgagaccatagagttgcagataggtctgaagaactatgacccacagaaggacaagcgtttcagtggatctgtcaaattgcctcacattcctcgccccaagatgaaggtttgcatgcttggggatgcccagcatgttgaagaggctgagaagataggtttggattacatggatgttgaggggctgaagaagatgaacaagaacaagaaactggttaaaaaacttgccaagaaatatcatgcatttcttgcttcagaagcaattattaaacagattcctcgccttcttggtcctggtctcaacaaggccggtaaatttcctaccctggtatcgcaccaagaatctttggaggcaaaagtgaatgaaacaaaggcaatggtcaagtttcaattgaagaaagtgctttgcatgggtgttgctgtgggtaactgtggaatggaggagaagcagatttttcagaatgtgcagttgagcgtaaactttctggtgtcactcctaaaaaagaattggcaaaatgtaaggtgtttgtatctgaagagtaccatgggcaaaccgaaccgcatattttgaatgtgtaatattgctttagtgctgctttgtgggtaaacagtttttctgttgcttgtttgggtatagttataaaggattgaagcaatcaattttgaattaaattttccactagaggcagatgtcggccgagagctgacatatatcaccattcagaggaaaagcctagtattggaaagctaccttttttatttatttttataacttggcatgttttactgttctgtttctggaaagctagttggtggattggtttggcattcatgtanttgcacctatttccagttttccctatcaagaaactaattaaagctaattattagtcgt

SEQ ID NO: 1143 - DNA, 981 bp, Panax ginseng
  misc_feature (889)..(889): n is a, c, g, or t
  misc_feature (907)..(907): n is a, c, g, or t
  misc_feature (917)..(918): n is a, c, g, or t
  misc_feature (920)..(920): n is a, c, g, or t
  misc_feature (927)..(930): n is a, c, g, or t
  misc_feature (932)..(932): n is a, c, g, or t
  misc_feature (934)..(934): n is a, c, g, or t
  misc_feature (943)..(943): n is a, c, g, or t
  misc_feature (945)..(947): n is a, c, g, or t
  misc_feature (950)..(950): n is a, c, g, or t
ccgcgggaattcgatttcgagcggccgcccgggcaggtacgcggggacttctaggcagtcgcaaccctaatctagggtttcattccagtatcgaagtcactgaagtcggaagaaagtttcaagcatgagtaaacttcagagtgaagccctgagagaagccatcactcagattactaacgaggccaaagagaaaaagcgtaatttcacggagaccattgaactccagattggtctgaaaaactatgacccccagaaggataagcgtttcagtggttctgtaaagttgcctcacatccctcgtccgaagatgaaggtttgcatgcttggtgatgctcagcatgtggaagaggcagagaaaattggtctggaatacatggatgtggaaggcctgaagaagcttaacaagaacaagaaattagttaagaaactcgcaaagaaataccatgctttcctagcttctgaagctgtcattaagcagattccacgtcttttgggcccagggctcaacaaagcaggtaagttccctacactaattacccaccaggagtccctcgagtctaaagttaatgagacaaaggccacagtaaaattccaactgaagaaggtactctgcatgggagttgctgtggggaacctcagtatggaggagaaacaaatcttccaaaatgtgcagatgagcgtgaatttcctagtttcattattgaagaagaactggcaaaatgccagatgcttgtacctaaagagcacaatgggaaagacagtccgcatcttttaaggagtttcctgcttttagtcaggcagtgtatgagagtatttttctgaatatttccttgtaatggacaaattttattttccagctagctgtttctcttgatgttattaagaatantatgaattcaaatatggnttattgtgannanaaaaaannnnanantactcggcngnnnccncgctaatcactagtgaattcgcggcgacaca

SEQ ID NO: 1144 - DNA, 802 bp, Leymus cinereus x Leymus triticoides
  misc_feature (786)..(786): n is a, c, g, or t
tgtcaaggatgccatcacccagattgttggggaggccagagaaaagaaacgcaagttcactgagactgtggagcttcagatcggtctcaagaactacgacccacaaaaggacaagcgtttcagcggctcagtgaagctgccccatatcccccgcccaaagatgagggtgtgcatgcttggtgatgcccagcatgtcgaccaggctgagaaaatggggcttgactacatggatgttgaaagtcttaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaatgagacaaaagctacagtcaagttccagctaaagaaggttctttgcatgggtgttgctgtgggcaacttatcgatggacgagaagcagatccaacaaaacatccaaatgagcgtcaacttccttgtgtccctcctgaagaagaactggcagaatgtgagatgcctgtacgtgaagagcaccatggggaagcgtgtacgggtgttctaagtgggtgcgctccagtgaagttgataagatactgggctgtcctgtcgacccctgcttgtctttggattagatctgtttcactgattccaattttgtgtttacctaatcgaatatcaaaagtattttatcgtactagtcgaaatcatgggagcaatggnactgcattttctgtta

SEQ ID NO: 1145 - DNA, 933 bp, Glycyrrhiza uralensis
ggctacttggttttcctgcttttcattcctctccgttgttaacgatttttgttttcttgttctctgcaattttattcacagctgtgagacctgtagctgacaagccactaattcaaagaaaaaacaatgagtaagcttcagagtgatgctttgcgagaagctatctccggaatcatggctgattccaaggagaagaatcgcaagttcgtcgagaccattgaactccaaattgggctgaagaactatgacccacagaaggacaagcgtttcagcggctctgtcaagcttccccacattcctcgccccaagatgaagatttgcatgctcggtgatgctcaacacgttgaagaggcagagaagataggattggattatatggatgttgaagctttgaagaagctaaacaaaaataagaagttggtgaagaaactagcaaaaaaataccatgccttcttagcttcggaggcagtcataaagcagattcctcgtcttctgggtcctggtctcaacaaagcagggaagttccctacacttgtcactcaccaagaatctctcgagtcaaaggtgaatgagactaaagctatggtgaaatttcaacttaagaaggtgctctgcatgggagttgccgtgggcaatgttagtatggaggaaaagcaaatctttcaaaatgtacaaatgagtgttaacttcctcgtctccctgttgaaaaagaactggcagaatgttcggtgcttgtatctgaagagtaccatggggaaatcttaccgtgtcttttaagggaattccttttctttacctttttttaaaatattcagtgaacttgtaatcgccctcaatacattgattatcataatagctggatagaaattttcatcttgttacagttttgctggataatttgttgttagagttttgtttctatgtttgaacatt

SEQ ID NO: 1146 - DNA, 791 bp, Glycyrrhiza uralensis
acctagctagagttttgcctccggtgtgagatctgttgccggctagcagctgatttgaatagccccaagtatcgaagatgagtaagcttcagagtgatgctttgagagaagctatctcaggaattatggctgattccaaggagaagaaccgtaaatttgttgagaccattgaactccagattgggctaaaaaactatgacccacagaaggacaagcgttttagcggctctgtcaaattgccccacattcctcgacccaagatgaaaatctgcatgcttggtgatgcccaacacgttgaagaggctgagaagataggactcgactacatggacgtcgaagccttgaagaagctaaacaaaaacaagaaactggtgaagaaactagcgaaaaagtaccatgcttttttagcttctgaagcagtcattaagcagattcctcgtcttttgggtcctggtctcaacaaagcagggaagttcccgacacttgttacccaccaagaatctcttgagtcaaaggttaatgagaccaaggccatggtcaaattccaacttaagaaagtgctctgcatgggagtagctgtaggcaatgtcagtatggaggaaaaacaaatcttccaaaacgtacaaatgagtgttaacttccttgtctccttgttgaaaaagaactggcaaaacgttaggtgcttgtatctgaagagtaccatggggaagtcgtaccgtgtcttttaatttgtttttaatttcagtgaatttctgattgcacttgatattttgattattgtaatagctgtg

SEQ ID NO: 1147 - DNA, 959 bp, Liriodendron tulipifera
gcctcttagggtttttctctcttcaacctccgcctcttctcttctccactggagagtaatttctgaaggaatttcagaaaggagaaaatcaaaatcatgagcaagctccagagtgaggcattgagggaggcgatcacccaacttgtcagtgatgccaaggagaaaaaacgcaactttacagagaccatagagctgcagattgggctgaaaaattatgatccacaaaaggataagcgtttcagtgggtctgtgaagttgccacacattcctcgtcctaaaatgaaggtctgcatgcttggtgatgcccagcatgttgaagaggcagagaggataggattggactatatggatgttgaaggactcaagaggatgaacaaaaacaagaagttggtcaagaagcttgcgaagaaataccatgcttttctagcatcagaagcgatcatcaagcagatccctcgacttctgggccctggtctcaacaaagcaggaaagttccctacattggtgtctcatcaggaatccctagaggcaaaagttaatgagacaaaagctatggtgaagttccaactgaagaaggtgctttgcatgggagttgctgttgggaactgtgggatggaagagaagcaaatctttcagaatgtgcaacttagtgtcaacttccttgtatcgttgctgaagaagaactggcaaaacgtgaggtgcctgtacttgaagagcacaatggggaagccgaaccgcatcttctgaggtactcctttctatacgatgtttttgtttaggtggttttcaagcaaaagctcacttgcatttctgtaggaaatactgagctatcattttagattttttttccttcttttttccttttattaaatactgaatatactgcagcctgagcaactactaccaatgttaaattcattggacaccgaacctgtagattgattttcatctgttgcagc

SEQ ID NO: 1148 - DNA, 719 bp, Nuphar advena
  misc_feature (565)..(565): n is a, c, g, or t
  misc_feature (598)..(598): n is a, c, g, or t
tccgggctcgagctgaagttattgtgcaaaagccagcaagatgagcaagctccagagtgatgcattaagggaagctattactcaggtggttggtgaatcaagagataaaaaacgcaagttcactgaaacaattgaacttcagattggtttgaaaaactatgatccacaaaaagacaaacgtttcagtggatctgtaaagctacctcatattccccgtccaaaaatgaaagtttgcatgctaggtgatgctcagcatgtggaggaggctgagaagataggactggattacatggatgttgaaggtttaaagaagatgaacaagaacaagaagttggttaagaagcttgccaagaagtatcatgcttttcttgcatcagaagctattatcaaacagattcctaggctccttggtccaggtcttaacaaggctgggaagtttccaacccttgtttcacaccaggagtctctcgaatcaaaggtgaatgaaaccaaagcaatggttaagttccaacttaagaaggtcctctgcatgggagttgctgttgggaattgtgccatggagganaagcagatcttccagaatgtgcaacttagtgtnaacttccttgtttcactattaaagaagaactggcaaaatgtgaggtgcttgtacctgaagagtaccatgggaagggcaattagggtattctaagtggtgcatctggtctccacacaatttg

SEQ ID NO: 1149 - DNA, 904 bp, Avena sativa
gctgcctctccctcccttcgaccgccgccgcaccatcgacgaaatccttcgtcgactgatcggaggcaaccatgagtaagctttcaagtgatgcggtcaaggaggccatcacccagattgttggggaggccagagagaagaagcgcaagttcactgagactgttgagcttcagattggtctcaagaactatgacccgcaaaaggacaagcgtttcagtggctctgttaagctgccccatatcccccgcccgaagatgagggtgtgcatgcttggtgatgcccagcatgttgaccaggctgagaaattgggacttgactccatggatgttgaaagtctcaaaaagatgaacaagaataagaagcttgttaagaagttagccaagaagtaccatgctttcttagcatctgaggccatcatcaagcagatcccccgtctccttggtcctggtctcaacaaggcaggaaagttccccacactggttagtcactctgagtctcttgaagccaaggtcaatgagacaaaagctacagtcaagttccagctaaagaaggttctctgcatgggtgttgctgtgggtaacttgtcgatggatgagaagcagatccaacagaaccttcaaatgagcgtcaacttccttgtgtcccttctgaagaagaactggcagaatgtgaggtgcctgtacgtgaagagcaccatggggaagcgtatccgggtgttctaagtggtcttgctccagtgaagttgataagatactctgtactgtcaacccgagtttgtcttcgatttagatctgtttcactgatgccaattttgtgtttatctaagcgaatatcagcaaagtattctgtctctggtagtcattttgaacttgttgagaaatggatctgcgtttctattgtgatt

SEQ ID NO: 1150 - DNA, 1125 bp, Sorghum bicolor
agccgcacgccgccgccgccgctcgctcctcgcccgctgtcctcgcccgaccacagccggaaggaacgctgctagcacttccggtagcggcgacatgagtaagctgcagagtgatgctctgagggaggcgattgcctcgattaccaatgattcccgtgagaagcagcgcaagtttgttgaaaccattgagctgcagattggtcttaagaactatgaccctcaaaaggacaagcgtttcagtggttctgttaagctgcctcacatccctcgccctaagatgaaggtttgcatgcttggtgatgctcagcacgttgaggaggcagagagaataggtctagacagtatggatgtggaagccctcaagaagatgaacaaaaacaagaaactagtgaagaagctggcaaagaagtaccatgctttccttgcgtctgaggctatcattaagcaaattcctcgtcttcttggtcctggtcttaacaaggcaggaaaattccctaccctggtgacacatcaggaatccctcgagtccaaggttaatgagacaaaggctacagttaagttccagctaaagaaggtgctttgcatgggtgttgccgttggcaactgtggtatggaggagaagcaaatcttccagaatgtgcaaatgagcgtcaacttcctcgtgtcactcttgaaaaagaattggcagaatgtgagatgcctgtacctgaagagcactatgggaaaggtgtaccgggtgttctaaaatttccatttagccatagaacttccaggagacttgagtgcttgggccattttgcaattttccctacgaaccatttttttgtgcaactatcgaggattaagtagttaaaccctggtcttgtatggaatgttttgattctttatactgaactcacaggtggtcttttattttcttgagccctatccctacggtcgtctagtttttaacccgattgctttatttatcgcatccaatggaattgatgcattatcgttgcttggctgtttcaagtcacggtatggtcggtgccgactggcagtggtgattttttatgcgttccccatccgacatcggacacagaatcttggtgtatccttattgggacgttggactacccgaag

SEQ ID NO: 1151 - DNA, 1464 bp, Sorghum bicolor
caagtgtagtagtagcaatttagcccacgaaaagatccacagccggcccagcccacggtataaccctacccccaaggtatttaattcccagcgccagtcggccacgctcccagccgcacgccgccgccgccgctcgctcctcgcccgctgtcctcgcccgaccacagccggaaggaacgctgctagcacttccggtagcggcgacatgagtaagctgcagagtgatgctctgagggaggcgattgcctcgattaccaatgattcccgtgagaagcagcgcaagtttgttgaaaccattgagctgcagattggtcttaagaactatgaccctcaaaaggacaagcgtttcagtggttctgttaagctgcctcacatccctcgccctaagatgaaggtttgcatgcttggtgatgctcagcacgttgaggaggcagagagaataggtctagacagtatggatgtggaagccctcaagaagatgaacaaaaacaagaaactagtgaagaagctggcaaagaagtaccatgctttccttgcgtctgaggctatcattaagcaaattcctcgtcttcttggtcctggtcttaacaaggcaggaaaattccctaccctggtgacacatcaggaatccctcgagtccaaggttaatgagacaaaggctacagttaagttccagctaaagaaggtgctttgcatgggtgttgccgttggcaactgtggtatggaggagaagcaaatcttccagaatgtgcaaatgagcgtcaacttcctcgtgtcactcttgaaaaagaattggcagaatgtgagatgcctgtacctgaagagcactatgggaaaggtgtaccgggtgttctaaaatttccatttagccatagaacttccaggagacttgagtgcttgggccattttgcaattttccctacgaaccatttttttgtgcaactatcgaggattaagtagttaaaccctggtcttgtatggaatgttttgattctttatactgaactcacaggtggtcttttattttcttgagccctatccctacggtcgtctagtttttaacccgattgctttatttatcgcatccaatggaattgatgcattatcgttgcttggctgtttcaagtcacggtatggtcggtgccgactggcagtggtgattttttatgcgttccccatccgacatcggacacagaatcttggtgtatccttattgggacgttggactacccgaagagtaactgtttgttgtttcgctgcgttcgggtttctccgtatatagctgccaatattaagtttgggctttcaatcaatctgtaaatgtagattcttgtacagctatactgggtaaaaatataatcgatgcacgtacccgtcactcgcgcatcagctagtgcgtcttctcttgtaatgtatcttgttgtgacgcagaatgtggcgcgaacacaaagattctagttggac

SEQ ID NO: 1152 - DNA, 994 bp, Saccharum officinarum
ccggacgccgacgccgccgccgccgccgctcgctctgtcgcccgctatcctctcccgaccacagcccgaaggaacgttgcttgcacttccagtggcggcgacatgagtaagctgcagagtgatgctctgagggaggcgattgcctcgattactaatgattcccgtgagaagcagcgcaagtttgttgagaccattgagctgcagattggtctcaagaactatgaccctcaaaaggacaagcgtttcagtggttctgttaagctgcctcacatccctcgccctaagatgaaggtttgcatgcttggtgatgctcagcacgttgaggaggcagagagaataggtctagacagtatggatgtggaagccctcaagaagatgaacaaaaacaagaagctagtcaagaagctggcaaagaagtaccatgctttccttgcgtctgaggctatcattaagcaaattcctcgtcttcttggtcctggtcttaacaaggcaggaaaattccctaccttggtgacacaccaggaatctctggagtccaaggttaacgagaccaaggctacagttaagttccagctaaagaaggtgctttgcatgggtgttgctgttggcaactgcggtatggaggagaagcaaatcttccagaatgtgcaaatgagcgtcaacttccttgtgtcactcttgaaaaagaattggcagaatgtgagatgcctgtacctgaagagcactatgggaaaggtgtaccgggtgttctaaactttccaattaggcttagaatttcctggagacttgagtgcttgggcgcctttgcaattttccctaccaaccaatattttgtgcaactactatcgaggattaagtagttaaaaccctggtcttgtatggatgttctggttcatgataccgaacttatgacattatcgtatttcaatgttgctgtcttcactcacgggtacagccgtacaggctttgatgatcttttattttcttgagccct

SEQ ID NO: 1153 - DNA, 1253 bp, Zamia vazquezii
ctcgttcttattccagttcgtagggtttctggttgcgaggccgcgaggaaaggtggagaagaggaagcgtagcagcggagattgatctcgttgtaagcaatgagtaagcttcagagcgatgtgttgagggaggccatcacacaggtggtcacagacagcaaggagaagaagcgcaagttctccgagacaatagagttgcagatcggccttaagaactatgatccacagaaggataagcgtttcagtgggtctgtcaaattgcctcacattcctcgccctaagatgaaggtctgcatgcttggtgatgcccagcacgttgaagaggcggagaagataggtttggattacatggatgtagaagggttgaaaaagatgaacaagaacaagaaattggtaaaaaaacttgcaaaaaagtaccatgcctttcttgcttctgaagcaattattaaacagattcctcgtctgcttggtcctggtcttaacaaggctggtaaatttcccacccttgtatcgcaccaagaatctttggaggcaaaagtgaatgaaacaaaggcaatggtcaagtttcaattgaagaaagttctttgtatgggtgttgctgtgggaaactgtggaatggaggagaagcaagttttccaaaatgtgcagttgagcgtaaactttttggtttcgcttctgaaaaagaactggcagaatgtaagatgcttgtatctgaagagtaccatgggcaagccaaatcgcatattctaaatgagcaaattattctttttggtcttgagtcttgggcatttctttgtagaagcattaactgcacatagaaggcattgtagtggatatggtacctattttaacatttatgaatctatctgctgatgaggctgaatgattgtttggtaaactttggtagattttgactgaaattttggttgtctttatgatgtttaaataactattcatagctcagttaagttatagtcctcatctcaggctagcatgtaatgagtgaagcatgatttcatgatgaacattataaacgagtagctggttttagctcagttaagttatagtcctcatctcaggctagcatgcaatgagtgaagcatgatttcatgattaacattataaacgagtagctggttttaatgtttgtcaaagtcttgtgagacatcactgccccagaagtttgcttatgaaggcagttaaagaggtctgctaggtaacattttgaaggagtaacttgttttgccggtagc

SEQ ID NO: 1154 - DNA, 878 bp, Eschscholzia californica
gttgtcgttctgttagggtagaaatctgtagtgggtttcacggaaatcgttaaccatgagtaagcttcaaagtgaagttctaagagaagcaatcacccaaatcacagctgatgctaaggagaaggcaagaaagttcactgagacagttgagctccagattggtcttaagaactatgaccctcaaaaggacaagcgtttcagtggttcagtgaagttgccacatatcccccgccctaagatgaaagtgtgcatgcttggagatgctcaacacgtcgaagaggcagagaaaattgggctagactacatggatgtcgaaggattgaagaagcttaacaagaacaagaaattggtcaagaagcttgcaaagaagttccatgcttttctagcatctgaagctgtcattaagcagattcctcgtcttctcggccctggtctcaacaaggcaggaaaatttccaacacttgtgagtcaccaagaatcattggaagccaaagttaacgaaaccaaggctatggtgaagtttcaactgaagaaggttctctgcatgggtgttgctgtgggtaacctcggaatggaagagaagcagatcttccagaatgtgcaattaagtgtcaacttccttgtatcattgttgaagaagaattggcagaatgtgaggtgcttatacttgaagagtacaatggggaagcctgtccgcatcttctaagtattcaattaccccgaaaaatagatgggtactttttttggttatgatctcaaatttctttgatgttcttttcatgaccctaagcccagtgcttaactgaaatcttgaaaaacaaagttttgttttcttgttgttttgagttgaatagttcttctgtagcagttcatacttt

SEQ ID NO: 1155 - DNA, 1027 bp, Amorphophallus konjac
gacctccgcggtttttctctcctcaggaaaacgcgtagagggatacctggaggtaccgtcgacgaggcggcgcggcgaccatgagtaagctacagagtgatgtactgagggaagctattacccagcttgtcactagctcaaatgaaaagaaaaggaagtttactgaaaccattgagctgcaaattggtctgaagaactatgatcctcagaaagacaaacgtttcagtggttcagtgaagctcccacatatacctcgccccaaaatgaaagtatgtatgctcggagatgctcagcatgttgaagaggccgagaagatggggttggattacatggatgttgaagggctaaagaaaatgaacaagaacaagaagcttgtgaagaaacttgcaaaaaagtatcatgcatttcttgcatcagaagctataatcaagcaaattcctcgtcttctgggtccgggacttaacaaggcaggaagtttccaaccctagtctctcatcaggagtccctggaatcaaaagtgaatgagaccaaggcaatggtgaaatttcagcttaagaaagttctttgcatgggtgttgcagtgggtaattgtcaaatggaggagaagcagatctttcagaatgtgcagctctctgtcaacttccttgtgtctctgcttaaaaagaactggcaaaatgttaggtgtttatacctgaagagcaccatggggaaaccgattcgtgtgttctaagttgcagaggctgtatcttttattgctctcttgagcctgccatttcgagggtccggcaacggaagctgatgtcttcctgtcttatcattgtttgcgtaggacaactgtagttttgagcactatgaacacaatcatttttgtcatcagtgtagctggaaattcacttcattctgcttgacattaaacttttaacactctctttggtcttgttctttcaaaaaggtacattttttctcttccattgctagagcatatgacaagtaaaatcattttcttccaagaccattcttggaagag

SEQ ID NO: 1156 - DNA, 1101 bp, Primula obconica
gttatcgatttttgccctcgatttgtatacatatcttgtttagttctcttcgatttattcctaactgtttaattgaaagtgtattcagctatcgtgttttctttttctttgatttgatcttatttttttagtagtttctaatagttttttaaaaaaaatatttgctgttattgttgcagatttgggttaagcaagagtttcagtcatgagtaagcttcagagtgatgtcttgaggaggcgatagctcagattcacaaggacgccactgagaaagcacgcaagttcactgaaacaattgagcttcagattggactgaaaaattacgatcctcaaaaagacaaacgtttcagtggctctgtgaagttgcctcacatccctcgccccaagatgaaggtttgcatgcttggtgatgctcagcatgtcggagaggctgagaagatagggttggaatatatggatgttgaatcgttgaagaagcttaacaagaacaagaaacttgttaagaaacttgccaagaagtatcatgcctttttggcatcagaagctgtcattaagcagattcctcgtcttctaggccctggtctcaacaaagcaggaaagtttcccaccctggtctctcaccaggagtctctggagtctaaagtcaatgagactaaagcgacagtcaagttccaacttaagaaggttctctgcatgggtgttgctgttggaaactgcggaatggaggagaagcaaattttccaaaatgtgcagatgagtgtcaatttcctcgtttctctgttgaagaaaaattggcaaaatgtgaggtgcttgtacttgaagagcaccatggggaagccagtacgcgtattctaagaacttcagcgtttgggttgctgttttctgcttaatttagacagtttttcaggattaagcatttttcatttgctgtcattttgaattctttcccaatattacttgacattatggtgcgctttatatggagagttttaatatttccttgtgaaagttttaattctacaactcaccagagcttgctcgatctttatcaactttctgatgcttttttcttcaatgttctaatgattgttatggtttttt

SEQ ID NO: 1157 - DNA, 935 bp, Tabernaemontana elegans
gtctttctgaactccatagagtcggtggacctattcacttgtggaaggcaaagactaatcttttaccatgagtaagctacagagtgatgcagtgagagaagcgatctcccagattgttagcgattctaaaggggagaaaaaacgtaagttcactgagactattgagcttcagattgggctgaaaaactatgacccccaaaaggataagagatttagtggctcagtcaaacttcctcatatcccgcgccccaagatgaagatttgcatgcttggtgatgctcagcatgtggaagaggcagagaagatcggtcttgagtacatggatgttgagggcctgaagaaactcaacaaaaacaagaagttggtgaaaaagcttgccaagaagtatcatgctttcctggcatctgaagcagttataaagcagatcccgcgtcttttgggccccggtcttaataaggcaggcaaatttcctacacttgtcactcaccaagaatccttggagtcaaaagtaaatgaaaccaaagctacagtcaagtttcaactcaagaaggttctatgtatgggtgttgctgtgggcaatttggacatggaggagaagcaaattttccaaaatgttcaaatgagtgtcaactttcttgtttcgctattaaaaaagaattggcaaaatgtgaggtgcttatatctgaagagtaccatgggcaggccacaacgcatcttctgagcagttgttttatttactttgttttgagaccatcagtttagtgcgagttaaagtgtgggcagttgcatacactttttggtgaatgtttccgatatttttgctcaactattttaacggattcttcaatcttgaaccaagaaatgaaattttagttccagtctagacaatattcacttgtaacagtttctcctgagctgtgatatctttgcatctg

SEQ ID NO: 1158 - DNA, 939 bp, Citrus sinensis
gtctctagggtttctttttcgtatttgaagaaaaaaaattctgtaaagggctccaagcgcttcaatcatgagtaagcttcagagtgatgcactgagagaggccatctctagtattgtgcaatactctaaggagacaaagaagaggaacttcaccgagactattgagcttcagattggtctcaagaactatgatccacaaaaggacaagcgtttcagtggctctgttaagttgcctcacattccccgccccaagatgaaggtctgcatgcttggtgatgctcaacatgttgaagaggccgagaagattggtttggactacatggatgttgaaggattgaaaaaattgaacaagaacaagaaattggtgaagaaacttgccaagaaatatcatgctttcttggcatcagagtctgtcatcaagcagattcctcgtttgttgggtcctggtctcaacaaggcaggaaagttccctacccttgttactcaccaagaatccctggagtccaaagtcaacgagactaaggcaacagtgaagttccaattgaagaaggtgctttgcatgggagttgctgtcggaaacctttcaatggaggagaagcagatcttccagaatgttcaaatgagtgttaacttccttgtctcattgttgaagaaaaactggcagaatgtcaggtgcctctatctgaagagtaccatgggtccttcaaaccgcatcttttaagaaattctgctttatgttggagttttgtagggaaaacctagtgtgatcttattatacccaaaatgtctttctttgaatggtcacaacctgcaattttctttttctttttctttttcttttcagaatttaatgcactagtaatcttataatatggtagacttgtacgaatttttttgttggagagatgttgaattgaatcatgattgctttctgttaaa

SEQ ID NO: 1159 - DNA, 916 bp, Eragrostis curvula
  misc_feature (915)..(915): n is a, c, g, or t
ccggagcgcggcgcacttctgcctctttgctctcgctccgtcgctcgcctcgcgccaaacccaagggagttgagcggtagattgcaacatgagtaagttgcaaaccgaggtcctcaaggatggcatcgccaatgtcgttaaggatgccaaggagaagaacaggaagttcaccgagacaattgagctatagattggtctgaagaactatgacccgcagaaggacaagcgtttcagcggctctgttaagctgccccatatcccccgcccgaagatgaaggtgtgcatgcttggtgatgcccagcatgtggaggaggctgagaagatggggcttgactacatggatgttgaatctcttaagaaaatgaacaagaacaagaagcttgttaagaagcttgccaagaagtaccacgctttcttggcatctgaggcgatcatcaagcagattccccgtctccttggtcctggtctcaacaaggcaggcaagttcccgacactggttagtcaccaggagtctcttgaatccaaggtcaatgagacaaaagccacggtcaagttccagctgaagaaggttcttggcatgggtgttgctgtgggcaacttgtcaatggacgagcagcagatccagcagaacatccaaatgagcgttaccttccttggtgtcccttctgcagaagaactggcgcactgtcacgtgcctgtacattcagagcacatggggaacccgtacaggtggtctagttactgtgctccctgtgaagttgagtagataccgggcactgaccgacgttggctaaactaagacagtaaacttaagattcgagatgccaaggattaaaagaagttagggcttaatcgtgtacatagaaagtgtggaaatgactagataagatgaggtgatgtgacaaaagaaaacant

SEQ ID NO: 1160 - DNA, 787 bp, Pennisetum glaucum
ccgtgtcggtcaccttcgtctccctcacgcccactcttctcgcgccggcgccgcacttcccgtctctcgtctgatctgcaccaagccctagcaccaggtggatcagtgatcgacggacatcaggcatgagtaagttgcaaaccgaggtcctcaaggatgccatctcccttgtcgtctcagaggccagggagaagaacaggaagctcacagagaccgaactacgacccacaaaaggataagcgtttcagtggctctgtgaagctgccccacatcgatgaaggtccgcatgcttggtgatgcgcagcatgtggaggaggcggagaagattggtcttgattacatggatgttgaagcttgaacaagaacaagaagcttgtcaagtagcttgccaagaagtaccatgctttcttagcttccgaggctattatcaagcagattcctcctctccttggtcctggtctcaacaaggcaggcaagttcccaactttggttagtcaccaagagtctctggaatcaaaagtgaacgagataaaagctacagtcaagttccagctgaagaaggttctttgcatgggcgtggctgtgggcaacctgtcgatggaggagaagcagatccagcaaaacatccagatgagtgtcaacttcttggtttcgttgctgaagaagaattggcagaacgtgaggtgcctttacatcaagagcaccatggggaagccaaacagagtgttctaagttgctgtcttcattgggtctaaaacaagtgctgtacaccgtattgaagtttgtt

SEQ ID NO: 1161 - DNA, 816 bp, Bupleurum chinense
aagcgcagtcgccagccgcaaattagggtttcgtttcaaggtctatagacgaaaccagatttcagccatgagtaagttgcagagtgaagccttgagggaagctatctctcagattacgaaagaagccgttgagaaaaagaggaactttaccgagactattgaactccagattggtctgaagaactatgatccacaaaaggataagcgtttcagtgggtctgtgaagttgcctcacattcctcgtcctaagatgaaggtttgcatgcttggtgatgctcagcatgtgggagaggcagagaaaattggtttagaatacatggatgttgaagggttgaagaagctgaacaagaacaagaaacttgttaagaaacttgcaaagaagtaccatgcttttctagcttctgaagctgtcatcaagcagatccctcgtcttttgggaccagggctcaacaaagcaggcaagtttcctacacttgtttcacatcaggagtcccttgaggctaaagtgaatgagaccaaggctacagtcaaatttcagttgaagaaggtactttgcatgggggttgctgttgggaactgcagtatggaggagaagcagatcttccagaatgtccagatgagtgtgaatttcctagtttcgctgttgaagaagaactggcaaaatgtcagatgtttgtacctgaagagtacaatgggaaagactgtccgcattttttaaaacagttttatattttcggttgaaggtagttggtgtatgaatgagatgtgttttttcccaaatactgttgtggggcatgttctcataagatagctgat

SEQ ID NO: 1162 - DNA, 864 bp, Catharanthus roseus
caggagtgaagaatttcagggacattaaatcatgagtaagcttcagagtgatgccctcagagaagccatttctcagattaagaatgacgctgatgctaaaaaacggaactttacggagacagttgagcttcagattggactgaaaaattatgatccccagaaggacaaacgtttcagtggctctgtgaggttaccacacattcctcgtccaaagatgaaagtttgcatgcttggagatgctcagcacgttgaggaggccgaaaagattggtctggagtacatggatgtggaaggcctgaagaagctgaacaaaaacaagaaattggtcaagaagcttgctaagaaatatcatgctttcttggcttcagaagctgtgataaagcagataccgcgtctcttagggcctggtcttaacaaggctggcaaatttcctacccttgttacacaccaggaatcccttgaatctaaagttaacgaaaccaaggcaacagtaaagtttcagttgaagaaggtgctttgcatgggagttgcagtggggaattgtgctatggaggaaaagcaaatctttcaaaatgtgcagatgagtgtgaatttccttgtttccttgttgaagaagaattggcaaaatgtgaggtgcttgtacctcaagagtacaatgggcaaaccacagcggatcttttgaagagagagtttcttctttactgctgctgtttttttatgtatgagataagcatatctagtaatatattgtttttagtatgatggcaatttaattacgctgtttggtgattgttttagcttgaaaagtgatcaagatcaacaactcttgtttggtaccaagttttgtttgttactgtgatatta

SEQ ID NO: 1163 - DNA, 1027 bp, Cedrus atlantica
gagcgcagacagaggaaagcgctaggagaaggcaaatatgagtaagcttcagagtgatgcattgagggaggccatctcccaggtcatggcagatagtaaggagaaacaacgtaaattcacggagacaattgagttacagattggcctcaagaattatgatcctcaaaaggacaagaggttcagtggctctgtgaagttgcctcacattcctcgccctaagatgaaggtttgcatgcttggagatgcccagcatgttgaagaggctgaaaaattaggtttggattatatggacgtcgaaggactcaagaaaatgaacaaaaacaagaaattggttaagaagcttgcaaagaaatatcatgcctttcttgcttcagaagcaatcatcaaacagatccctcgacttcttgggcctggtctcaacaaggctggcaagtttcctacccttgtatctcaccaagagtccctggagggaaaaattaatgaaaccaaagcaactgttaaattccaattaaaaaaggtactgtgtatgggggttgctgtgggaaactgtggaatggaagaaaagcaaatttttcagaatgtgcagttgagtgttaacttccttgtatcactactgaagaagaactggcagaatgtaaggtgcttatatttgaagagtactatgggaaagactaaccggattttctgattgcggagcagattggggatattacaattgcacgctttttttgtacaactgttaaacataggttatttttatttaatttctacgaaactaattaattttgatgctactattgaggaattggggaagaggtgctggtaaattgctgttttgaacgatagaatttgttttcttactgaaatatatgtggtcatggttttagaccttaaacctaaatagcgttcaatgttttaaaatcatgttttgggtgccttccattatcttagaatttcatcaatcccgtcatacacacaggccacggtatccttttgaatccctgtagacgcgaccaaggttcgaaac

SEQ ID NO: 1164 - DNA, 894 bp, Gossypium hirsutum
ttttcctcctcagctgcgttagggtttctctcttcaggtaaattcttggtagtttcgttcgttttaagaacagagattcgaagatgagtaagcttcagagtgatgcccttagagaagctatttcaaccattgtggctaattccaaggagaaaaatcgcaagttcaccgagaccattgaactccagattgggctgaaaaactatgatccccaaaaagacaagcgtttcagtggttccgtgaagctaccacacattcctcgtcccaagatgaagatttgcatgcttggagatgctcaacatgttgaagaggctgagaagattggtttggattatatggatgtagaagcattgaagaagctaaacaagaacaagaagttggtcaagaagcttgctaagaaatatcatgcatttttggcctctgaatctgtcatcaaacagatcccccgtctcttgggtcctggtctcaacaaagcagggaaattcccaacccttgttactcaccaggaatctttggagtccaaagtgaatgagacaaaggcaatggtgaagttccaattgaagaaagttctttgcatgggagtcgccgttgggaatgtagcaatggaggagaagcagatcttccaaaacgtgcaaatgagcgtcaatttccttgtttcattgttgaagaaaaactggcaaaatgtgaggtgcctttacttgaagagtaccatgggaccttcaaacaggatcttttgaattatgcatggagtgaaatcatttttttaattgagaatgtttcaaaaattatgttatttgatgttggaaatcatgaatttttgagacattgaaaagtttttgttttgcatttgcttcgtgcgcgaattcttctggatcgcaataagtgtcgagcctgcag

SEQ ID NO: 1165 - DNA, 1066 bp, Gossypium raimondii
agggtcttttattagttccataccatttgatatcaaaattttcctcctcagctgcattagggtttctctcttcaggtaaattcttggtagtttcgttcgttttaagaacagagattcgaagatgagtaagcttcagagtgatgcccttagagaagctatttcaaccattgtggctaattccaaggagaaaaatcgcaagttcaccgagaccattgaactccagattgggctgaaaaactatgatccccaaaaagacaagcgtttcagtggttccgtgaagctaccacacattcctcgtcccaagatgaagatttgcatgcttggagatgctcaacatgttgaagaggctgagaagattggtttggattatatggatgttgaagcattgaagaagctaaacaagaacaagaagttggtcaagaagcttgctaagaaatatcatgcatttttggcctctgaatctgtcatcaaacagatcccccgtctcttgggtcctggtctcaacaaagcagggaaattcccaacccttgttactcaccaggaatctttggagtccaaagtgaatgagacaaaggcaatggtgaagttccaattgaagaaagttctttgcatgggagtcgccgttgggaatgtagcaatggaggagaagcagatcttccaaaacgtgcaaatgagcgtcaatttccttgtttcattgttgaagaaaaactggcaaaatgtgaggtgcctttacttgaagagtaccatgggaccttcaaacaggatcttttgaattatgcatggagtgaaatcatttttttaattgagaatgtttcaaaaattatgttatttgatgttggaaatcatgaatttttgagacattgaaaagtttttgttttgcatttcaactgaactttcgatgaatgtcaaatttccattttttttccttttaaattatggcctcaactagaatgatgaaaagaaactcgctttgacaaaatggttaagaatcattacgggcatgtatgactctttcaatttggggttttaaaatttcggattaaagaatggaatttagtagttaata

SEQ ID NO: 1166 - DNA, 897 bp, Olea europaea
gccgtcaattccgtctaaagaactctaagacttctcgtcagaagtggattgagaagaaatagagatattgcacaatgagtaagcttcagagcgaggccttgagagaagctatctccgtaattgttaccgattctaaggagaaaaatcgtaatttcaccgagacaattgagcttcaaattgggctgaaaaactatgatccccagaaggacaagcgattcagcggctcggtgaaattgcctcacattcctcgccccaagatgaagatttgcatgcttggtgatgctcagcatgttgaggaggcagagaaaataggattggagtccatggatgtggaggctctcaagaagttgaataaaaacaagaagttggttaagaaacttgcaaagaaatatcatgctttcttagcctcggaagctgttatcaagcagattcctcgtctcttaggacctggtcttaacaaggcaggaaagttccctactcttgtgagtcaccaggaatctcttgaatccaaggtcaatgagacgaaggccacagtgaaatttcagcttaagaaggttctttgcatgggagttgctgttggaaatttgggtatggaggagaagcaagtctttcaaaatgtgcaaatgagtgtcaactttctagtttcactgctgaagaaaaattggcagaatgtgagatgcttgtacttgaagagtacaatggggaagcctcagcggatcttttaagatgtatgtttctacgccgctgtttagggaagaattttgtgagcgtaaacaataaaatatttccagagaatcggagttttgaatttctatcgtcctgtttttatcatgaacattgctttccatactcttgtcaggtcgaagcttactgctcttaatcaactatttctgttag

SEQ ID NO: 1167 - DNA, 878 bp, Platanus occidentalis
ggagttcatcgttttctccctccaaaatccctgtcgagatctttggtttaggttctcaatttttgcattagaaaatgagtaagcttcagagtgatgttctgagggaggccatcggccaggtcatgggtgctgccaaagaaaagaaccgcaagtttactgagactctcgagcttcaaatcggtctgaagaactatgacccacaaaaagacaagcgtttcagtggttctgtgaaattgcctcatatccctcgccccaagatgaaggtctgcatgcttggggatgcacagcatgtcgaggaggctgagaggattggattggagtccatggatgttgaagccttgaagaaaatgaacaagaacaagaagctggtgaagaagcttgctaagaagtaccatgctttccttgcttcggaggcaatcattaagcaaatcccaaggcttctgggtccaggtctcaacaaggccggtaagtttccgactttggtttcccaccaggagtctttggagtcaaaggtgaatgagaccaaggccatggttaagttccagcttaagaaagttctttgcatgggggttgctgtgggaaactgtggcatggatgagaagcaagtcttccagaatgtgcaactcagtgtcaatttcctggtttcactgttgaaaaagaactggcaaaatgtgagatgcttatatctgaagagtacaatgggcaagccatacagaatattttgagttagctttatgaaccgtttgatagcagttttcatttgaattcggtggtgagaagtcaacaaggtggtattttctcttttttcactagagctttaggattttagtttgcggcttcaatcgttctttaccaaatcaaaatagatctttcttttt

SEQ ID NO: 1168 - DNA, 1007 bp, Papaver somniferum
ttttttttttttcctctcctacacagggtagatatcaggaaaaggttaaaccatgagtaagcttcagagtgaagtgttgagggaggcaatcagccagataggtacagaagctaaggataagaagcgtaagttcactgaaacagtggagcttcagattggtcttaagaactatgatccacaaaaggacaagcgtttcagtggttcagtgaagttgccacatattcctcgacctaagatgaaagtctgtatgcttggagatgctcagcatgttgaggaggctcaaaaaattggacttgaatatatggatgttgaagggctaaagaagctcaacaagaacaagaaattggtcaagaagcttgcaaagaaatttcatgcttttctagcctcggaagctgttatcaagcagattccccgtctccttggtcctggtcttaacaaggcaggaaagtttccaactcttgtgacgcatcaggaatcattggaggccaaggttaacgaaaccaaggcaatggttaagtttcaattaaagaaggtgctttgtatgggtgttgctgttggtaaccttggaatggaggacaagcagatcttccagaacgtccagcttagtgtcaattttctagtttcattgctcaagaagaattggcaaaatgtgaggtgcttatacttgaagagtaccatgggcaagccagttcgcatcttctaagcattgtttttaccaagtatgaatgcagatcctgctatattgtgtggtttttatagatttagctgtaggagataccttgagagttgtaaccagcaagaggtccaaattttgcgaaatatctaaagaaagaaccccagaatattatgtttttattgctcatctatattactagattcttaaattttgtgttatttgaggaatgtggatttttcatggatttaaaatcaaaacatgattgggtatctttcctatcatcccatttagaaggaaaaataagcaggattggaaatcaaagtatcggtta

SEQ ID NO: 1169 - DNA, 952 bp, Papaver somniferum
tgtaccaggaaaataaccatgagtaagcttcagagtgaagtgttgagggaagcaatctcccagatcaataccgaagctaccactaaaaagcgaaatttcactgagacggtggaacttcagattggtcttaagaactatgatcctcaaaaggacaagcgtttcagtggttcagtgaagttgccacatattccccgccctaagatgaaagtctgcatgcttggagatgctcagcatgttgaggaggctcagaagatcggtctcgagtacatggatgttgaaggtcttaagaagcttaacaagaacaagaagttggtcaagaagcttgcaaagaagttccatgcttttctagcctcagaagctgttatcaagcaaattccccgtcttcttggacctggtcttaacaaggcaggtaagttcccaactcttgtgactcatcaagagtcattggaggccaaggtgaatgaaaccaaggctatggttaagtttcaattgaagaaagtgctctgtatgggtgttgctgttggtaaccttggcatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcattacatttctataattgtaagggcaattcctacacgctcttcatgttttgtgagatccctggagggttagatgtagggaatgccccaagtcccgagactctgtaatcagatataggtagtttgcatgagtagcagactttttctgaaatgctcagtaattctttttgtttaattcctgtaattcgttttttctgtttttacttggtagttcagggatacttaaatcttgaaaagataatgatttggcttttctttatgacttgttaaatagatggtttgg

SEQ ID NO: 1170 - DNA, 957 bp, Papaver somniferum
agggttgaagtttgtaccaggaaattaaccatgagtaagcttcagagtgaagtgttgagggaagcaatttcccagatcaataccgaagctaccactaaaaagcgaaatttcactgagacagtggaacttcagattggtcttaagaactatgatcctcaaaaggacaagcgtttcagtggttcagtgaagttgccacatattccccgccctaagatgaaagtctgcatgcttggagatgctcagcatgttgaggaggctcagaagatcggtcttgagtacatggatgtcgaaggtcttaagaagcttaacaagaacaagaagttggtcaagaagcttgcaaagaagttccatgcttttctagcctcagaagctgttatcaagcaaattccccgtcttcttggacctggtcttaacaaggcaggtaagttcccaactcttgtgactcatcaagagtcattggaggccaaggtgaatgaaaccaaggctatggttaagtttcaattgaagaaagtgctctgtatgggtgttgctgttggtaaccttggcatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcattacatttctatacttgtaatggcaattcctacatgctcttcatgtttcgtgagatccctggagggttagatgtagggaatgccctgagagtccagagtctgtaaccagatataggtagtaactgtttgcatgagtagtagacttcttctgaaaatgctcagtaatctttttgtttaattcctgaattcgctttttctgtttttacttgtagttcagggatacttaaatcttgaaagataattatttggcctttctttatgacttgttaaata

SEQ ID NO: 1171 - DNA, 896 bp, Papaver somniferum
aaaaccatgagtaagcttcagagtgaagtgttgagggaggcaatcagccagattggtacagaagctaaggacaaaaagcgtaagttcactgagacagtggagcttcagattggtcttaagaactatgacccacaaaaggataagcgtttcagtggttcagtgaagttgccacatattcctcgacctaagatgaaagtctgtatgcttggagatgctcagcatgttgaggaggctcaaaaaattggacttgagtatatggatgttgaagggctaaagaagctcaacaagaacaagaaattggtcaagaagcttgcaaagaaatttcatgcttttctagcctcagaagctgttatcaagcagattccccgtctccttggtcctggtcttaacaaggcaggaaagtttccaactcttgtgacacatcaggaatcattggaggccaaggttaacgaaaccaaggcaatggttaagtttcaattaaagaaggtgctttgtatgggtgttgctgttggtaacctcggaatggaggacaagcagattttccaaaacgtccagcttagtgtcaatttcctagtatcattgctcaagaagaattggcaaaatgtgaggtgcttatacttgaagagtaccatgggcaagccagttcgcatcttttaagcattgtttttaccaagtatgaatgcagatcgtgctatattgtcactcgggtggtttctatagatttagctgtaggagataccttgagagttgtaaccagcaagaggtccaatttttgcgaaatatctaaagaaagaaacccagaatatcttatgtttcttggtaatgctcgtaggaaatgtaatttacacttttattgcgcatctattctgaccagattctaaaatttgtgctatttg

SEQ ID NO: 1172 - DNA, 882 bp, Pteridium aquilinum
gatttctcacatctctggtaaatattatagttttattcgtggaaataacagagattcagggatgagtaagcttcagagtgatgcccttagagaagctatttccaccattgtggctcaagtccaaggaaaaaaccgtaagttcactgagaccattgaactccagattgggctgaaaaactatgatccccaaaaggacaagcgtttcagtggatctgtgaagctgccacacattcctcgccctaagatgaagatctgcatgcttggagatgctcaacatgttgaagaggcagagaagataggcttggattatatggatgttgaagcactgaagaagcttaacaagaacaagaagttggtcaagaagcttgccaagaagtatcaggcctttttggcatctgaagctatcatcaagcagatccctcgtctcttgggtcctggtctcaacaaagcagggaaattcccaacccttgttactcaccaggaatccctagagtccaaggtgaatgagaccaaggcaatggtgaagttccaactgaagaaggttctttgcatgggagttgctgttgggaatgtagctatggaggagaagcagatcttccaaaatgtgcaaatgagtgtcaatttccttgtttcattgttgaagaaaaactggcaaaatgtgaggtgcctctacctgaagagtaccatgggcccttcaaacaggatcttttgagatgatatttactttctattagtgttatgtacggagtgaaagtagttgttgggattaatagtaaatcagttttttactcagaatgttcaaattttgtgttatgttttgttgctggaatccgtagaaatattatgaatttgagaccttggaagttttgttttgcatatcaa

SEQ ID NO: 1173 - DNA, 989 bp, Sarracenia psittacina
atagtcttcgaccttttttgaatagaaatgattgcttttttattctgttttatgtttcggtgacagcacttaaatctgaagaaaggaaatagttttagccatgagtaagcttcagagtgatgccttgagggaggccataactcagattgcaaatgatgccaaggagaaaaagcgtaactttactgaaactattgagctccagattgggctaaaaaactacgatccccaaaaggataagcgtttcagtggttcagtgaagttgcctcacatacctcgccccaaaatgaaggtttgcatgcttggtgatgcgcagcacgtggaggaggctgagaagataggtttggagtatatggatgttgaaggactgaagaagcttaacaaaaacaagaaattggttaagaaacttgcaaagaaataccatgcgttcttagcgtcagaagctgtcatcaagcagattcctcgtttattaggccctggtctcaacaaggcagggaagtttcctaccctcgttagtcaccaggaatccctcgaatctaaagttaatgagaccaaagctacagtaaagtttcaactgaagaaggttctctgcatgggagttgctgttgggaactgcagtatggaggagaagcagatctttcaaaacgtgcaaatgagcgttaattttctagtttcattgttgaagaagaactggcaaaatgtgaggtgcttgtacctgaagagtacaatggggaagccagtccgcatcttttaaggaattctcttagttgagctggagggagttcctaatttgtgagcaaatgcttgaaatattatttcttggatttagcaattttcccttttgttgatcggtctacttcactttactggagtgtgatactgataataaatagttgtactgtttgtttgtgttctttcatctagagattaaaagttaattttgttttgctttttttgcatttgtagtaaaaaagctaaaattgttaattgga

SEQ ID NO: 1174 - DNA, 907 bp, Thalictrum flavum
tctaaccctagtttctgctaagggagtaaaccgtgggaatagctgttgaaagatgagtaagcttcagagtgatgtgctgagagaggcaatcacccaggttactggagaagccaaagagaaaaagagaaaatttactgagacagttgagctccagattggccttaagaactatgatcctcaaaaagataagcgtttcagtggctctgttaagctgccacacattccccgtcctaagatgaagatttgcatgcttggagatgctcagcacgttgaagaggcagagaaaataggtttggagtatatggatgtagaagggctaaagaaactgaacaaaaacaagaaacttgtgaaaaagctagcaaaaaaataccatgcttttctagcatcagaagctgtcattaagcagattcctcgtcttcttggccctggtcttaacaaggctggaaaattcccaactcttgtgactcatcaggaatcattggaatcaaaagttaacgaatccaaggctatggtgaagttccaacttaagaaggttctttgcatgggggttgctgtgggtaatcttggaatggatgagaagcagatcttccaaaatgttcaactcagtgtcaactttcttgtctcattgttgaaaaagaactggcagaatgtgaggtgcttgtacctgaagagctcaatggggaagccattccgtatcttctaaaacattataatttcgtttgattgagtacactatgtaccgaggtagtgaccaggattagaaacttattttggaaatgctcagatttgtcgtggttgtactattgagatctttagttgaatgctgttggaattttgaaagttgaaacattagtttgtactattgagatctttagttgaatgctagaataggaatttagaaatagtt

SEQ ID NO: 1175 - DNA, 934 bp, Cryptomeria japonica
  misc_feature (4)..(4): n is a, c, g, or t
  misc_feature (7)..(7): n is a, c, g, or t
  misc_feature (9)..(10): n is a, c, g, or t
  misc_feature (14)..(16): n is a, c, g, or t
  misc_feature (18)..(30): n is a, c, g, or t
  misc_feature (32)..(32): n is a, c, g, or t
  misc_feature (34)..(34): n is a, c, g, or t
  misc_feature (37)..(38): n is a, c, g, or t
gagngcngnngaannnannnnnnnnnnnnngnanganncttgtgcatgagtaagcttcagagcgatgtgttgagggaggccataacaggtttggtgggagagagcaaagagaagaatagaaaatttgtggagacgattgaattgcaaattgggctgaagaattatgatcctcagaaggataagcgtttcagcggctcagtcaaactcccccacatccctcgtcccaagatgaagctctgtatgctcggtgatgcccaacatgttgaagaggccgagaaaataggattggactacatggatgtcgaaggattaaagaaaatgaacaaaaacaagaaattggttaagaagcttgccaagaaatatcatgcttttcttgcatcagaagcaattatcaagcagattcctagacttcttggacctggtctaaacaaggctggtaagttccccactttggtgtcacatcaagagtcattggagggaaaagtaaatgaaacaaaagccactatcaagttccaattgaagaaagttctgtgtatgggtgttgctgtgggtaactgtggcatggacgaaaagcaaatattccagaatgttcagttgagtgttaactttctggtgtccttgctcaagaaaaactggcaaaatgtacgttgtctctatctgaagagcaccatgggaaagccgtctcgggtattctaaatgaacagtttagtcagcttttgcacaatgaacattgatggaatatgttttgttttgttggtatagggtagggtgtttagacaatttattctataatgcaaaattgcatttgatttgaatataacatttttcagaggcatatgttgaccaataggcaggctcttatttatgttgtaactgagggagattctatttttgatgcacaattgctttaatgattgatgtcatgtcctttttc

SEQ ID NO: 1176 - DNA, 768 bp, Medicago truncatula
ggccttacggccggggccggaagtaggagcaagagaaccgaggagaggagagcagaagggcggcgttgtatcagccatgagtaagcttcagagtgatgtgttgagggaggctataacaggtttggtgggagagagcaaagagaagaatagaaaatttgtggagacgatcgaattgcagattgggctgaagaattatgatcctcagaaggataagcgtttcagcggctcagtcaaactccctcacatccctcgccctaagatgaagctctgcatgctcggtgatgcccaacatgttgaagaggccgagaaaataggattggactacatggatgttgaaggattaaagaaaatgaacaaaaacaagaaattggttaagaagcttgccaagaaatatcatgcttttcttgcatcggaagcaattatcaagcagattcctcgacttcttggacctggtctaaacaaggctggtaagtttcccactttggtgtcacatcaagagtcattggagggaaaagtaaatgaaacaaaagccactatcaagttccaattgaagaaagttctgtgtatgggtgttgccgtgggtaactgtggcatggaagaaaagcaaatattccagaatgctcagttgagtgttaactttctggtgtccttgctcaagaaaaactggcaaaatgtacgttgtctctatctgaagagcaccatgggaaagccgtctcggatattctaaatgagcaatatagtcggctttttgcacaatgaacattggtg

SEQ ID NO: 1177 - DNA, 792 bp, Medicago truncatula
ggccttacggccggggccggaagtaggagcaagagaaccgaggagaggagagcagaagggcggcgttgtatcagccatgagtaagcttcagagtgatgtgttgagggaggctataacaggtttggtgggagagagcaaagagaagaatagaaaatttgtggagacgatcgaattgcagattgggctgaagaattatgatcctcagaaggataagcgtttcagcggctcagtcaaactccctcacatccctcgccctaagatgaagctctgcatgctcggtgatgcccaacatgttgaagaggccgagaaaataggattggactacatggatgttgaaggattaaagaaaatgaacaaaaacaagaaattggttaagaagcttgccaagaaatatcatgcttttcttgcatcggaagcaattatcaagcagattcctcgacttcttggacctggtctaaacaaggctggtaagtttcccactttggtgtcacatcaagagtcattggagggaaaagtaaatgaaacaaaagccactatcaagttccaattgaagaaagttctgtgtatgggtgttgccgtgggtaactgtggcatggaagaaaagcaaatattccagaatgctcagttgagtgttaactttctggtgtccttgctcaagaaaaactggcaaaatgtacgttgtctctatctgaagagcaccatgggaaagccgtctcggatattctaaatgagcaatatagtcggctttttgcacaatgaacattggtggaatatgttttggttttgctggtc

SEQ ID NO: 1178 - DNA, 982 bp, Carica papaya
cttgtctcttctcgcctttctccctagttcctctgccagccgcggaatctggttcttctggcaggaggcaaatctagattctcagtatgagtaagcttcagagtgacgcactgagggaagctatttccactgttgtgaatgcttccaaagagaaaaagcggaactttactgagaccattgaactccagattgggttgaagaactatgatccccaaaaggacaaacgtttcagtggttctgttaagttgccacatattccccgcccaaagatgaaggtctgcatgcttggagatgcccaacatgtggaagaggccgagaagattggtttggactatatggatgtggaaggcttgaagaaactaaacaagaacaagaaactggttaagaaacttgccaagaagtatcacgcattcttagcatcagaatcagttatcaagcagattccccgtcttctaggccctggtctcaacaaggcaggaaaattccctacccttgttactcaccaagaatctctcgagtctaaagtcaatgagatcaaagccacagtgaagttccagctgaagaaagttctttgcatgggagttgcagtcgggaactgtgctatggaagagaaacagattttccagaatgtgcagatgagcgtcaatttccttgtttccttactgaagaaaaattggcaaaatgttaggtgcttgtatttgaagagtaccatgggcccatctaaccgggttttctaagttccttcttatcttcaagatatgctgtgagtgatccggtatggcaaattagggttcgcagaatggttttcggggttatatcttttctttttgttaagttggatggtagaaatcttgcaatgttagacttccacaaatcattgtaaggtaatttttaacagatacgtactatttgggaacttttagatgcaaatttttaaaattttgtatgccttgcattttataattattagcttttctttact

SEQ ID NO: 1179 - DNA, 1080 bp, Glycine max
cgaagatattgctatttgattttcctacattttcttctgcttacttcactgattccaattcttactttcttcttctctgcgattttgttcgcaggtgttagatctgtacctgcctagccattgatttggaaaagtccaagcttcaaagatgagtaagcttcagagtgatgctcttagagaagctatctcaggaatcatgactgattccaaggaaaagaacaggaaatttgtggagaccattgaactccaaattgggctgaaaaactatgatccccagaaggacaagcgttttagtggctctgttaagttgcctcacattcctcgccccaagatgaagatttgtatgcttggagatgcccaacacgttgaagaggctgagaagataggattggactacatggatgtcgaggccttgaagaagcttaacaaaaacaagaaattggtgaaaaaactagccaaaaaatatcatgcctttttggcctctgaagcagtcatcaagcagattcctcgtctcttgggacctggtctcaacaaggcagggaagttccctacgcttgtgactcaccaagaatctctcgagtcaaaggttaatgagaccaaggccatggtgaagttccagcttaagaaggtgctttgcatgggagtagccgtggggaatgttagcatggaggaaaagcaaatcttccaaaatgtacaactgagtgttaacttccttgtctctttgttgaaaaagaattggcagaacgttcgctgcctgtatctgaagagtaccatggggaaatcgtaccgtgtcttttgagttgttcttaaattcagtgaatttctgatcgcacctaatatattgtctttcgataggtttgacagaatttttcatcgttctacagttttgttggatgagtattttttgggtagtatttgtttgttatttggcatttatgtttcaagtgcttttcgacatcggataattttagcgtgttaagtttaagcttctcgtgtttttacttacacaactccttgcgctaagcccctttgatgcaaatatcttgtgattacatctatccggcaacaatttgattaggc

SEQ ID NO: 1180 - DNA, 1008 bp, Glycine max
atccgaagattttgctatttgattttcctacattttcttctgctttcttcactgattccaattctcactttcttcttctctgcaattttgttcgcagctgttagatctgtacccgcctagccattgatttggaaaagtccaacttcaaggatgagtaagcttcagagtgatgctctaagagaagctatctcaggaatcatggctgattccaaggaaaagaacaggaaatttgtggagaccattgaactccaaattgggttgaaaaattatgatccccagaaggacaagcgtttcagtggctctgttaagttgcctcatattcctcgccccaagatgaagatttgtatgcttggagatgcccagcacgttgaggaggctgagaagataggattggactacatggatgttgaggccttgaagaagcttaacaaaaacaaaaagttggtgaaaaaactagccaaaaaatatcatgcctttttagcctctgaagcagtcatcaagcagattcctcgtctcttgggacctggtctcaacaaggcagggaagttccctacacttgtgactcaccaagaatctctcgagtcaaaggttaatgagaccaaggccatggtcaagttccagcttaagaaggttctctgcatgggagtagctgtggggaatgttagcatggaggaaaagcaaatcttccaaaatgtacaactgagtgttaacttccttgtctctttgctgaaaaagaattggcagaacgttcgctgcctatatctgaagagtaccatggggaaatcgtaccgtgtcttttgagtagtggttcttaaaattcagtgaatttctgattgcacttaatatattgtcatgataggttggacagaatttttcatcgttctacagttttgttggatgagtattttttggctagtatttcttgttattgacatttatgtttcaagtgctttgcaacatcggataattttagtggtgctaagtttaagtactcgtgttttaacttgc

SEQ ID NO: 1181 - DNA, 1037 bp, Eschscholzia californica
tacattgtcgtctaccctagtttatctctctacgaataaaaagctcggaaaccctagtgtagggttttccatctccgctctctcgttaggttagaactttttagaggacctcagtaaaaggttccaaaatgagtaagcttcaaagtgaagttttgagagaagcaatcacccagatctctggagatgctaaggagaaagcccgtaagttcactgagacagtggaactacagattggtctgaagaactacgaccctcaaaaagataagcgtttcagtggttccgtaaagttgccacatatccctaggcctaagatgaaagtttgcatgcttggggatgctcaacatgtggaagaggctgagaagataggtttggactacatggatgtagaagggctaaagaagcttaacaagaacaagaaattggtcaaaaagcttgctaagaggtttcatgcttttctagcatcagaagctgtcattaagcagattcctcgtctactcggacctggtctcaacaaggcaggaaagttccctacccttgtgtctcatcaagaatcactggaagccaaagttaacgaaaccaaggctatggttaagtttcaactaaagaaggttttgtgcatgggtgttgctgtgggtaaccttggaatggaagagaagcaaatcttccaaaatgttcaactcagtgtcaacttccttgtttcattgttgaagaagaactggcaaaatgttcgctgcttgtacttgaagagtaccatgggaaagcccgtccgcattttctaggtattttgttattaagttgaagagatctaggtgttagacaattgtagacgtctcctcctcagaattggttaacctttttgtttcgcgctcaaatttcatttctgttttcttctggaccttgagtagcaactgaaactttgaaacattagtcttttttaatgtttaaatcgaagatatttttggaatttcatgcaaaaaaaaaagtaacgtgggtagggacgaacggacgacacaagggagtaggagcccccccccccc

SEQ ID NO: 1182 - DNA, 849 bp, Catharanthus roseus
aaccctagctcatgttagggttttacacatttcctgcctcctctctctgcgttttctgcagtcttccttaggcagtcgactaagcaagtctaatctttcaccatgagtaagctacagagtgatgctgtgagagaagcaatatcaactattgttactgactgcaaagaagtcaagaaacgtaagttcactgagactattgagcttcagattggactgaagaactatgaccctcaaaaggacaagcgtttcagtggatcagtcaagctgccccatattccgcgccccaagatgaaagtttgcatgcttggtgatgctcagcacgtggaagaggctgagaagattggcctcgagtacatggatgttgaagggttgaagaaactcaaacaaaaacaagaagttagtgaaaaagcttgccaagaagtatcatgctttccttgcatctgaagcagttattaagcagatccctcgtcttttgggccctggtcttaacaaggcaggcaaatttcctacattggtgactcaccaagaatccttggagtcgaaagtgaatgaaacaaaggccacggtgaagtttcaattgaagaaggtcctttgcatgggtgttgctgtggggaatttggatatggaggagaagcaaattttccagaatgttcaaatgagcgtcaattttctggtatcactactgaaaaagaattggcaaaatgtgaggtgcttgtacctgaagagtacaatggggaggccacaacgcatcttctgagaagttgttttaatttaccttttttctaagatcagttcagtgagttaaggagttgatagttgaatacactcttctggtgaatgtctcaagta

SEQ ID NO: 1183 - DNA, 1079 bp, Amsonia hubrichtii
tggtatatctcgaacatagccgcgaccaccaagtgcccgccctcccctccaccagaactctattggagcaccatccaggagtgaagagggaagaatttcggagattttaaatcatgagtaagcttcagagtgatgccctcagagaagccatttctgtggtaaagaatgatgctgctgagaaaaagcgcaacttcacagagacaattgagctgcagattgggctgaaaaattatgatcctcagaaggataaacgtttcagtggctctgtgaagttacctcacattcctcgccctaagatgaaagcttgcatgctgggagatgctcagcatgttgaggaggctgaaaaaattggtctggagtacatggatgtggaaggtctgaagaagcttaacaaaaacaagaaattggtgaaaaagcttgccaagaaatatcatgcttttttggcttcagaagctgtgatcaagcagattccccgtctcttgggacctggtcttaacaaggctggcaagttccctacccttgttacccaccaggaatcacttgaatctaaagttaatgagatcaaggccacagtaaagtttcaattgaagaaggtgctttgtatgggagttgcagtcgggaattgcgatatggaggaaaagcaaatatttcaaaatgtgcagatgagtgtgaattttctggtttccttgttgaagaagaattggcaaaatgtgaggtgcttgtacctaaagagtaccatggggaaaccacagcgcatcttctgaggagagtttcctgttgttactgctgttttgatgggttttatgatgattgcatctaatatattgttcttagtatgatggcaaattttgttaccttaggtattgttttagctattgtctcggcttgaaaaggtgaccaagaccatcaactcttttgttttattagtttcattactgcatatttattatgattttaaatatttatcccctgttataaatttttgcgcatagaaggaagtttcctgcatctggtattgcttttctttgtttggatttctggaattaaattttggttatgtttgctctggatgttcaaaa

SEQ ID NO: 1184 - DNA, 1073 bp, Beta vulgaris
aaaaccctagcaatttctctggttttcgactttgctcaatctaagctttaatcatgagtaagcttcagggagaagctgtgagagaagctatatctggaattgcaaatgatgcgaaagagaagaatcgcaagttcacggagacaattgagctccagattggtttgaaaaattatgatccccaaaaggataagcgtttcagtggctctgttaagttgccacacatccctcgtcccaagatgaaagtttgcatgctcggagatgcacaacatgttgaagaggctgagagaataggtctagaatggatggatgtagaagcattgaagaaacttaacaagaacaagaaattggttaagaagcttgctaagaagtaccatgctttccttgcatctgaagcagttattaagcagattccccgtttgctcggtcccggtctcaacaaggcaggtaagttccccacacttgtcacccaccaagagccgttggaaaacaaagtaaatgagatcaaggctaccgtgaagtttcagctcaagaaagttctctgcatgggagttgctgttggtaactgtagtatggaagagaagcagatcttccaaaacgtgcaaatgagtgtcaactttcttgtttcactattgaagaagaattggcaaaatgtacgatgcttataccttaagagtaccatgggcaagccataccgcatcttctaagagattgcccatcgccatttttggttaaattggaagttttgttgatcgccttcgagtactacaattatatttgttgtgagctttagtatacttggattatgtcctcgaatgtaatggctaaaaaatttcttcttagtttcattgtccttggcaactttgatatctatgatattttgacccttttggcagttttgaatttccatttgttttaggagctatatatctttggacggtttatcttccattagttttaagataggttatgatattggcaattttaacgtagtacctcttggagttgttagatcgagctgtcgtgcttatttcatgagaagcatttggaaaatgtttatgaacagtatttattat

SEQ ID NO: 1185 - DNA, 853 bp, Brassica napus
agagcttcctctgcttcacctttcaggctcagagattcgtcaattgagagaaactcaagatgagtaagcttcaaagcgaggttcttagagaagggatcacagctgttaagggcaaagccgatgagaaaaaacgcaactttgtcgagacagttgagcttcagattggtctcaagaactacgacccacaaaaggacaagcgtttcagtggttctgtcaagctccctcacattcctcgccctaaaatgaagatctgtatgctcggagatgctcagcatgttgaggaggctgagaagattggactagactatatggacgttgaggctttgaaaaagcttaacaagaacaagaagcttgttaagaagcttgccaagaagtaccatgctttccttgcttctgaatccgtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttctgtgtatgggtgttgctgttggtaacctttccatggaagagaagcagctctttcagaatgttcagatgagtgttaacttccttgtctctctgttgaagaagaattggcaaaacgtgaggtgtttgtacttgaagagcaccatgggaccacctcaaaggatcttttgagctctctggtttctgaatctataaatttttgctttgcgtttttgtttcaaatgtctagtgcttcttgagatatggttcggattgatattagtggaacgaaggtgctagtttgcttttcgttaaaagacaaatataatatatgc

SEQ ID NO: 1186 - DNA, 1074 bp, Cephalotaxus harringtonia
catgtcgagaaaccctaaaccactaatgctaggcgcgtgaacacattgggtggtttgggggatgtttaagaaataacaaaaaccctagctttggtctcgtttggttctttccccaaccagtcttcagtttgttaggaagatcgaaataaactggaggggaggagaggagttgagttggtgcggcgataacaagcatgagtaagcttcagagtgatgtgttgagggaggcgattacaggggtggtggcagagagcaaggagaagaagaggaagtttgtggagactttagagttgcagataggcctcaagaactatgatccccagaaggacaagcgcttcagcggctccgtcaaactcccccacattcctcgacccaagatgaagctctgcatgctcggcgatgcccagcatattgaagaggcagaaaaaataggtttggactacatggatgtggaaggactaaagaaaatgaacaagaacaagaagctggttaagaagcttgcaaagaaataccatgcttttcttgcctcagaagcaattattaagcagattcctcgacttcttggtcctggtctaaacaaggctggtaaatttcctactttggtgtcccaccaagagtcattggagggaaaagtaaacgaaacaaaagccacaatcaagttccaattgaagaaagtcctgtgtatgggtgttgctgtgggtaactgtggcatggaggaaaagcaaatattccagaatgttcagttgagtgtcaactttctggtgtccttgcttaagaagaactggcaaaacgtacgttgcctctatctgaagagcaccatgggcaagccatctcggatattctaattgtccaatttattgtgagcttttgctcaatgaattttagaatgtgttttctgttttttggtttagagtagggggttcaaacaatttactttaatactatgcatttaattttgatataatgttttgcagaggcgttttattgcaaataggcagggtgtgatgcatgatgtaattgagggaaatcctatttttatcttacaattacaataatgctggaagttgttgcttt

SEQ ID NO: 1187 - DNA, 1079 bp, Gossypium hirsutum
cggctagggttttctcttctctggtaaatgttatagttttgttcgtggaaagaacagagattcagagatgagtaagcttcagagtgatgcccttagagaagctatttcaaccattgtagctcagtccaaggagaagcagcgtaagtttactgagactattgaactccagattgggttgaaaaactatgatccccaaaaagacaagcgtttcagtggttctgtgaagttgccacacattcctcgccctaaaatgaagatctgcatgcttggagatgcccagcatgttgaagaggcagagaagataggtttggattatatggatgttgaagcactgaagaagctaaacaagaacaaaaagttggtcaaaaagcttgccaagaagtatcatgcttttttggcttctgaatctgtcatcaagcagatccctcgtctcctgggtcctggtctcaacaaagcagggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagtgtcaatttcctggtttcattgttgaagaaaaactggcaaaatgtgaggtgcctctacttgaagagtaccatgggcccatcaaacaggatcttttgagttatttacccatgtgttaagagttttgtatgtggacaaattttctgctatgttttgtcgttggaatcttagagttgtgattttgagacattggaagttttgttttgcatatcaacataaaatgtcaatttccatcttatttttaatcgttaaaaaaggccctaatgtggtggcatattggattggctcattggacatgctctatgatggcggaaaatagttatttgggcatggttatggctgtggttttgctggaaaaagaagatttgcatagtagggtttgaatgaactacattcattacaccatgaccgctgataatcttttagtaaataatcacgtcggaattctagctagttaggg

SEQ ID NO: 1188 - DNA, 1117 bp, Gossypium hirsutum
aggtttttctcatctcttgttggcggtgccggggatcgtacttactacctctttctctctaaaccctcttttaccgtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacatgttgaagaggcagagaagataggtttggattatatggatgtggaagcattgaagaaactaaacaagaataagaagttggtgaagaagcttgccaagaagtatcatgcctttttggcttctgaatctgtcatcaagcaaatccctcgtcttttgggtcctggtctcaacaaagcaggtaaattcccaacccttgtcactcaccaggaatcactagagtcgaaggtgaatgagacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcagttttttttcttctcttttacttagaatgttcaagtttatgttatgttctgttgttccctagaaatgttatgaatatgagacattgaagttttgatttgcttatcagcttgagttttatgttagtgttaaattgccatctaatatttgcttagtccacacgaaaatcttccttagcaaatggttggcaattggcatccttgttaggcgtatggattttgactgctgattgtaaccatgtggtagaaatcctggaatgatactggccttggttttgatgtgaacttt

SEQ ID NO: 1189 - DNA, 916 bp, Gossypium hirsutum
ttttctcatctcttgttggcggtaaaattttattgtttgtggaaagaacaaagattcaaagatgagtaagcttcagagtgatgcgcttagagaagctatatcaaccattgtaactcagtcaaaggagaaacagcgcaaatttactgagaccattgaactccagattggtctgaaaaactatgatcctcaaaaagacaagcgattcagtggatccgtgaagctgccacatattcctcgccccaagatgaagatttgcatgcttggagatgctcaacacgttgaagaggcagagaagataggtttggattatatggatgtggaagcattgaagaaactgaacaagaataagaaattggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaggttctatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcacaatgggtccttcaaacaggatcttttgagtttatatgtttaccttctgttatgtacggactgaaagtagtagtggggatttaatactaaaatcagtttttttcttctcttttacttgttcaagtttatgttttgttctgttgttccctagaaatgttatgaatacgagacattggaatattgatttgcttatcaactttggttttacattatttgcttaatccacacgaaaa

SEQ ID NO: 1190 - DNA, 975 bp, Eschscholzia californica
agaaaccctaatccaggatttgcgcttcgtcgtctttctcttggaacctgaatctgcgaagatgagtaagcttcagagtgatgtattaagagaagccatcacccaaattgttggagatgccaaagagaagaaacgcaatttcactgaaactattgaactccagattgggcttaagaactatgaccctcagaaagacaagcgtttcagtggttctgtgaagctaccacatattcctcgccctaaaatgaaggtttgcatgctcggggatgcccagcacgtcgaagaggcagagaagataggattggcctatatggatgtggaatcactgaaaaagctcaacaaaaacaagaaattggtgaagaagcttgccaaaaagtaccacgcttttcttgcatctgaagctgtgattaaacagattccccgtctccttggccccggtcttaacaaggcaggaaagttcccaacattggtttctcatcaagaatctctagaggcaaaagttaatgaaaccaaagctatggtgaagtttcaattgaagaaggttctttgcatgggagtagcagtaggaaacttaggaatggaagagaagcagatcttccagaatgtgcaactcagtgttaacttccttgtatctctgttgaagaagaactggcaaaacgtgaggtgtttgtacttgaagagtaccatggggaagacaaaccgcatcttttaagcagtactactatttacttggttataagagagcttttgtgtggtttagtgagagcttacttggaccttgatttttgtcttttttttttttttttagtttttacgtttcgttcgttccgttagtaactttaactttttaagttttggtttacgtttaccctactactaactaactttaacttaaaggtaggtatagttatttttagttttagtaggtacgttgggtaggggacgaacggaacggaccaacgaagggaagggtag

SEQ ID NO: 1191 - DNA, 908 bp, Eschscholzia californica
ggatttggcacttcgtcgtctttctcttggaactaaaatctgcgaagatgagtaagcttcagagtgatgtattaagagaagccatcacccaaattgttggagatgccaaagagaagaaacgcaatttcactgaaactattgaactccagattggacttaagaattatgaccctcagaaagacaagcgtttcagtggttccgtgaagctaccacatattcctcgccctaaaatgaaggtttgcatgctcggagatgcccagcacgtcgaagaggcagagaagataggtttggcctatatggatgtggagtcgctgaaaaagcttaacaaaaacaagaaattggtcaagaagctagccaaaaagtaccatgcttttcttgcatcagaagctgtcattaaacaaattccccgtctccttggccccggtcttaacaaagcaggaaagttcccaacattggtttctcatcaagaatctctagaggcgaaagttaatgaaaccaaagctatggtgaagtttcaattgaagaaggttctttgcatgggagtagcagtaggaaacttgggaatggaggagaagcagatcttccaaaatgtgcaactcagtgttaacttccttgtatctctgttgaagaagaattggcaaaacgtgaggtgcttgtacttgaagagtaccatggggaagacaaaccgcatcttttaagcaatactttctattacttgttattggagatctgcagtatggtgtagtgagagctgcttcagcaaagactagagtttatcatcttttaaattcttgaattttgaagttccttgtcttgatacttattagttttgttactggataactcttgaatagctataattgtttaatgggatctatggacctggagaatcttgaattttgttctta

SEQ ID NO: 1192 - DNA, 1034 bp, Eucalyptus grandis
atgcttcctgcatcagccgtcgaagaaacctgaccggcgccatcaatcttctctcgggagagcgactcgttcgtgttcggtcccgtagagtttcctcaacatgagtaagcttcagagtgacgctcttagagaagctatctcggggatctttagtgattgcaatgagaagaaaaggaagttcaccgagaccattgaactccagattgggttgaagaattatgatccccagaaagataagcgtttcagtggttccgttaagttgccgcacattcctcgtccaaagatgaaggtctgcatgctgggtgatgcacagcatgtggaagaggcagagaagataggcctggcttatatggatgtggaagcgttgaagaagctcaacaagaataagaaactggtcaagaaactggcaaagaagtaccatgcctttttggcttcagaagctgtaattaagcagatcccccgtcttctaggccctggtctaaacaaggcagggaagttcccaaccctggttactcatcaggaatctctggaatctaaagtcaacgagacaaaggccatggtgaagttccaactgaagaaggtcctttgcatgggtgttgccattggcaacctcagtatggaagaaaaacaggttttccaaaatgttcagctcagcgtgaatttccttgtttccttgctgaagaaaaactggcaaaatgtcaagtgtctgcacttgaaaagcactatgggaaagccatatcgcgttttctaagccatttcgctcgatcatctgaagagttttgtaggcagagaattagtcagtttttggtggctgatgtggatggttctcttttggttggtttttttccctcaaagaatatgttattcaataccatctgtcttattgtgaaatttcgcttttgaagatattgaattcttcttgacttcacagtttcgtaaacgataaatctatgtcggaatgctctttatggattgaatgcttattctgtcatgctgctctcgaagagagctaaagaggagcgaaatgcataact

SEQ ID NO: 1193 - DNA, 1013 bp, Fagopyrum esculentum
gtcgccgttcggcaattgatctctagagtttccagattgactggtgcttatttcacacaccggatcattaaccatgagtaagcttcagagtgaagctttgagggaggccatctctggtatcgtgaatgatacaaaggagaaggcaaggaagtttacagagaccattgagcttcagattgggttgaagaattatgacccacaaaaggacaagcgtttcagcggttcggtcaaactcccccacattccccgacccaagatgaaggtgtgcatgcttggagatgctcagcatgttgaagagtctgaaaaaatgggactggattacatggatgttgaagcacttaagaagctgaacaagaacaagaagctggtgaagaagcttgccaagaaataccatgcatttttagcctctgaatctgtcatcaagcagattccgcgtttgcttggtcccggacttaacaaggcaggaaagtttcctactcttgtttcccaccaagaatcattggaatcaaaagttaatgaaatcaaggccacagtgaagttccagctcaagaaggtgctctgcatgggtgttgctgtcggaaactgcggaatggaagagaaacagatcttccagaatgttcaaatgagcgtcaacttccttgtttctttgttgaagaagaactggcaaaatgttcgctgcctatacctcaagagtaccatgggaaagccataccgtatcttttaagctatggttcttagagttttgagttgtttattagtgaaagatcacgacatggaatcaagggatcttctttggttggtcgtctttttgtttgattgcttcatctgtactatctcaagttttggtgatcagttagtatgctgcagagcttcatacataattttggtattcctatagaagtccgaaatttccgcagtctgtcttatatcattcctctcgaaattttaagaagttacaagtttcattcaatcagtgtaaaatcgaagcagctcttgcaagtgaagtcacaaaa

SEQ ID NO: 1194 - DNA, 912 bp, Fraxinus spp
cggccgggggacgccgtcaattccgtctaacaaactcttgatacttctcgtcagtggattgagaagaaatagagatattgcacaatgagtaagcttcagagcgaggcgttgagagaagctgtctctgtaattgtaaccgattctaaggagaaaaaacgcaatttcaccgagacaattgagcttcaaattgggctgaaaaactatgatccccagaaggacaagcgattcagtggctcggtgaagttgcctcacattcctcgccccaagatgaagatttgcatgcttggtgatgctcagcatgttgaggaggcagaaaaaataggattggagtccatggatgtggaggctctcaagaagttgaacaaaaacaagaagttggttaagaaacttgcaaagaaatatcatgctttcttagcttctgaagctgttatcaagcagattcctcgactcttaggacctggtcttaacaaggcaggaaagttccctactcttgttagtcaccaggaatctcttgaatccaaggtcaatgagacaaaggccacagtgaaattccagctgaagaaggttctttgcatgggagttgctgttggaaatttgggtatggaggagaagcagatctttcaaaatgtgcaaatgagcgtcaactttctagtttcactgctgaagaaaaattggcagaatgtgagatgcttgtacttgaaaagtacaatggggaagcctcaacgtatcttttaagaaaatgcacatctcagccacagctgttttgggagaattgtacgggtttaaacaattaaatgtttccagagaggaattttgaatgcctatcgtcttttttcttcatgaacgttgtcttccttaatgttgttgggttgaagcttactattattaatcaactgttgctgtttgaaacag

SEQ ID NO: 1195 - DNA, 1449 bp, Gossypium raimondii
ggcagaaaatccgaaaaagcataaataactgttattcactattttgggctgaagacagtaatatgggtaggccgaatccaaaccaaagtctaagcccgaatgaattgggtttaaactttccgttggcccaatttcaatataattacaatacttagttagggtttattacttttgctggtactatatatttctcctcaacaaaattcatagtgcggctagggttttctcttctctggtagttactctatatccctaaacaactccatttttcttgttagatctagttttgatacgtccttttttttgttcatttctggatgacttggtagctttgttttacaggtaaattttatagttttgttcgtggaaagaacagagattcagagatgagtaagcttcagagtgatgcccttagagaagctatttcaaccattgtagctcagtccaaggagaagcagcgtaagtttactgagactattgaactccagattgggttgaaaaactatgatccccaaaaagacaagcgtttcagtggttctgtgaagttgccacacattcctcgccctaaaatgaagatctgcatgcttggagatgcccagcatgttgaagaggcagagaagataggtttggattatatggatgttgaagcactgaagaagctaaacaagaacaaaaagttggtcaaaaagcttgccaagaagtatcatgcttttttggcttctgaatctgtcatcaagcagatccctcgtctcctgggtcctggtctcaacaaagcagggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagtgtcaatttcctggtttcattgttgaagaaaaactggcaaaatgtgaggtgcctctacttgaagagtaccatgggcccatcaaacaggatcttttgagttatttacccatgtgttaagagttttgtatgtggacaaattttctgctatgttttgtcgttggaatcttagagttgtgattttgagacattggaagttttgttttgcatatcaacataaaatgttaatttccatcttatttttaatcgtaaataatgaatggtggcatattggattggctcattggacatgctctatgatggcggaaaatagttatttgggaatggttatggctgtggttttgctggaaaaagaagatttgcatagtagggtttgaatgaactacattcattacaccatgaccgctgataatcttttaattctagctagttagggatggtaacatgacagggtttatacggtttttacttgtttatattcggatcagcattgctttcaactttagtttata

SEQ ID NO: 1196 - DNA, 1236 bp, Gossypium raimondii
gaaaatctggccagggtttttctcatctcttgttggcggtagctactcactccccctctgtctaaaccctcttttactataacgcccatttcattgcagatctaatttcattttaagacttctttaagtttttgatgactttgtaaccttgtttcgcaggtaaaattttattgtttgtggaaagaacaaagattcgaagatgagtaagcttcagagtgatgcgcttagagaagctatttcaaccattgtagctcagtcaaaggagaaacagcgcaaatttactgagaccattgaactccagattggtctgaaaaactatgatcctcaaaaagacaagcgattcagtggatctgtgaagctgcctcatattcctcgccccaagatgaagatttgcatgcttggagatgctcaacacgttgaagaggcagagaagataggtttggattatatggacgtggaagcattgaagaaactgaacaagaataagaaattggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaggttctatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcacaatgggtccttcaaacaggatcttttgagtttatatgtttaccttctgttatgtacggactgaaagtagtagtggggatttaatactaaaatcagtttttttcttctcttttacttagaatgtttaagtttatgttatgttctgttgttccctagaaatgttatgaatacgagacattggaattttgatttgcttatcaactttggttttacattatttgcttaatccacacgaaaatttcccttaacaaatggttggcaattggcgtccttgttgggcttatggatattgactgctgattgtcactatgtgggagtgtggtggatatcctggacttatactggcctcggttttgatgtgagctttttagtaagagtgtaaaatgaaaccaactgtgtcaaaattttataacaa

SEQ ID NO: 1197 - DNA, 1197 bp, Gossypium raimondii
tagactgccaatggcccgatatcagttttattatttcggctgacccgcctatatattttccccaagactcgaaaatctggctaggtttttctcatctcttgttggcggtgccggggtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacatgttgaagaggcagagaagataggtttggattatatggatgtggaagcattgaagaaactaaacaagaataagaagttggtgaagaagcttgccaagaagtatcatgcctttttggcttctgaatctgtcatcaagcaaatccctcgtcttttgggtcctggtctcaacaaagcaggtaaattcccaacccttgtcactcaccaggaatccctagagtcgaaggtgaatgaaacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcagtttttttcttctcttttacttagaatgttcaagtttatgttatgttctgttgttccctagaaatgttatgaatatgagacattgaagttttgatttgcttatcaacttgagtttcatgttagtgttaaattgccatctaatatttgcttagtccacacgaaaatcttccttagcaaatggttggcaattggcatccttgttaggcgtatggattttgactgctgattgtaaccatgtggtagaaatcctggaatgatactggccttggttttgatgtgaacttttgctaaatgaaaccaactaatgtgtcaaaattttattacaa

SEQ ID NO: 1198 - DNA, 813 bp, Olea europaea
agtccgtctggcgaaccctgattctcctctttagaagtggactgagaagaaatagagatattgaacaatgagtaagcttcagagcgaggccctgagagaagcgatctctgtaattgttaccgattctaaggagaaaaaacgtaatttcactgagacgattgagcttcaaattgggctgaaaaattatgatccccagaaggataagcgattcagtggctcggtgaagttgcctcacatccctcgccccaagatgaagatttgcatgcttggtgatgctcagcatgttgaggaggcagaaaaaataggattggagtccatggatgtggaggctctcaagaagttgaacaaaaacaagaagttggttaagaaacttgcaaagaaatatcatgctttcttggcctcagaagctgttataaagcagattccacgtctcttaggacctggtcttaacaaggcaggaaagttccccacccttgtgtcacaccaggaatctcttgaatctaaggtcaatgagacgaaggccacagtaaaatttcaattgaagaaggttctttgcatgggaattgctgttggaaatttgggtatggaggagaagcagatctttcaaaatgtgcaaatgagtgtcaactttctagtttcactgctgaagaaaaattggcagaatgtcagatgcttgtacttgaagagtacaatggggaagcctcagcggatcttttaagatgtatgtttcttcaccgctgtttagtgaagaaatttacgagctttaaacatttaaataattccagagaattggagttttgaatttctatcgtc

SEQ ID NO: 1199 - DNA, 1227 bp, Papaver somniferum
ctcttcactgccgcatagtctctgggtttgcgatagttctctttgattaatagaaggttacaagattagttgaactagatctgcttctagttcaactaatctgttttcgatcactgtcgatccattttctgtttcgatctagaatccttcttcttcgtgtcatctgctgttactaatttgtttatttgtgttatttgtgttgttttggttacagggtagaagtttgtaccaggaaaataaccatgagtaagcttcagagtgaagtgttgagggaagcaatctcccagattaataccgaagctaccgctaaaaagcgaaatttcaccgagacagtggaacttcagattggtcttaagaactatgaccctcaaaaggacaagcgtttcagtggttcagtgaagttgccacatattccccgacctaagatgaaagtctgcatgcttggagatgctcagcatgttgaggaggctcagaagatcggtcttgagtacatggatgttgaaggtcttaagaagcttaacaagaacaagaaaatggtcaagaagcttgcaaagaagttccatgcttttctagcctcagaagctgttatcaagcagattccccgtcttcttggacctggtcttaacaaggcaggtaagttcccaactcttgtgactcatcaagagtcattggaggccaaggtgaatgagaccaaggctatggttaagtttcaattgaagaaagtgctctgtatgggtgttgctgttggtaacctaggtatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcactacatttctataattgcaagggcaattcctacctgctcttcatgtgagacccctggagagttagacttagggaataccctgcgagtcccgagagtctgtaaccagatataggtagtaactgtttgcatgagtagtagactttttctgaaaatgctcagtaaatctttttgtttaattcctgaattcgttttttctgttttttactggtagttcagggatacttaaatcttggaagataatgatttggcttttctttatgacttgttaaatagatgattggctttaccagatttttttagtatatacttggtatgctcatttgtagctcta

SEQ ID NO: 1200 - DNA, 969 bp, Papaver somniferum
tttttcctctcctacacagggtagatatcaggaaaaggttaaaccatgagtaagcttcagagtgaagtgttgagggaggcaatcagccagattggtacagaagctaaggataaaaagcgtaacttcactgagacaatggagcttcagattggtcttaagaactatgacccacaaaaggacaagcgtttcagtggttcagtgaagttgccacatattcctcgacctaagatgaaagtctgtatgcttggagatgctcagcatgttgaggaggctcaaaaaattggacttgattatatggatgttgaagggctaaagaagctcaacaagaacaagaaattggtcaagaagcttgcaaagaaatttcatgcttttctagcctcagaagctgttatcaagcagattccccgtctccttggtcctggtcttaacaaggcaggaaagtttccaactcttgtgacacatcaggaatcattggaggccaaggtaaatgaaaccaaggcaatggttaagtttcaattaaaaaaggtgctttgtatgggtgttgctgttggtaaccttggaatggaggacaagcagatcttccagaacgtccagcttagtgtcaatttcctagtatcattgctcaagaagaattggcaaaatgtgaggtgcttatacttgaagagtaccatgggcaagccagttcgcatcttctaagcattgtttttaccaagtatgaatgcagatcctgctatattgtcactcgggtggtttctatagatttagctgtaggagatacctcgagggttgtaaccagcaagaggtccaattttgcgaaatatctaaagaaagaaccccagaatatgtcatgtttcttgataattctcgtaggaaatgtaatttacacttttattgcgcatctattctgaccagattctaaaattttatgctattcatggatttaaaatcaaaacatggttggactggaaa

SEQ ID NO: 1201 - DNA, 787 bp, Scabiosa columbaria
tagggttttcagtgttcttacattatttctccccttcattcttcgtatcagtagcagtcaaaaaattcagttttgaagcttgaggaagacaacaacttcaaatatgagtaagcttcagagtgaagcccttagagaagcaatttctcaaattgctacagctgcagcaggagagaacaagcgtaatttcgttgagacaattgagcttcagattggtctgaagaattatgatccccaaaaggataagcgtttcagtggatctgtgaaacttcctcacattcctcgccctaagatgaaggtttgcatgcttggagatgctcagcatgttgaagaggcagagaaaattggtctagaatacatggatgttgaagggctaaagaagttgaacaagaacaaaaagttggtgaagaagcttgcaaagaaataccatgctttcttggcatcagaggctgttattaaacagattcctcgtcttctcggccctggtctcaacaaggctggtaagtttccgacattggttactcatcaagaatcgctggagtcgaaagtaaacgagatcaaggcaactgttaaatttcagttgaagaaggttttgtgcatgggagttgctgttgggaactgcagcatggaagagaaacaaatctttcagaatgttcagatgagcgttaattttcttgtttctttgctcaagaagaactggcaaaatgtgaggtgcttgtacttgaagagtacaatggggaagccggttcgcatcttttaagttgcttatttcgtgttttttgtttcttac

SEQ ID NO: 1202 - DNA, 977 bp, Eutrema halophilum
actctcttcctcatatttctggttcatataagtttacacacgatcccttccctcgccgtcctttctctgttcccgacttccacaggaggcaagagtatttgagggagtgccaaaatgagtaagctccagagtgaagccctgagagaggcgatatccgccattgtcactcactgcaaggagacaaagccgcgcaagttcactgagactatcgagctccagattggtcttaagaactatgacccacaaaaagacaagaggtttagcggatccgttaaattgcctcacattcccaggccaaagatgaagatttgcatgctcggagacgcccagcacgttgaagaggctgaaaagattggattagactctatggatgtcgaagctcttaagaagttgaacaagaacaagaaacttgttaagaagctcgccaagaaattccaggctttccttgcttctgaatctgtcattaagcagattccccgtcttcttggtcccggtctcaacaaggcgggaaagttcccaacacttgttagccaccaagagtctttggaatccaaagtgaatgagacaaaggcaacagtgaagttccagctcaagaaggttctctgtatgggagttgccgtcgggaaccttggcatggaagagaaacagatctttcagaatgttcagatgagcgttaacttcctcgtttcactcttgaagaaaaactggcaaaatgtgaggtgcttgtacttgaagagtacaatgggtccaccaaatcgggttttctaagaattttatctcaaagtttctctaagttatcatcagaaaaaggaaatttgattttcttttctgtctcatgattcttcttgggttaattccagaatccttacttggtaggatgaagattttgattttgttgaaagaccattttgtttctactattgctatattatttcaagtttcgcgatttcattatcaagatcggttaagttttcgtc

SEQ ID NO: 1203 - DNA, 926 bp, Antirrhinum majus
ttcaaagcctatcgatatatttatattgaagagtctctcacttatctttttcatcactcgtcgaaaccctagtctcgtcaggagtgaatttagaagattaggagatcttgaaccatgagtaagcttcagagtgaggctcttagggaagccattacggtcattactgctgacgctaaggaaaagaagcgtaacttcaccgagacggttgagttacaaattggacttaagaactatgatccccaaaaggacaaacgtttcagtggttccgtcaagttgccacacatcccaaggccgaagatgaagatctgtatgcttggagatgctcagcatgttgaggaggcagcaaaaattggcttggaatccatggatgtggaagcactgaagaagttgaacaagaacaagaagttggtgaagaagcttgcaaagaagtatcatgctttcttagcctcagaagcagttatcaagcagattccccgtcttctgggacctggtcttaacaaggctggcaagttccccactcttgtgagtcatcaagaatcacttgagtccaaggtgaatgagaccaaggctaccgtgaagttccagcttaagaaggttctttgcatgggagttgctgttgggaaccttggcatggaagagaagcaaatctttcagaatgtccaaatgagtgtcaactttcttgtttctcttttgaagaagaattggcagaacgtgaggtgcttgtacttgaagagcacaatgggaaagccacaacgcatcttttaagcagttaaatccatttttgtttttgaatgcgtaggatcgaaagtggtatgagaacaattgaatgtttcccagatagtgcagtttttggtgttacttttattgtgatactatgctcatatgtgttacggagactgttttattttgtgattctgttataatgc

SEQ ID NO: 1204 - DNA, 941 bp, Brassica juncea
gtcctctgtttcacccttcaggttcacagattcgtcaattgagagaggatcaagatgagtaagcttcagagcgaggttcttagagaaggaatcacagctgttaagggaaaagctgatgagaagaaacgtaactttgtcgagacagttgagcttcagattggtctcaagaactatgacccacaaaaggacaagcgtttcagtggttctgtcaagctacctcacattcctcgccccaaaatgaagatctgtatgctcggagatgctcagcatgttgaggaggctgagaagattggactagactatatggatgttgaggctttgaaaaagctcaacaagaacaagaagcttgttaagaaacttgccaagaagtaccatgctttcctggcttctgagtcagtcattaagcagattcctcgtcttcttggtcctggtcttaacaaggcaggaaagttccctactctagtgagtcaccaagagtcgttggaaggaaaggtgaatgagacaaaagcgacagtgaagttccagttgaagaaggttttgtgtatgggtgttgctgttggtaacctttccatggaagagaagcagctctttcagaatgttcagatgagcgttaacttccttgtctccctgttgaagaagaattggcaaaatgtgaggtgtttgtacttgaagagcacaatgggaccaccacaaaggatcttttgagctctctgctcttttcttcttttgaatttttgctttttgtttttgtttcaaagatcttgtgcttcttgagatatggtttggattgaaattagcagaacgcatgtgctagtatgcacttcgtcagattatacaaaatgcaatgcttgttttttttttcgctcacttctcgttttggtctttccacttgtcatacttgcagcaaccacaagaagttgccagtttcacctgtttggttg

SEQ ID NO: 1205 - DNA, 984 bp, Brassica rapa
agccgccttttagagaaggttagagcttcctctgcttcacctttcaagctcagagattcgtcaattgagagcaactcaagatgagtaagcttcaaagcgaggttcttagagaagggatcacagctgttaagggcaaagccgatgagaaaaaacgcaactttgtcgaaacggttgagcttcagattggtctcaagaactacgacccacaaaaggacaaacgtttcagtggttctgtcaagctccctcacattcctcgccctaaaatgaagatctgtatgcttggagatgctcagcatgttgaggaggctgagaagattggactagactatatggacgttgaggctttgaaaaagctcaacaagaacaagaagcttgttaagaagcttgccaagaagtaccatgctttccttgcttctgaatcggtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttttgtgtatgggtgttgctgttggtaacctttccatggaagagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgcttttttaatctttggaaatttgctttgcgttttttgtttcaaatatctagtgcttcttgagatatatggttcggattgattataacggaactcaggtgctagtttgcttttcgttaaaagacaaatataatatatgcaatgtttgcgtttaaagcttcaatcacgtctcgtttctggttttcccattacccttttattgactggttacagtagaaacggttcacaacttaagcgcaacgatgag

SEQ ID NO: 1206 - DNA, 758 bp, Brassica rapa
  misc_feature (43)..(44): n is a, c, g, or t
  misc_feature (51)..(51): n is a, c, g, or t
  misc_feature (197)..(197): n is a, c, g, or t
  misc_feature (581)..(581): n is a, c, g, or t
  misc_feature (726)..(726): n is a, c, g, or t
agagcttcctctgcttcacctttcaggctcagagattcgtcanntgagagnaactcaagatgagtaagcttcaaagcgaggttcttagagaagggatcacagctgttaagggcaaagccgatgagaaaaaacgcaactttgtcgaaacggttgagcttcagattggtctcaagaactacgacccacaaaaggacaancgtttcagtggttctgtcaagctccctcacattcctcgccctaaaatgaagatctgtatgcttggagatgctcagcatgttgaggaggctgagaagattggactagactatatggacgttgaggctttgaaaaagctcaacaagaacaagaagcttgttaagaagcttgccaagaagtaccatgctttccttgcttctgaatcggtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttttgtgtatgggtgttgctgttggtaacctttccatggangagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgcttttttnatctttggaaatttgctttgcgttttttgttt

SEQ ID NO: 1207 - DNA, 792 bp, Ocimum basilicum
ttagctgtgattttcgaatatttgaacgatgagtaagctttcgggtgatgccacaagagaagccatctctcagatagtatctgaatgtaaggagaagaagagaaatttcactgagacaattgaactacagattggactgaaaaactatgatccacaaaaggataagcgttttagtggctccgttaagttgccccatattccccgcccaaaaatgaagatttgcatgcttggtgatgctcagcatgtggaagaggctgaaaaaattggtatggaatccatggatgtggaggctctcaaaaagttgaacaaaaacaagaaattggtgaagaagcttgccaagaagtatcatgctttcttagcctctgaggctgttatcaagcagattccccgtctcttgggacccggtcttaacaaagcagggaagttccctactcttgtgtcccaccaagaatctctcgagtccaaggtgaatgagacgaaggctacagtcaagttccaattgaaaaaggtgctctgcatgggcgtcgctgttgggaacttggacatggaagagaagcaaatcttccagaacgttcagatgagcgtgaatttcctcgtttctctcctgaaaaagaactggcaaaacgtgaggtgcttgtacttgaagagtaccatgggcaagccacaacgcatcttctaagatggttatcatatgcatgtttggagttttagggaagagttttcagttgtcatgtacttttctcagcttatattttcttgacataagaattttgtctttggttcttgttcaaa

SEQ ID NO: 1208 - DNA, 1723 bp, Beta vulgaris
  misc_feature (1714)..(1715): n is a, c, g, or t
gatgtagtaatttcagtgtagaggggggcgcaataagaagtcggggagtgggggagggggggggcttttttttttctgtgtttttttgggggaaaaacaacgcttttgcccttggcttcattttcgttcccttggaaaaatccctgagaagtcccccgcccccccggccggtttgggagaggagagcccaaggcccccttccgcggggggttttagagggggcccagtttcccgaaagggcgaggggaccaattatgggttgttttttttggccccgggttcctttttttcggctttttttgggggatggggggatacatttccccggaacagttggcccgtttccccagttggaattaccctttaagggaaaaaagtgggggtcccccggggggggcccgtttagactagggatcccccgggtgcggaattcggccggagaaaaccctagcaatttctctggttttcgactttgctcaatctaagctttaatcatgagtaagcttcagggagaagctgtgagagaagctatatctggaattgcaaatgatgcgaaagagaagaatcgcaagttcacggagacaattgagctccagattggtttgaaaaattatgatccccaaaaggataagcgtttcagtggctctgttaagttgccacacatccctcgtcccaagatgaaagtttgcatgctcggagatgcacaacatgttgaagaggctgagagaataggtctagaatggatggatgtagaagcattgaagaaacttaacaagaacaagaaattggttaagaagcttgctaagaagtaccatgctttccttgcatctgaagcagttattaagcagattccccgtttgctcggtcccggtctcaacaaggcaggtaagttccccacacttgtcacccaccaagagccgttggaaaacaaagtaaatgagatcaaggctaccgtgaagtttcagctcaagaaagttctctgcatgggagttgctgttggtaactgtagtatggaagagaagcagatcttccaaaacgtgcaaatgagtgtcaactttcttgtttcactattgaagaagaattggcaaaatgtacgatgcttataccttaagagtaccatgggcaagccataccgcatcttctaagagattgcccatcgccatttttggttaaattggaagttttgttgatcgccttcgagtactacaattatatttgttgtgagctttagtatacttggattatgtcctcgaatgtaatggctaaaaaatttcttcttagtttcattgtccttggcaactttgatatctatgatattttgacccttttggcaaaaaaaaaaaaaaattcaggggggcccggaccaatcccccaaagggtcgattaaattccggccgccttttaactccggagggaaaaccgggtcccaattatccttggaaatacccctttccggtgggaaaaaaaagccccccattccttccaattgcccctgaaggaaggaatggacttaatttgtaaatcgtaattttaaaccccttttaccagccaacggaatcttaataaaaaaccaaagggggtttctttggaaacctttaaaagctcccagggaaccttggggcccccccccctattttggggcgaaaaaaccaaccccttttggaacaaaaaaaaaaagggcggggggccccccccccgggggggggcttttttnnaaaaaaat

SEQ ID NO: 1209 - DNA, 881 bp, Brassica napus
agagaaggttagagcttcctctgcttcacctttcaggctcagagattcgtcaattgagagaaactcaagatgagtaagcttcaaagcgaggttcttagagaagggatcacagctgttaagggcaaagccgatgagaaaaaacgcaactttgtcgaaacggttgagcttcagattggtctcaagaactacgacccacaaaaggacaaacgtttcagtggttctgtcaagctccctcacattcctcgccctaaaatgaagatctgtatgcttggagatgctcagcatgttgaggaggctgagaagattggactagactatatggacgttgaggctttgaaaaagctcaacaagaacaagaagcttgttaagaagcttgccaagaagtaccatgctttccttgcttctgaatcggtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttttgtgtatgggtgttgctgttggtaacctttccatggaggagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgcttttttaatctttggaaatttgctttgcgttttttgtttcaaatatctagtgcttcttgagatatatggttcggattgattataacggaactcaggtgctagtttgcttttcgttaaaagacaaatataatatatgcaatgtttgcgtttaa

SEQ ID NO: 1210 - DNA, 850 bp, Brassica napus
ttcacctttcaggctcagagattcgtcaattgagagcaactcaagatgagtaagcttcaaagcgaggttcttagagaagggatcacagctgttaagggcaaagccgatgagaaaaaacgcaactttgtcgaaacggttgagcttcagattggtctcaagaactacgacccacaaaaggacaagcgtttcagtggttctgtcaagctccctcacattcctcgccctaaaatgaagatctgtatgctcggagatgctcagcatgttgaggaggctgagaagattggactagactatatggacgttgaggctttgaaaaagcttaacaagaacaagaagcttgttaagaagcttgccaagaagtaccatgcgttcctggcttctgaatcggtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttttgtgtatgggtgttgctgttggtaacctttccatggaagagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgcttttttaatctttggaaatttgctttgcgttttttgtttcaaatatctagtgcttcttgagatatatggttcggattgattataacggaactcaggtgctagtttgcttttcgttaaaagacaaatataatatatgcaatgtttg

SEQ ID NO: 1211 - DNA, 891 bp, Brassica napus
agagaaggttagagcttcctctgcttcacctttcaggctcagagattcgtcaattgagagcaactcaggatgagtaagcttcaaagtgaggttcttagagaagggatcacagctgtgaagggcaaagccgatgagaaaaagcgcaactttgtggagacagttgagcttcagattggtctcaagaactacgacccacaaaaggacaagcgtttcagtggatcagtcaagctccctcacattcctcgccctaaaatgaagatctgtatgctcggagatgctcagcatgttgaggaggctgagaagattggactagactatatggatgttgaggctttgaaaaagctcaacaagaacaagaagcttgtcaagaagcttgccaagaagtaccatgctttccttgcttctgaatccgtcattaagcagattcctcgtcttcttggtcctggtcttaacaaggcaggaaagttcccgactctagtgagtcaccaagagtcgttggaaggaaaggtgaatgagaccaaagcgacagtgaagttccagttgaagaaggttctgtgtatgggtgttgccgtgggtaacctttccatggaagagaagcagctctttcagaatgttcagatgagcgttaacttccttgtctcgctcttgaagaagaattggcaaaacgtgaggtgtttgtacttgaagagcaccatgggaccacctcaaaggatcttttgagctctctgcttttatcatctttggaaatttcgctttgctttttttgtttcaaatatctagtgcttcttgagatatatggttcggattgattaatagcggaactcggctgctagtttgcttttcgttaaaagacaaatataatatatatgcaatgtttgcttttaaggcttc

SEQ ID NO: 1212 - DNA, 915 bp, Brassica napus
cgagcatgagtcgatgccagcggcaccggccctgaattcacgggtcgacccacgcgtccggcttcctctgcttcacctttcaggctcagagattcgtcaattgagagcaactcaggatgagtaagcttcaaagtgaggttcttagagaagggatcacagctgtgaagggcaaagccgatgagaaaaagcgcaactttgtggagacagttgagcttcagattggtctcaagaactacgacccacaaaaggacaagcgtttcagtggatcagtcaagctccctcacattcctcgccctaaaatgaagatctgtatgctcggagatgctcagcatgttgaggaggctgagaagattggactagactatatggatgttgaggctttgaaaaagctcaacaagaacaagaagcttgtcaagaagcttgccaagaagtaccatgctttccttgcttctgaatccgtcattaagcagattcctcgtcttcttggtcctggtcttaacaaggcaggaaagttcccgactctagtgagtcaccaagagtcgttggaaggaaaggtgaatgagaccaaagcgacagtgaagttccagttgaagaaggttctgtgtatgggtgttgccgttggtaacctttccatggaagagaagcagctctttcagaatgttcagatgagcgttaacttccttgtctcgctcttgaagaagaattggcaaaacgtgaggtgtttgtacttgaagagcaccatgggaccacctcaaaggatcttttgagctctctgcttttatcatctttggaaatttcgctttgctttttttgtttcaaatatctagtgcttcttgagatatatggttcggattgataatagcggaactcgggtgctaggttgcttttcgttaaaagacaaatataatatatgca

SEQ ID NO: 1213 - DNA, 954 bp, Catharanthus roseus
actagtggatccaaagaattcggcacgaggctgcagtcttccttagaggcagtcgactaagcaagtctaatctttcaccatgagtaagctacagagtgatgctgtgagagaagcaatatcaactattgttactgactgcaaagaagtcaagaaacgtaagttcactgagactattgagcttcagattggactgaagaactatgaccctcaaaaggacaagcgtttcagtggatcagtcaagctgccacatattccgcgccccaagatgaaagtttgcatgcttggtgatgctcagcacgtggaagaggctgagaagattggcctcgagtacatggatgttgaagggttgaagaaactcaacaaaaacaagaagttagtgaaaaagcttgccaagaagtatcatgctttccttgcatctgaagcagttattaagcagatccctcgtcttttgggccctggtcttaacaaggcaggcaaatttcctacattggtgactcaccaagaatccttggagtcgaaagtgaatgaaacaaaggccacggtgaagtttcaattgaagaaggtcctttgcatgggtgttgctgtgggcaatttggatatggaggagaagcaaattttccagaatgttcaaatgagcgtcaattttcttgtatcactactgaaaaagaattggcaaaatgtgaggtgcttgtacctgaagagtacaatggggaggccacaacgcatcttctgagaagttgttttaatttaccttttttctaagatcagttcagtgagttaaggagttgatagttgaatacactcttctggtgaatgtctcaagtatttttgcctccttttttaatggattttccaattttggaccgagcaatggaattttaattctcagtcagacaaattatactcttcttctgtgctaagtttcgactcaattatctctccaaaaaaaaaaaa

SEQ ID NO: 1214 - DNA, 836 bp, Cenchrus ciliaris
agtaagttgcagagtgacgttctgagggaggcgatcgcctcagttaccaacgatgcccgtgaaaagcagcgcaagtttgttgaaaccattgagctgcagattggactgaagaactatgatcctcaaaaggacaagcgtttcagtggttctgttaagctgcctcacatccctcgacccaagatgaaggtttgcatgcttggtgatgctcagcatgttgaggaggcagcgagaataggtctggacagtatggatgtggaagccctcaagaagatgaacaaaaacaagaagctagtcaagaagcttgcaaagaaataccatgctttccttgcatctgaggccatcattaagcaaattcctcgtcttcttggacctggtcttaacaaggcaggaaagttccctactttggtgtctcatcaggagtcccttgaatccaaggttaatgagactaaggctacagttaagttccagctgaagaaggtgctttgcatgggtgttgctgttggcaactgtggcatggacgagaagcaaatcttccagaatgtgcaaatgagcgtcaacttccttgtgtcactcttgaagaagaattggcagaatgttagatgcctgtacctgaagagcactatgggaaaggtgtacaggttgttctaaatctttatcttaggcttgtagaatttccagaagactttactggggtgcttcgatattttctcaaccaccaatcttttgtgcaactttattgaggattaaggagttaaatccctattctcttgagatgttttcgttcttgttatcgaacctatggcaatatcttatatcaacatttttgttgctgccta

SEQ ID NO: 1215 - DNA, 1043 bp, Citrus clementina
tacgagcgttcgccgctcccaagtctctagggtttctttttcgtatttgaagaaaaaaaattctgtaaaggactccaagcgcttcaatcatgagtaagcttcagagtgatgcactgagagaggccgtctctagtattgtgcaatactctaaggagacaaagaagaggaacttcaccgagactattgagcttcagattggtctcaagaactatgatccacaaaaggacaagcgtttcagtggctctgttaagttgcctcacattccccgccccaagatgaaggtctgcatgcttggtgatgctcaacatgttgaagaggccgagaagattggtttggactacatggatgttgaaggattgaaaaaattgaacaagaacaagaaattggtgaagaaacttgccaagaaatatcatgctttcttggcatcagagtctgtcatcaagcagattcctcgtttgttgggtcctggtctcaacaaggcaggaaagttccctacccttgttactcaccaagaatccctggagtccaaagtcaacgagactaaggcaacagtgaagttccaattgaagaaggtgctttgcatgggagttgctgttggaaacctttcaatggaggagaagcagatcttccagaatgttcaaatgagtgttaacttccttgtctcattgttgaagaaaaactggcagaatgtcaggtgcctctatctgaagagtaccatgggtccttcaaaccgcatcttttaagaaattctgctttatgttggagttttgtagggaaaacctagtgtgatcttattatacccaaaatgtctttctttgaatggtcacaacctgcaattttctttttctttttctttttcttttctgaatttaatgcactagtaatcttataatatggtagacttgtacgaatttttttgttggagagatgttgaattgaatcatgattgctttctgttagatcgatggttattcattctctatgtgaggtctgtatttctggggttgcattaattcccaggctttttggctgcaagacctttt

SEQ ID NO: 1216 - DNA, 1097 bp, Gossypium hirsutum
atggggagggtttttctcatctcttgttggcggtaaaattttattgtttgtggaaagaacaaagattcaaagatgagtaagcttcagagtgatgcgcttagagaagctatatcaaccattgtaactcagtcaaaggagaaacagcgcaaatttactgagaccattgaactccagattggtctgaaaaactatgatcctcaaaaagacaagcgattcagtggatctgtgaagctgccacatattcctcgccccaagatgaagatttgcatgcttggagatgctcaacacgttgaagaggcagagaagataggtttggattatatggacgtggaagcattgaagaaactgaacaagaataagaaattggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaggttctatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcacaatgggtccttcaaacaggatcttttgagtttatatgtttaccttctgttatgtacggactgaaagtagtagtggggatttaatactaaaatcagtttttttcttctcttttacttagaatgtttaagtttatgttatgttctgttgttccctagaaatgttatgaatacgagacattggaattttgatttgcttatcaacttgggtttcacattatttgcttaatccacacaaaaatttcccttaacaaatggttggcaattggcgtccttgttgggcttatggatattgactgctgattgtcactatgtgggagtgtggtggatatcctggacttataccggcctcggttttgatgtgagcttttgagtaagagtgtaaaatgaaaccaactaatgtgtc

SEQ ID NO: 1217 - DNA, 1059 bp, Gossypium hirsutum
tcatctcttgttggtggcggtaaaattttattgtttgtggaaagaacaaagattcgaagatgagtaagcttcagagtgatgcgcttagagaagctatttcaaccattgtagctcagtcaaaggagaaacagcgcaaatttactgagaccattgaactccagattggtctgaaaaactatgatcctcaaaaagacaagcgattcagtggatctgtgaagctgcctcatattcctcgccccaagatgaagatttgcatgcttggagatgctcaacacgttgaagaggcagagaagataggtttggattatatggacgtggaagcattgaagaaactgaacaagaataagaagttggtgaagaagcttgcgaagaagtatcatgcctttttggcttctgaatctgtcatcaagcaaatcccacgtcttctgggtcctggtctcaacaaagcaggtaaattcccaacccttgtcactcaccaggaatcactagagtcgaaggtgaatgagacaaaggcaatggttaagttccagctgaagaaagttttatgcatgggagttgctgttgggaatgttgcaatggaggagaagcagatcttccaaaatgtgcaaatgagcgtcaatttccttgtttccttgttgaagaaaaattggcaaaatgtgaggtgcctctacttgaagagcaccatgggtccttcaaacaggatcttttgagttcatatttttaccttctgttatgtacggactgaaagtagtagtggggatttaatactaaaatcagtttttttcttctcttttacttagaatgtttaagtttatgttatgttctgttgttccctagaaatgttatgaatacgagacattgtaattttgatttgcttatcaacttgggtttcacattatttgcttaatccacacaaaaatttcccttaacaaatggttggcaattggcgtccttgttgggcttatggatattgactgctgattgtcactatgtgggagtgtggtggatatcctggacttataccggcctcggttttgatgtgagcttttgagtaagagt

SEQ ID NO: 1218 - DNA, 1046 bp, Gossypium hirsutum
ccgcgcaggtgtatcaacgcagagtacatggggagctgcgttagggtttctctcttcaggtaaattcttggttgtttcgttcgttttaagaacagagattcgaagatgagtaagcttcagagtgatgcccttagagaagctatttcaaccattgtggctaattccaaggagaaaagtcgcaagttcaccgagaccattgaactccagattgggctgaaaaactatgatccccaaaaagacaagcgtttcagtggttccgtgaagctgccacacattcctcgtcccaagatgaagatttgcatgcttggagatgctcaacatgttgaagaggctgagaagattggtttggattatatggatgttgaagcattgaagaagctaaacaagaacaagaagttggtcaagaagcttgctaagaaatatcatgcatttttggcctctgaatctgtcatcaagcagatcccccgtctcttgggtcctggtctcaacaaagcagggaaattcccaacccttgttactcaccaggaatctttggagtccaaagtgaatgagacaaaggcaatggtgaagttccaattgaagaaagttctttgcatgggagtcgccgttgggaatgtagcaatggaggagaagcagatcttccaaaacgtgcaaatgagcgtcaatttccttgtttcattgttgaagaaaaactggcaaaatgtgaggtgcctttacttgaagagtaccatgggaccttcaaacaggatcttttgaattatgcatggagtgaaatcatttttttaattgagaatgtttcaaaaattatgttatttgatgttggaaatcatgaatttttgagacattgaaaagtttttgttttgcatttcaactgaactttccatgaatgtcaaatttccattttttttccctttaaattatggcctcaactagaatgatgaaaagaaacccgctttgacaaaatggttaagaatcattacgggcatgtatgactgttccaatttggggctttaaaatttcggattaaagaatggaatttagtagtt

SEQ ID NO: 1219 - DNA, 889 bp, Gossypium hirsutum
tcatctcttgttggcggtgccggggtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacacgttgaagaggcagagaagataggtttggattatatggatgtggaagcattgaagaaactaaacaagaataagaagttagttaagaagcttgccaagaagtatcatgcctttctggcttctgaatctgtcatcaagcaaatccctcgtcttttgggtcctggtctcaacaaagcaggtaaattcccaacccttgtcactcaccaggaatccctagagtcgaaggtgaatgaaacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcggtttttttcttctcttttacttagaatattcaagtttatgttatgttctgttgttccctagaaatgttataaatattagacattgaagttttgatttgcttatcaactt

SEQ ID NO: 1220 - DNA, 1064 bp, Gossypium hirsutum
tcatctcttcttggcggtgccggggtaaaagtttattgtttgtggaaagagcagagattcggagatgagtaagcttcagagtgatgcgcttagagaagctatttcaaccattgtagctcagtcaaaggagaaacagcgcaaatttactgagaccattgaactccagattggtctgaaaaactatgatccccaaaaagacaagcgtttcagtgggtctgtgaagcttccacatattcctcgccccaaaatgaagatttgcatgcttggagatgctcaacacgttgaagaggcagagaagataggtttggattatatggatgtggaagcattgaagaaactaaacaagaataagaagttagttaagaagcttgccaagaagtatcatgcctttctggcttctgaatctgtcatcaagcaaatccctcgtcttttgggtcctggtctcaacaaagcaggtaaattcccaacccttgtcactcaccaggaatccctagagtcgaaggtgaatgaaacaaaggcaatggttaagttccagctgaaaaaggttctatgcatgggagttgctgttgggaatgttgcaatggaggagaagcagatcttccaaaatgtgcaaatgagcgtcaatttccttgtttctttgttgaagaaaaattggcaaaatgtgaggtgcctctacttgaagagcaccatgggtccttcaaacaggatcttttgagtttatgttttaccttctgttatgtacggactgaaagtagtagtggggatttaatactaaaagcggtttttttcttctcttttacttagaatattcaagtttatgttatgttctgttgttccctagaaatgttataaatattagacattgaagttttgatttgcttatcaacttgagtttcatgttagtattaaattgccatctgatatttgcttagtccacacgaaaatcttccttagcaaatggttggcaattggcatccttgttaggcgtatggattttgactgctgattgtaaccatgtggtagaaatcctggaatgatactggccttggttttggtgcaaaaaa

SEQ ID NO: 1221 - DNA, 963 bp, Vigna unguiculata
ggagctagggtttcgcctccgctctgagatctgtagccgcctagccgttgagttggaaaaagaccaagtctcacaatgagtaagcttcagagtgatgctttaagggaggctatcactggaatcatgggtgattccaaagagaagaaccgaaagtttgtggagactattgaactccaaattgggctgaaaaactatgatccccaaaaggacaagcgtttcagtggctctgttaagttgcctcatattcctcgacccaagatgaaaatttgcatgcttggagatgcccaacacgttgaggaggcagagaagataggattggactacatggatgttgaagccttgaagaagcttaacaaaaacaagaaattggtgaaaaagctagctaaaaagtatcatgcgtttttggcctctgaagccgttatcaagcagattcctcgtctcttgggacctggtctcaacaaggcagggaagttccccacacttgtgactcaccaagaatctctggagtcaaaggttaatgagactaaggctatggttaaattccagcttaagaaggtgctctgcatgggagtagccgtggggaatgttagcatggaggaaaagcaaatcttccaaaatgtacaactgagcgttaatttccttgtgtcattgttgaaaaagaactggcagaatgttaggtgcttgtatctgaagagtaccatggggaaatcataccgtgtcttttaagtgtttgttcttaaattcagtgaatttctgatcgcacttgatatattgtcgtgataggttggacaggatttttcattgttctacagttttgttggatgagtattttttggttagtattctgtgttattgacgtgtgtttcaagtgctttgcaagatcggataatttaagcggtgctaattttaaggtacccgtgttttttatttatacaacatgcgcattggcccgttgatacccga

SEQ ID NO: 1222 - DNA, 978 bp, Eucalyptus grandis
atgcttcctgcatcagccgtcgaagaaacctgaccggcgccatcaatcttctctcgggagagcgactcgttcgtgttcggtcccgtagagtttcctcaacatgagtaagcttcagagtgacgctcttagagaagctatctcggggatctttagtgattgcaatgagaagaaaaggaagttcaccgagaccattgaactccagattgggttgaagaattatgatccccagaaagataagcgtttcagtggttccgttaagttgccgcacattcctcgtccaaagatgaaggtctgcatgctgggtgatgcacagcatgtggaagaggcagagaagataggcctggcttatatggatgtggaagcgttgaagaagctcaacaagaataagaaactggtcaagaaactggcaaagaagtaccatgcctttttggcttcagaagctgtaattaagcagatcccccgtcttctaggccctggtctaaacaaggcagggaagttcccaaccctggttactcatcaggaatctctggaatctaaagtcaacgagacaaaggccatggtgaagttccaactgaagaaggtcctttgcatgggtgttgccattggcaacctcagtatggaagaaaaacaggttttccaaaatgttcagctcagcgtgaatttccttgtttccttgctgaagaaaaactggcaaaatgtcaagtgtctgcacttgaaaagcactatgggaaagccatatcgcgttttctaagccatttcgctcgatcatctgaagagttttgtaggcagagaattagtcagtttttggtggctgatgtggatggttctcttttggttggtttttttccctcaaagaatatgttattcaataccatctgtcttattgtgaaatttcgcttttgaagatattgaattcttcttgacttcacagtttcgtaaacgataaatctatgtcggaatgctctttatggattgaat

SEQ ID NO: 1223 - DNA, 712 bp, Adiantum capillus-veneris
tctcgcccacagcacagtcgcgggagggagcggaaggagcaaagcaatcatgagcaagcttcagagcgatgtgctgagagaagccatcacgcagctcgtgtcggaatcgaaggagaagaagagaaagtttgtggagacggttgagcttcagattgggttgaagaactatgaccctcaaaaggacaagcgtttcagcgggtcagttaagctcgcacacatcccgcgacccaagatgaaagtgtgcatgctaggagatgcccagcatgtggaagaggcggagaagattggcctggattgtatggatgtcgatgcgctgaagaaaatgaataagaataagaagcttgtgaagaagctggcaaagaagtatcatgcctttttggcctctgaagctgtcattaagcagattcctcgtctcctgggtcctggtttgaacaaggcggggaaattccctactctcgtctctcaccaagagtcattggaggggaaattaaatgagacgaaggccactgttaaatttcagctgaagaaggtgctgtgcatgggtgttgctgtgggaaaccttgaaatggaggaaaagcagctttttcagaatgtgcagctgagcgtgaactttctcgtatccctcttgaagaagaactggcaaaatgtgcgagttttgtatttgaagtcgactatggggaagcctcaaagaatcttttgagctcgtgctgaa

SEQ ID NO: 1224 - DNA, 951 bp, Vitis vinifera
agtggctgctagggttttcttcatctcctctggttcggaaagaaacctgtagtggatccattggaaggaagaggcttcaagcatgagtaagctccagagtgatgctcttagagaagccatcacaaacattgttaatgaatccaaggagaaaaagcgtaattttactgagaccattgagctccaaatcgggctgaaaaactatgatccccagaaggacaagcgtttcagtggttctgtgaagttgccccacatccctcgccccaagatgaaggtctgcatgcttggtgatgctcaacacgtggaagaggcagaaaagataggcttggaatacatggatgtggaagggctaaaaaagctgaacaagaacaagaaactggtcaagaaacttgccaagaaataccatgcctttttagcatcagaggctgttattaagcagatcccccgtcttttaggccctgggctcaacaaggcaggtaagttcccaacacttgtaactcaccaggaatcccttgagtctaaagttaatgagaccaaggcaatggtaaagttccaattgaagaaggtcctttgcatgggagttgctgtgggtaactgcagtatggaggagaagcagatctttcaaaatgtgcaactgagcgttaatttccttgtctccttgttgaagaagaactggcaaaatgtgaggtgcttgtacctgaagagcaccatggggagatcaaaccgcgtcttctaaggagttaaatcttttacctgttatggttggtgtgtagggagagtcctattttgagcaaacagttttaaaaatgttttttttttccttcatatcaaactgaatggtcaaattttcttcatgcttggctgtctacttttgggatttcattgcactcagaagcaaccatataacatcaggttttatttaaaattttaatgttgggagtattctggttgtca

SEQ ID NO: 1225 - DNA, 1084 bp, Vitis vinifera
cgtgtctagggttttatatctcacaacatcttcctcctttatctctcttctcggctgcagtcgccaaacccgttctagggttttcttctcctagagttatcaaactgtagagaaacagaaagcagtagccatgagcaagcttcagagtgaggcattgagagaggccatcacccagattgttggagatgcaaaggagaaaaagcgtaacttcattgagaccattgaactccaaattggactgaagaactatgatccccaaaaggacaagcgttttagtgggtctgtgaagctgccacacatccctcgtcctaagatgaagatctgcatgcttggtgatgctcagcatgtggaagaggcagagaagataggattagagtacatggatgtggaagggctgaaaaagctcaataagaacaagaaactggtcaagaagcttgccaagaagtaccatgcttttcttgcatctgaagctgtcatcaagcagatccctcgtcttttaggccctggtctcaacaaggcagggaagtttccaacactggtgactcatcaggaatcccttgagtcaaaagttaatgaaacaaaagcaatggtgaagttccaacttaagaaggttctctgcatgggtgttgctgtgggcaactgcagcatggaggagaagcagatcttccagaatgtgcaacttagtgtcaacttccttgtctcattattgaagaaaaattggcaaaatgtgaggtgcctgtacctgaagagtaccatggggaaatccaatcgcatcttttagaaatttgcttattatgagagttttgtagtgagtggtagtactgcacaagactgttaaaacatttatctgaaaatgcctaagatcttatatttgttcttctttattggatccttctgttttgaacctgagattttaatttttaagcattgatgttagtccgaagtagattttttttttacttgtgttttaatatgattttgtttcacaattcagctctgaaatgttgtctgtctttatgtattcacctgaaatttttatggaagatgatatggtgccacaaagttttctttgatactagagaaa

SEQ ID NO: 1226 - DNA, 1016 bp, Vitis vinifera
cttctcggctgcagtcgccaaacccgttctagggttttcttctcctagagttatcaaactgtagagaaacagaaagcagtagccatgagcaagcttcagagtgaggcattgagagaggccatcacccagattgttggagatgcaaaggagaaaaagcgtaacttcattgagaccattgaactccaaattggactgaagaactatgatccccaaaaggacaagcgttttagtgggtctgtgaagctgccacacatccctcgtcctaagatgaagatctgcatgcttggtgatgctcagcatgtggaagaggcagagaagataggattagagtacatggatgtggaagggctgaaaaagctcaataagaacaagaaactggtcaagaagcttgccaagaagtaccatgcttttcttgcatctgaagctgtcatcaagcagatccctcgtcttttaggccctggtctcaacaaggcagggaagtttccaacactggtgactcatcaggaatcccttgagtcaaaagttaatgaaacaaaagcaatggtgaagttccaacttaagaaggttctctgcatgggtgttgctgtgggcaactgcagcatggaggagaagcagatcttccagaatgtgcaacttagtgtcaacttccttgtctcattattgaagaaaaattggcaaaatgtgaggtgcctgtacctgaagagtaccatggggaaatccaatcgcatcttttagaaatttgcttattatgagagttttgtagtgagtggtagtactgcacaagactgttaaaacatttatctgaaaatgcctaagatcttatatttgttcttctttattggatccttctgttttgaacctgagattttaatttttaagcattgatgttagtccgaagtagattttttttttacttgtgttttaatatgattttgtttcacaattcagctctgaaatgttgtctgtctttatgtattcacctgaaatttttatggaagatgatatggtgccacaaa

SEQ ID NO: 1227 - DNA, 790 bp, Heritiera littoralis
ggctattagggttgctctgttctctggtagattttatagtttgttcgtggaaagaacagatattcagagatgagtaagcttcagagtgatgccctcagagaagccatatcgaccattgtggctcagtccaaggagaggcaacgaaagtttactgaaaccattgaactccagattgggctgaaaaactatgatccccagaaagacaaacgtttcagtggttctgtgaagctaccacacattccacgcccgaagatgaaaatctgcatgcttggagatgctcaacatgttgaagaggcagagaagataggcttggattatatggatgtggaagcgctgaaaaagctaaacaagaataagaagttggtcaagaagcttgccaagaagtatcatgcctttttggcttctgaatctgtcatcaagcaaatccctcgtctcttgggtcctggtctcaacaaagcagggaaattcccaacccttgttactcaccaggaatccctagagtccaaagtgaatgagaccaaggcaatggtgaagttccagctgaagaaggttctttgcatgggagttgctgttgggaatgtggctatggaggagaagcaaatcttccaaaatgtccaaatgagtgttaattttctggtctccttgttgaagaaaaactggcagaatgttaggtgcctctacttgaagagtaccatgggcccttcaaacagggtcttttgagctgatacttatcttctgttagagttctgtaaggagtgaaagtagttgtggggataaatgccaagttttt

SEQ ID NO: 1228 - DNA, 855 bp, Lolium multiflorum
gctcttctcctctccctcccttcgtccgccgccgccgcaccctcgacagaatccgtaagggcgtcgactgatcggcggcaaccatgagtaagctttcaagtgacgcggtcaaggaggccatcgccctgattgtcggggaggccagggagaagaagcgcaagttcactgagactgttgagcttcagattggtctcaagaactacgacccacaaaaggacaagcgtttcagcggctctgttaagctgccccacatcccccgccctaagatgagggtgtgcatgcttggtgatgcctcgcatgtagaccaggctgagaaattgggccttgactccatggatgttgaaagtctcaaaaagatgaacaagaacaagaagcttgttaagaagctagccaagaagtaccatgctttcttagcatctgaggccatcatcaagcagatcccccgtctccttggtcctggtctcaacaaggcaggcaagttccccacacttgttagtcactctgagtctcttgaagccaaggtcaacgagacaaaagctactgtcaagttccagctgaagaaggttctttgcatgggtgttgctgtgggtaacttgtcgatggacgagaagcagatccaacagaacctccaaatgagcgtcaacttccttgtgtcccttctgaagaagaactggcagaatgtgaggtgcctgtacgtgaagagcaccatggggaagcgccagcgggtgttctaagtggtctccagtgaagttgataagatagtgggctgtattgtcgagcttgtctttgaagttagatctgtttcactgataccaattttgtgttttatcttaagcgaatatgaaccaactattt

SEQ ID NO: 1229 - DNA, 1037 bp, Citrus sinensis
tacgagcgttcgccgctcccaagtctctagggtttctttttcgtatttgaagaaaaaaaattctgtaaagggctccaagcgcttcaatcatgagtaagcttcagagtgatgcactgagagaggccgtctctagtattgtgcaatactctaaggagacaaagaagaggaacttcaccgagactattgagcttcagattggtctcaagaactatgatccacaaaaggacaagcgtttcagtggctctgttaagttgcctcacattccccgccccaagatgaaggtctgcatgcttggtgatgctcaacatgttgaagaggccgagaagattggtttggactacatggatgttgaaggattgaaaaaattgaacaagaacaagaaattggtgaagaaacttgccaagaaatatcatgctttcttggcatcagagtctgtcatcaagcagattcctcgtttgttgggtcctggtctcaacaaggcaggaaagttccctacccttgttactcaccaagaatccctggagtccaaagtcaacgagactaaggcaacagtgaagttccaattgaagaaggtgctttgcatgggagttgctgttggaaacctttcaatggaggagaagcagatcttccagaatgttcaaatgagtgttaacttccttgtctcattgttgaagaaaaactggcagaatgtcaggtgcctctatctgaagagtaccatgggtccttcaaaccgcatcttttaagaaattctgctttatgttggagttttgtagggaaaacctagtgtgatcttattatacccaaaatgtctttctttgaatggtcacaacctgcaattttctttttctttttcttttcagaatttaatgcactagtaatcttataatatggtagacttgtacgaatttttttgttggagagatgttgaattgaatcatgattgctttctgttagatcgatggttattcattctctatgtgaggtctgtatttctggggttgcattaattcccaggctttttggctgcaagacctttt

SEQ ID NO: 1230 - DNA, 1046 bp, Arachis hypogaea
gttccattccgcctcacacagacacaggttttagcagctcttgattccacaaaaccctagcttcaaccatgagtaagcttcagagtgatgcgctgagagaagccatcacaggaattgtggctgattcgaaagagaagaataggaagtttgttgagaccattgagctccaaattggactcaaaaactatgatccacagaaggacaagcgtttcagtggttctgtaaagttgccacacatcccaaggcccaagatgaaaatctgcatgcttggtgatgctcagcatgttgaagaggctgagaaaataggattggattggatggatgttgaagcattgaaaaagcttaacaaaaataagaaattggtgaagaaacttgccaagaaatatcatgctttcttggcttctgaagcagtcattaagcagattcctcgtctcttgggtcctggtctcaacaaggcaggaaagtttcccacacttgttacccaccaagaatctctcgagtcaaaagttaacgagacaaaggctatggtcaagtttcagcttaagaaggtgctctgcatgggagtagccgttggcaatgttagtatggaagaaaagcaaatctttcaaaacgtacaactgagtgttaacttccttgtttccctgttgaaaaagaactggcagaacgttaggtgcttgtatctgaagagtaccatgggaaaatcttaccgtgtgttttaagagacttttttttatttgaaattaaaaattctgtgaaattatgatcaagattttgagtatctcaccagcatgacagatattttcatattattaaagttttgtcggatgatttttttgtttattaatattttgttcatggtttggcctctaaagtctaaagtggttaccggcattggatcctatacttccttctcacccttctcttaatctttttattccatttcaacgtggtctgtgacttatttaatagttaatacttgtagcggaaggacaatcgtaaacttggtgaatcatgtacaataaactaccgttgtagattttagtatt

SEQ ID NO: 1231 - DNA, 999 bp, Arachis hypogaea
ggggggcgattccgcctctgccagttttagctcttgatcccacaaaaccctagcttcaaccatgagtaagcttcagagtgatgcactgagagaagcaatcactgggatagtggctgattccaaagagaagaataggaagtttgttgagaccattgagctccaaattggactcaaaaactatgacccacaaaaggataagcgtttcagcggttctgtaaagttgccacacatcccgaggcccaagatgaaaatctgcatgcttggtgatgctcagcatgttgaagaggcagagaaaataggattggattggatggatgttgaagcattgaagaagcttaacaaaaataagaaattggtgaagaaacttgcgaagaaatatcatgctttcttggcttctgaagcagtcattaagcagattcctcgtctcttgggtcctggtctcaacaaggcaggaaagttccccacacttgttacccaccaagaatccctcgagtctaaagtcaatgagaccaaggctatggtgaaatttcagcttaagaaggtgctctgcatgggagtagctgtaggcaatgtaagcatggaggaaaagcaaatcttccaaaacgtacaactgagcgttaacttccttgtgtccttgttgaaaaagaactggcagaatgttaggtgcttgtatctgaagagtaccatgggaaaatcctaccgtgtgttttgaaggatcttttatattcagtgaaattgtgattttgcttaatatattaagtagcttaataccttggcagcaattttcatcttgttacagttttgttggatgaaatttttgttagtttctttagttcatggttcttaaaatgtgcttacgaacattggatcctatttttgagctgaacctgtttgcgtactatataatttccttcttgataagtttgtgggttatcccctatttagtatgttctatggataattatctatcatgctaaaaatattattaaatatgttctc

SEQ ID NO: 1232 - DNA, 917 bp, Petunia hybrida
ggggggcgctcactcactctctttttgcagcccttctcctttcagccatgagtaagcttcagagtgatgccttaagagaagccatctctgttattaagaatgattcaaatgagaagaaaaggaagtttactgaaactgttgagctccagattggtctgaaaaactatgatcctcaaaaggataagcgtttcagtggttcagtcaagttgcctcacattcctcgacccaagatgaaaatttgcatgcttggagatgctcagcatgtggaagaggcagaaaagattggtttggaatacatggacgtggaaggcctgaagaagcttaacaaaaacaagaagttggttaagaagcttgcaaagaaatatcatgctttcttggcatcagaagctgttatcaagcagattccccgtctcttaggccctggtttgaacaaggcaggtaagtttcctacccttgttacccaccaggagtcactcgagtctaaggttaacgagaccaaggccactataaaattccaattgaaaaaggtgctttgcatgggagttgccgtaggtaatctggatatggaggagaaacaaatcttccagaatgtgcagatgagtgtcaactttcttgtgtctttgctaaagaagaattggcaaaatgttagatgcttatacttgaagagtactatggggaagactcaacgtatcttttaaggaaattatattacaatcttggcagttttaaggaattatgcttgtacgagctagttgttgaatttttttgttagttattctggatagtctcttgaacttgatatcggtcgacttttttccccttttcagatggtaccacaactcattctgatatatcttgttttaatttcttgaatattgtcaaattttaatccttaaagtaaaactcaaactgtgttt

SEQ ID NO: 1233 - DNA, 908 bp, Podocarpus macrophillus
ctttcattcttgacatccgagtagggcgaaggcagaggcagaggaactccatcaacaaggaggaggacgatttcttcgcctgtaaatcaccatgagtaagcttcagagcgatgtactgagggagtcaatcacgcagataatgaatgatagcaaggagaagaagcgaaagttctcagagacgattgagctgcagataggcctcaagaactatgatcctcagaaggataagcgtttcagcggctccgtcaagcttccccacatccctcgccccaagatgaaagtctgcatgcttggtgatgcccagcatgttgaagaggctgagaaaataggcttggattacatggatgtggaaggtttgaaaaagatgaataaaaacaagaaacttgtgaagaagttggctaagaaataccatgcatttcttgcttcagaagctatcattaagcagatccctagacttctgggtcctggtcttaacaaagctgggaagtttccgaccttggtatcacatcaagagtccctggaggcgaaggttaatgaaacaaaggcaactgtgaagtttcaattgaagaaggtactttgcatgggtgttgcggtaggaaactgtggcatggaggagaaacaggtattccagaatgtccagatgagtgtcaactttctggtttctttgctgaaaaagaattggcaaaatgtacgctgcttgtatctgaagaccacaatgggcaagccaacccgggtattctgattgtgcaatttagtgtctaatttttattggttgaactttgaaagttgtttttgttggtttaggatagcaagttcaaattctacttttttatgacttttacaattgagtttgatataactttgtaaggaggcatatgttgatcaatatggagggaattgcatgttgt

SEQ ID NO: 1234 - DNA, 1162 bp, Papaver somniferum
  misc_feature (12)..(12): n is a, c, g, or t
cgtagaagtttntaccaggaaaataaccatgagtaagcttcagagtgaagtgttgagggaagcaatctcccagattaataccgaagctaccgctaaaaagcgaaatttcaccgagacagtggaacttcagattggtcttaagaactatgaccctcaaaaggacaagcgtttcagtggttcagtgaagttgccacatattccccgacctaagatgaaagtctgcatgcttggagatgctcagcatgttgaggaggctcagaagatcggtcttgagtacatggatgttgaaggtcttaagaagcttaacaagaacaagaaaatggtcaagaagcttgcaaagaagttccatgcttttctagcctcagaagctgttatcaagcagattccccgtcttcttggacctggtcttaacaaggcaggtaagttcccaactcttgtgactcatcaagagtcattggaggccaaggtgaatgagaccaaggctatggttaagtttcaattgaagaaagtgctctgtatgggtgttgctgttggtaacctaggtatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcactacatttctataattgcaagggcaattcctacctgctcttcatgtgagacccctggagagttagacttagggaataccctgcgagtcccgagagtctgtaaccagatataggtagtaactgtttgcatgagtagtagactttttctgaaaatgctcagttaatctttttgtttaattcctgaattcgttttttctgtttttacttggtagttcagggatacttaaatcttgaaagataatgatttggcttttctttatgacttgttaaatagatgattggctttaccaaaaaaaaaaaaaaacctcgtgcgatcgaatcagctatcgaacgtcgactcgaggggcgtacatcgcctaaggggtcgatacatctgcgcgttaacgttgactgactgggtacacttatgctgaccatccctgccacgtgatcgaggccgcagatgcctcaggtgcgcgtatgcaaggcaatggggcggaaa

SEQ ID NO: 1235 - DNA, 858 bp, Raphanus sativus
tttcctctgtttcaccctctcagatacagagattcgtcaattgagagaaactcaagatgagtaagcttcaaagtgaggtacttagagaaggaatcgcagctgttaagggcaaagctgatgagaaaaaacgcaactttgtcgagacagttgagcttcagattggtctcaagaactatgacccacaaaaggacaagcgtttcagtggttctgtcaagctccctcacattcctcgccctaaaatgaagatctgtatgctcggagatgctcagcatgtcgaggaggctgagaagattggactagactatatggatgttgaggctttgaaaaagctcaacaagaacaagaagcttgttaagaagcttgccaagaagtaccatgctttcctggcttctgagtccgtcattaagcagattcctcgtcttcttggtcctggtcttaacaaggcaggaaagttccctacactagtgagtcaccaggagtcgttggaaggaaaggtgaatgagaccaaagcgacagtgaagttccagttgaagaaggttctgtgtatgggtgttgctgttggtaacctttccatggaagagaagcagctctttcagaatgttcagatgagcgttaacttccttgtctcgctcttgaagaagaattggcaaaacgtgaggtgtttgtacttgaagagcaccatgggaccaccacaaaggatcttttgagctctctgctcttttcttctttgaatttttgctttttgtttttgtttcaaagatcttgtgcttcttgagatatggttcggattgatattagcggaactcaggtgctagtttacttttcgttgaacaatataatacggcaatgtttgctttt

SEQ ID NO: 1236 - DNA, 978 bp, Thellungiella halophila
gactctcttcctcatatttctggttcatataagtttacacacgatcccttccctcgccgtcctttctctgttcccgacttccacaggaggcaagagtatttgagggagtgccaaaatgagtaagctccagagtgaagccctgagagaggcgatatccgccattgtcactcactgcaaggagacaaagccgcgcaagttcactgagactatcgagctccagattggtcttaagaactatgacccacaaaaagacaagaggtttagcggatccgttaaattgcctcacattcccaggccaaagatgaagatttgcatgctcggagacgcccagcacgttgaagaggctgaaaagattggattagactctatggatgtcgaagctcttaagaagttgaacaagaacaagaaacttgttaagaagctcgccaagaaattccaggctttccttgcttctgaatctgtcattaagcagattccccgtcttcttggtcccggtctcaacaaggcgggaaagttcccaacacttgttagccaccaagagtctttggaatccaaagtgaatgagacaaaggcaacagtgaagttccagctcaagaaggttctctgtatgggagttgccgtcgggaaccttggcatggaagagaaacagatctttcagaatgttcagatgagcgttaacttcctcgtttcactcttgaagaaaaactggcaaaatgtgaggtgcttgtacttgaagagtacaatgggtccaccaaatcgggttttctaagaattttatctcaaagtttctctaagttatcatcagaaaaaggaaatttgattttcttttctgtctcatgattcttcttgggttaattccagaatccttacttggtaggatgaagattttgattttgttgaaagaccattttgtttctactattgctatattatttcaagtttcgcgatttcattatcaagatcggttaagttttcgtc

SEQ ID NO: 1237 - DNA, 906 bp, Fraxinus spp
cggccgggggacgccgtcaattccgtctaacaaactctgatacttctcgtcagaagtggattgagaagaaatagagatattgcacaatgagtaagcttcagagcgaggcgttgagagaagctatctctgtaattgttaccgatactaaggagaaaaaacgcaattttaccgagacaattgagcttcaaattgggctgaaaaactatgatccccagaaggacaagcgattcagtggctcggtgaagttgcctcacattcctcgccccaagatgaagatttgcatgcttggtgatgctcagcatgttgaggaggcagaaaaataggattggagtccatggatgtggaggctctcaagaagttgaacaaaaacaagaagttggttaagaaacttgcaaagaaatatcatgctttcttagcctcggaagctgttatcaagcagattcctcgtctcttaggacctggtcttaacaaggcaggaaagttccctactcttgtgagtcaccaggaatctcttgaatccaaggtcaatgagacgaaggccacagtgaaatttcagctgaagaaggttctatgcatgggagttgctgttggaaatttgggtatggaggagaagcagatctttcaaaatgtgcaaatgagcgtcaactttctagtttcactgctgaagaaaaattggcagaatgtgagatgcttgtacttgaaaagtacgatggggaagcctcagcgtatcttttaagaagatatacgtctcagctgcagctgttttgggagaattgtacgagtttaaacaatcaaatgtttccagagaggaattttgaatgcctatcgtcttgttcttcatgaacgttattttccttaatgttgctgggttgaagcttactattattaatcaactgttgctgtttg

SEQ ID NO: 1238 - DNA, 2999 bp, Mimulus guttatus
aatcaacgattcaaacagctccgaaatggaaatcgtgagactggttttcgtagctaatttgctgctactactgccaattctactgcattcgaccagcgcttacaatgtaggagatcccgtcccccttttcgtcaacaaaattggcccccttcataaccctagtgaaacatacaaatattatgagttggccttctgtcgtccagatcaggtgctcgaagagagagaaagcattggggaagttctgaacggtgacaggctggcaaacgctttatatgatttgaaattcgcagtcaacaaaactagggcagttaactgccagcagaagctcaataaacaggatatttcgaaattcagggacgctattaaaaacgatttttattaccagatgtactatgatgatcttcccctatgggcattcataggcaaagtcgaagatgaaaactggacatccgacagtaaaggaccaaagtattatcttttcacacacgttcaattcgatgctctctacaacggaaaccaagtcgtcgaaattcacgccttgagtgatccaaatcacgtgttagatataacagatgatattgatgtcacaatcgatttcacttattccattttttggaatgaaacttctataccgtacaggaatagaatggaaagatatttagctgcttcttcactgcctatactgcaacaaactcattggttctctttcgttaattcaattgtgatagttataatgctgacgggactgcttgttgtgctttttacgcggcatctcaagaatgatttaagaaaatggtcgattggagatgaagatgaggagaaagaggttggttggaaatacttacacggtgatgttttgagatgcccgacgaatttgcctttgttttgcgccgttttgggatgtgggacccagctattgaccatgatattcatcttatttgttttggcatttctcggaatctcttatccccacagccacggttctctctcaaattccatattcatatcttaccttcttacatcagcagtttccggatatatctcctcatctttttgcattcaatattccgaaacgggacaggaaacgagcacacttcttacagggacactcttcttaggcccttttctcttcacagcattcatcctcaatacactcgctgcgtattttaatgtgactgcagcacttcctctaggaacaatatttatcattattttaatatatacgctcgttgcaattccactactcgtacttggtggggtcgttggaaaacgtaacaaatacgatatacaatgttctccggttgcaaagaaatctccgagggagattccgtttttggcttggtatagaagaacacctgctcaaatgtttatcggaggtcttttgccttttagtgcaattgtcttggagttgcacaacttgtgtgctactgtgtggggctataaagtgtacacctctcttggagttttgtttgttacgatcttgatacttgttctgctcactgttatgatcagtgttggattgacgtattttcaattggttgttgaagatcacgattggtggtggaggtcagttttacgtggcggatcgacagcaatattcatgttttgttactgcgtatacttttattacaaatcaaatatgagcggcattctccaagcatgtttctttttcggatatagcttttgcatgtgctatgcgttcttcttggtgctcggagctctaagttttcgagcttctttgattttcgttcgaagaatataccatgctgtcaagagtgattgccccatttctccttcatcatcgtgcgagagagatttgacagaactcgagaacttttctctttcgattttttgcagaaaaagagataaaaaaaggatcggaaaaatggaaccggcagtcagacgaagcggcggcgtatgggagggtatgtacagagtgattatgcgccgcactcctgtctacgttaccttcgtcgtcgtcggcgccttcctcggcgaacgggctgtggatcgtggaattcgcggtctctgggaccacatcaattaagcttcagagtgaggctcttagggaagccattacccagatttctgccgattgtaaggagaagaatcgtaagtttaccgagacaatcgagctccagattggactcaagaactacgacccacagaaagacaagcgtttcagtggctcggttaagttgccacacattcccagacctaaaatgaagatttgcatgcttggagatgcccagcatgttgaagaggccacaaagatcggacttgagtccatggatgttgaggctctcaagaagctaaacaagaacaagaaattggtgaagaagcttgcgaagaaataccatgctttcttagcctccgaagctgttattaaacagattccccgtcttttgggccccggtctcaacaaggcaggtaagttcccgactctggtttctcaccaagaatctctggaagcaaaggtgaacgagacgaaagcaacagtcaagttccaattgaagaaggttctttgcatgggtgttgctgtaggaaacctttccatggaagagaagcagatcttccaaaacgtgcaaatgagcgtcaacttcttagtttcccttttgaagaagaattggcagaatgtgaggtgcctatacctcaagagtactatgggcaaacctcaacgtgtcttctaatcgattaattggagttttgtttcctgtttcacttgggggaaaggttgtaagagagcaaaagttagatttgaatattggaatctttactgtttttgttattttgacattgtgagaaatgaccttatttatggattttgttttattttgcattcatatctttgtttatggtttttgttttctttattattagttatatattaatctggaatagcacctttgctcgaaaattcaactgttttgggcttctgtttttccctattattgatttgttcccatcttttttcatatataatagaattttgataaatt

SEQ ID NO: 1239 - DNA, 962 bp, Coffea canephora
cggccggggggtccctgaaaaccctacaaataaattcccaccctcgcctcgccgctctactctctgctagtcggctcttgcagaactcccccaccattcaggataatcgcctaggcaagacgagacagaatttctcaccatgagcaagctacagagtgatgctgttagagaggcaattggcgtaattatgaccgaagctaagggtgataaaaagcgtaacttcaccgagactattgagcttcagattggtttgaagaactatgatccccagaaggacaagcgtttcagtggctctgttaaattaccacacattcctcgacccaagatgaaggtttgcatgcttggtgatgctcagcatgttgaagaggcagagaagattggtctggaatatatggatgttgaagggttgaagaaactcaataagaacaagaaattggtgaagaagctggcaaagaagtatcatgctttcttagcctctgaagcagtcatcaagcagattcctcgtcttctgggccctggtctaaacaaggcaggaaagttccccacgcttgtgactcatcaggaatctttggagtcaaaagttaatgagactaaagcaacagtgaaattccagcttaagaaggttctttgtatgggtgttgctgtgggtaattgtgatatggaggagaagcagatcttccagaatgtccaaatgagtgtcaactttcttgtctcattactcaaaaagaattggcaaaatgtgaggtgcttgtacctgaagagtaccatgggaaagccaaatcgcatcttttgagctgtattggttttgctttgttttgaatcagtttagcaagattaagagtgttggccaagtaatacatttttcagcgaatgtttcagatatttttgtttccttgctatgttgatttgttggttctcaaaactaagaatgaaattttagttacagttgaccccttttgggt

SEQ ID NO: 1240 - DNA, 1000 bp, Raphanus sativus
  misc_feature (244)..(244): n is a, c, g, or t
ttttttttctctgttcccgatcttccacagggggaatagtatctgagaaactgccaaaatgagtaagctccagagtgaagccgtgagagaggcgatatcctccatcatcactcattgcaaggagacaaagccacgcaagttcactgagaccatcgaactccagattggtcttaagaactatgacccacaaaaggacaagcggtttagcggatccgttaagttgcctcacattccgaggcccaanatgaagatttgcatgctcggtgacgctcagcacgttgaagaggctgagaagattgggttagactctatggatgttgaagctcttaagaagttgaacaagaacaagaaacttgttaagaagctcgccaagaagttccatgctttccttgcttctgaatctgtcattaagcagattcctcgtcttcttggtcctggtctcaacaaggcaggaaaattcccaactcttgttagccaccaagagtctttggaatccaaggtgaatgagacaaaggcaacagttaagttccagctgaagaaggttctgtgcatgggtgtcgctgttgggaatctcggcatggaagagaagcagatctttcagaacgttcagatgagcgtcaacttccttgtttcgctcttgaagaagaactggcaaaacgtgaggtgcttgtacttgaagagcacaatgggtccaccaaaccgtgttttctaagatgttcttattctctgaaaggtgtcgtcagcagacggatagaaaagttgattttctttccagtcatgagccttcttcttcttggattagttcctgaatctttactttgtaggatcaagattttgttgaaagacagttttgtttctgttattattagtgggattttctctattttaattatttcgtgacgacacatcatttaaagggttagtcttgggtgaatgtgacaaattaaacggtcttcttgtcatgacattcttcaatatcaaccaaacatgattattaccc

SEQ ID NO: 1241 - DNA, 839 bp, Gossypium hirsutum
gcggctagggttttctcttctctggtaaatgttatagttttgttcgtggaaagaacagagattcagagatgagtaagcttcagagtgatgcccttagagaagctatttcaaccattgtagctcagtccaaggagaagcagcgtaagtttattgagactattgaactccagattgggttgaaaaactatgatccccaaaaagacaagcgtttcagtggttccgtgaagttgccacacattcctcgacctaaaatgaagatctgcatgcttggagatgcccagcatgttgaagaggcagagaagataggtttagattatatggatgttgaagcactgaagaagctaaacaagaacaagaagttggtcaaaaagcttgccaagaagtatcatgcttttttggcttctgaatctgttatcaagcagatccctcgtctcctgggtcctggtctcaacaaagccgggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagcgtcaatttcctggtttcattgttgaagaaaaactggcaaaacgtgaggtgcctctacttgaagagtaccatgggcccatcaaacaggatcttttgaattggtagttacccatgtgttaagagttttgtatgtggacaaattttctgctatgttttgtcgttggaatcttagagttgtgattttgagacattggaagttttgttttgcatatcaaca

SEQ ID NO: 1242 - DNA, 988 bp, Euonymus alatus
ggctagggtttttttcacctcctgaactatctgcgagccagcgagcgggctcgttgaagggcaaacatgagtaagcttcagagtgacgccctgagagaagctatctcaaccattgtgaaagagtgcgcagagaaaaagaggaactttgttcagactattgaactccagattgggttgaagaattatgatccccaaaaagataagcgtttcagtggttctgtgaagttgccgcatattcctcgtccgaaaatgaaagtatgcatgcttggagatgctcagcatgtagaagaggcagagaaaattggtttggattatatggatgtggaagcattgaagaagctaaacaagaacaaaaaactagttaagaagctcgcaaagaagcaccacgcctttttggcttcggaatccgtcatcaaacagatccctcgtcttttggggcctggtctaaacaaggcagggaagtttcctactcttgtttctcatcaagagtcccttgagtctaaaattaatgagaccaaggcaacagtgaagttccagttgaagaaggtgctctgcatgggagttgctgtgggtaatgtctctatggaggagaagcagatattccagaatgtgcaaatgagtgtgaacttccttgtttcattgttgaagaaaaactggcagaatgtgaggtgcctgtacctgaagagcaccatgggcagtccaaatcgcatcttctgagttgaatttttatctgttgacgttgtgtaaggagagaactagttggtcacattcagaaaagtgtctaaccagaatgttacgttttccttctgttttgttagctcccttggtgagtagaattaaaatgttaagacgtacccaagaagatttagtgggagaagttgattatttgcattattatgattttgaaccacaactggagctttggttttattgttggcatttcttcccgttgcaatgtcttctatactcactcgttccagccattctc

SEQ ID NO: 1243 - DNA, 992 bp, Euonymus alatus
gttgctggctattgctgtatatatacactctggagcgcagtcgcggctagggtttctttcacctcctgaactatctgcgagcgggctcgttgaagggcaaacatgagtaagcttcagagtgacgccctgagagaagctatctcaaccattgtgaaagagtgcgcagagaaaaagaggaactttgttcagactattgaactccagattgggttgaagaattatgatccccaaaaagataagcgtttcagtggttctgtgaagttaccgcatattcctcgtccaaaaatgaaagtatgcatgcttggagatgctcagcatgtagaagaggcagagaaaattggtttggattatatggatgtggaagcattgaagaagctaaacaagaacaaaaaactagttaagaagctcgcgaagaagcaccacgcctttctggcttcggaatccgtcattaaacagatccctcgtcttttggggcctggtctaaacaaggcagggaagtttcctactcttgtttctcatcaagagtcccttgagtctaaaattaatgagaccaaggcaacagtgaagttccagttgaagaaggtgctctgcatgggagttgctgtgggtaatgtctctatggaggagaagcagatattccagaatgtgcaaatgagtgtgaacttccttgtttcattgttgaagaaaaactggcagaatgtgaggtgcctgtacctgaagagcaccatgggcagtccaaatcgcatcttctgagttgaatttttatctctgttgaatttttatctgttgacgttgtaaggagagaactagtcagaatgttacgttttccttctgttttgttagctcccctggtgagtagaattaaaatgttaagacgtacccaggaagatttagtgggagaagttgattttttgcattattataattttgaacctcaactggagctttggttttgttgttggcatttctccccgttgcaatgtcttctatat

SEQ ID NO: 1244 - DNA, 954 bp, Setaria italica
agggtttccactctgccgcgccgcctccccctacctcgaggaacgctgctcgcaccagcaccaccggcgccatgagtaagttgcagagcgacgctctgagggaggcaattgcctcagttaccaatgactcccgtgaaaagcagcgcaagtttgtcgaaaccattgagctacagattggactgaagaactatgaccctcaaaaggacaagcgtttcagtggttctgttaagctgcctcacatccctcgccctaagatgaaggtttgcatgcttggtgatgctcagcacgttgaggaggcagggagaataggtctggacagtatggatgtggaagccctcaagaagatgaacaaaaacaagaagctagttaagaagctcgcaaagaaataccatgctttccttgcatctgaggccatcattaagcaaattcctcgtcttcttggacctggtcttaacaaggcaggaaagttccctactttggtgtctcatcaggaatcccttgaatccaaggttaatgagactaaggctacagttaagttccagctgaagaaggtgctttgcatgggtgttgctgttggcaactgcggcatggatgagaagcaaatcttccagaatgtgcaaatgagcgtcaacttccttgtgtcactcttgaagaagaattggcagaatgtgagatgcctgtacctgaagagcactatgggaaaggtgtaccggttgttctaaatctttctcttaggcttgtagaatttccaggagactttactgggggactttgctattttctctaccaccaattttttgtgcaactattgaggattaaggtgttaaatccccattgtcttgtgcgagatgttttcgttcttgatatcgaacctatggtaatatcttatttcaacatttttgtcgctgcctaagctcaattcctgtggtctattgcccctttttttcacctcgg

SEQ ID NO: 1245 - DNA, 927 bp, Primula obconica
ctctcttccagatttgggttaagctagagtttcagtcatgagtaagctacagagtgatgtcttgagggaggcaataactcagattcacaaggactccactgagaaatcacgcaagttcactgaaacaattgagcttcagattggactgaaaaattatgaccctcaaaaagacaaacgtttcagtggctccgtgaagttgcctcacatccctcgccccaagatgaaggtttgcatgcttggtgatgctcatcatatcaacgaggctgagaagatagggttagaatatatggatgttgaatcgttgaagaagctcaacaagaacaagaaacttgttaagaaacttgccaagaagtatcatgcctttttggcatcagaagctgtcattaagcagattcctcgtcttctaggccctggtctcaacaaagcaggaaagtttcccaccctggtctctcaacaggaatctcttgagtctaaagtcaatgagactaaagcgacagtcaagttccaacttaagaaggttctctgcatgggagttgctgttggaaaccttggaatggaggagaagcaaattttccaaaatgtgcagatgagtgtcaatttcctcgtttctctgttgaagaaaaattggcaaaatgtgaggtgcttgtacttgaagagcaccatggggaagccagtacgtgtattctaagaacttcagcgtttgggttgctgttttctgcttaatttagacagtttttcaggattaagcatttttcatttgctgtcattttgaattctttcccaatattacttgacattatggtgcgctttttatggagagttttaatatttccttgtgaaagtttttaattctacaactcaccagagcttgctcgatctttatcaactttctgatgtcttttttctcaatgttctaatgattgttat

SEQ ID NO: 1246 - DNA, 1015 bp, Secale cereale
tccgtctgacccgcccctcttctccctctctgtcgctgcgcaggaacagtgctcccaccgccggcgccatgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggccacagtcgaagttccagttgaagaaggttctttgcatgggtgtggccgttggccacctgggtatggaggagaagcagatcttccagaacgtgcagatgagcgtgaacttcctcgtctctctgttgaagaagaattgggcaaaacgtgagatgcttgtacctgaagagcacgatgggaaaggtgtaccggttgttctagactctagtcttctaggatttccaggagattgacaacttgggaacttttgtttgctttctcaattattatcaaatttttcgtgcgtgccagtgacagttaaacagttgcaactattgtcttgtactgagatggtttgttctattgtctggaatttcatgacattttatccttttgcccctttgccttactgattgatgcttgctgtcaatcagtttaacactagattcagcattggtatttacgacagtaagctgtgtttgatagagtattataaaaccaagagtattttgcct

SEQ ID NO: 1247 - DNA, 901 bp, Eutrema halophilum
agggcttcagctgcttcacctttcagggtcagagattcgtgaactgagagaaacccaagatgagtaagcttcagagtgaggctcttagagaagccatcacaactgtcaagagcaaatctgaggataagaaacgtaactttgtggagacagtggagcttcagattggtctgaagaactatgacccacaaaaggacaagcgtttcagtggttctgtcaagctcccacacattcctcgcccgaaaatgaagatctgtatgcttggagatgcccagcatgttgaagaggctgagaagatgggactagactatatggatgttgaggctttgaagaagctcaacaaaaacaagaagcttgttaagaagcttgctaagaagtaccatgctttcttggcttctgaatccgtcattaagcagattccccgtcttcttggtcctggtcttaacaaggcaggaaagttcccaactctggtgagccatcaagagtcgttggaatcaaaggtgaatgagacgaaagcaactgtgaagttccagttgaagaaagttctgtgtatgggtgttgctgttggtaacctttccatggaagagaagcagctctttcagaacgtgcagatgagcgtcaactttcttgtctcgctattgaagaagaattggcaaaacgtaaggtgtttgtacttgaagagcaccatgggaccaccacaaaggatcttttgagctatctactccatcagtccaacttcgagttttgctttgtgtttttttttttcagagatcttgtgcttcttgagatatggtttggaatgatattattagcagaattcaagtgctagtttgctttttggtagacgatatatgcaatgtcctacaatatttacaattcaattttatccatctactatctcatg

SEQ ID NO: 1248 - DNA, 1028 bp, Tripterygium wilfordii
agagaactatcggcgagcgagctttttggaagggcaagcatgagtaagcttcagagtgatgccctgagagaagctatcgcaaccattgtgaaagagtccacagagaaaaagagaaactttgttcagactattgaactccagattgggttgaagaattatgatccccaaaaagataagcgtttcagtggttctgtgaaattgccgcatattcctcgtccgaaaatgaaagtatgcatgcttggtgatgctcagcatgtggaagaggcagagaaaattggtttggattatatggatgtggaagcattgaagaagctaaacaagaacaaaaaacttgttaagaagctcgcaaagaagcaccatgcctttttggcttcagaatctgtcatcaaacagatccctcgtcttttggggcctggtctcaacaaagcaggaaagtttcctacacttgtttctcatcaagagtcccttgagtctaaagttaacgagaccaaggcaacagtgaaattccagttgaagaaggttctctgcatgggagttgctgtgggaaatgtttctatggaggagaagcagatattccagaatgttcaaatgagtgttaacttcctggtttccttgttgaagaagaattggcagaatgtcagatgtttgtacctgaagagcaccatgggcagtccaaaccgcatcttctgagttaaatttatatatgttgaagatgcgtaaggagagaactagttgaacaaatactgaaaagttttctatcagaatgctcatgttttccttctgttttgctagttactttgtttccttggtgagtagtgttaaaattttaagacgtacccaagattttggagaaggtgatttttttttgctttttaattttgaacctcaactggaactttggtattattgttctgtcactacctctttgcaatgccttctatattcagattagcttatgctactggctttggcgtagtggtagtttgttggtatcaatcgacatttactcgttaattttgtcaggaaaa

SEQ ID NO: 1249 - DNA, 777 bp, Utricularia gibba
gcttactcatggttcacgcctttttttacgttctccgaactagcttcgcgatgcgttgagggaagccatatctgttataacggcgcaatgtaaggagaagaagcgcaaattcacggagacaattgaactgcagattggactgaagaactatgacccgcaaaaggacaagcgcttcagtggttccgtcaaattaccacacatcccaagacctaaaatgaaggtctgcatgcttggtgatgcgcagcacgttgaagaggctagaaaaaatcggcctggagtcgatggatgttgaggctttgaagaagttgaacaagaacaagaagctggtgaagaagctcgctaagaaatatcatgcttttctggcatctgaagctgttatcaagcagatcccacgtctccttggtcctggtcttaataaggctggtaaattccctactctggtgacacaccaggaatcactggaatccaaggtgaatgagaccaaggctacagtgaaattccaactgaagaaggttctttgtatgggtgttgctgttgggaacctggatatggaggagaagcagatcttccagaacgtgcaaatgagcgttaatttcctcgtctcccttctgaagaagaattggcagaacgtaagatgcttgtacttgaagagcaccatgggaaaaccccaacgcatcttttgaatagtttctttgatttgtattatggacaagctctatgcatctttgatcatccagaatttcagacgcgattttgctttcgtttatgaagagagct

SEQ ID NO: 1250 - DNA, 1122 bp, Phaseolus coccineus
tatatacttctttctctgcccgcaccaaaccctagctagggtttcgcctccggtactttatctattcagaagactttgctattgcatttccttctgctttcttcactcattccaattctcactttcttcttctctgcaattttttcgcagctctgagatctgtagccgcctagccgttaagttggaaaagcccaagtttcaaaatgagtaagcttcagagtgatgctctaagggaagctatctctggtatcatgggtgattccaaagagaagaaccggaattttgtggagactattgaactccaaattgggctgaaaaactatgatccccaaaaggacaagcgtttcagtggctctgttaagttgcctcatattcctcgccccaagatgaagatttgcatgcttggagatgcccaacacgttgaggaggcagagaagataggattggactacatggatgttgaggcgttgaagaagcttaacaaaaataagaaattggtgaaaaagttagctaaaaagtatcatgcgtttttagcctctgaagccgttattaagcagattcctcgtctcctaggacctggtctcaacaaggcagggaagttcccgacccttgtgactcaccaagaatctctagagtcaaaggttaatgagactaaggctatggtcaaattccagcttaagaaggtgctatgtatgggagtagctgtggggaatgttagcatggatgaaaaacaaatctttcaaaatgtacaactgagcgttaacttccttgtctcactgctgaaaaagaactggcagaatgttaggtgcttgtatctgaagagcaccatggggaaatcgtaccgtgtcttttaagtgtttgttcttaaattcagtgaatttctgatcacttaatatattgtcgtaataggttggacagaatctttcattgttctacagttttgttggatgagtattttttggttagtatttcatgttattgacatgtgtttcaagtgctttgcaacatcggatattttaagcggtgctaattttaaggtacccttgttttttatttctttatatacaacatgcgcaatgctccttcgatgcacgtatcctatgaatcagcttttagataccg

SEQ ID NO: 1251 - DNA, 962 bp, Phaseolus coccineus
gctagctaggtttcgcctccgctctgagatctgtagccgcctagccgttaagttggaaaagcccaagtttcaaaatgagtaagcttcagagtgatgctctaagggaagctatctctggtatcatgggtgattccaaagagaagaaccggaattttgtggagactattgaactccaaattgggctgaaaaactatgatccccaaaaggacaagcgtttcagtggctctgttaagttgcctcatattcctcgccccaagatgaagatttgcatgcttggagatgcccaacacgttgaggaggcagagaagataggattggactacatggatgttgaggcgttgaagaagcttaacaaaaataagaaattggtgaaaaagttagctaaaaagtatcatgcgtttttagcctctgaagccgttattaagcagattcctcgtctcctaggacctggtctcaacaaggcagggaagttcccgacccttgtgactcaccaagaatctctagagtcaaaggttaatgagactaaggctatggtcaaattccagcttaagaaggtgctctgtatgggagtagctgtggggaatgttagcatggatgaaaaacaaatctttcaaaatgtacaactgagcgttaacttccttgtctcactgctgaaaaagaactggcagaatgttaggtgcttgtatctgaagagcaccatggggaaatcgtaccgtgtcttttaagtgtttgttcttaaattcagtgaatttctgatcacttaatatattgtcgtaataggttggacagaatctttcattgttctacagttttgttggatgagtattttttggttagtatttcatgttattgacatgtgtttcaagtgctttgcaacatcggataatttaagcggtgctaattttaaggtacccttgttttttatttctttatatacaacatgcgcaatgctccttcgatgc

SEQ ID NO: 1252 - DNA, 992 bp, Cenchrus ciliaris
  misc_feature (788)..(788): n is a, c, g, or t
ctctaccgcgccgcctcccccttgctcgaggaacgttgttctcgccaggacctccggcgccatgagtaagttgcagagtgacgctctgagggatgcgattgcctcaattaccaacgactcccgtgaaaagccgcgcaagtttgttgaaaccattgagctgcagattggactgaagaactatgaccctcaaaaggacaagcgtttcagtggttctgttaagctgcctcacatccctcgccctaagatgaaggtttgcatgcttggtgatgctcagcatgttgaggaggcagcaagaataggtctggacagtatggatgtggaagccctcaagaagatgaacaaaaacaagaagctagttaagaagcttgcaaagaaataccatgctttccttgcatctgaggccatcattaagcaaattcctcgtcttcttggacctggtcttaacaaggcaggaaagttccctactttggtgtctcatcaggaatcccttgaatccaaggttaatgagactaaggctacagttaagttccagctgaagaaggtgctttgcatgggtgttgctgttggtaactgcggcatggatgagaagcaaatcttccagaatgtgcaaatgagtgtcaacttccttgtgtcactcttgaagaagaattggcagaatgtcagatgcctgtacctgaagagcactatgggaaaggtgtaccggttgttctaaaccttttatcttaggcttgtagaattactggggtactctgctattttccctaccaccaaatttttctgcaactatnaaggatcaaggagttaaatatccattgtcttgtgcgagatgtttcgttcttatcgaacctatggccacatcttattttgacatgttttgtcgctacctaagctcaattactgagtggtctaatttccctttattctcttgagccgtacgcccgtataatttttcgctgttgtatctgtgttctatttttagctgcatttcatta

SEQ ID NO: 1253 - DNA, 1169 bp, Gossypium hirsutum
ctcttctctggtagtttctctatatccctgaacgactccaatttttcttgttagatctagttctgatacgtcttttttttaatttctggatgacttgataactttgttttacaggtaaatgttatagttttgttcgtggaaagaacagagattcagagatgagtaagcttcagagtgatgcccttagagaagctatttcaaccattgtagctcagtccaaggagaagcagcgtaagtttattgagactattgaactccagattgggttgaaaaactatgatccccaaaaagacaagcgtttcagtggttccgtgaagttgccacacattcctcgacctaaaatgaagatctgcatgcttggagatgcccagcatgttgaagaggcagagaagataggtttggattatatggatgttgaagcactgaagaagctaaacaagaacaagaagttggtcaaaaagcttgccaagaagtatcatgcttttttggcttctgaatctgttatcaagcagatccctcgtctcctgggtcctggtctcaacaaagcagggaaattcccaacccttgttactcaccaggaatcgctagagtccaaagtgaatgagaccaaggcgatggttaagttccagctgaagaaggttctttgcatgggagttgccgttgggaatgttgcgatggaggagaagcagatcttccaaaatgtgcaaatgagcgtcaatttcctggtttcattgttgaagaaaaactggcaaaacgtgaggtgcctctacttgaagagtaccatgggcccatcaaacaggatcttttgaattggtagttacccatgtgttaagagttttgtatgtggacaaattttctgctatgttttgtcgttggaatcttagagttgtgattttgagacattggaagttttgttttgcatatcaacataaaatgtcaatttccatcttatttttaatcgttaaaaaaaggcctaatgtggtggcatattggattggctcattggacatgctctatgatggcggaaaatagttatttgggaatggttatggctgtggtttgctggaaaaaaagatttgcatagtagggtttgaatgaactacattcattacaccatgaccgctgataatcttttagtaaataatcacgtcggaattctagctagttag

SEQ ID NO: 1254 - DNA, 989 bp, Cucumis sativus
gttcttccattatatatttattctctgttcggccgtcgaaaaaccctagcttcctgtcttctcaccagtttgtagctacttcttgggaaagacaaagctccgaaaatgagcaaacttcaaagtgatgcgttgagagaagccatttcatctatcttcgctgatagcggtgaaaagaagcgcaaattcactgagaccattgaacttcagattggacttaagaactatgatccacaaaaggacaagcgtttcagtggttcagtgaagttgccccatatccctcgccctaagatgaagatctgcatgcttggagatgcttcacacgttgaagaggcagagaagattggtttggattatatggatgttgaaggtctgaagaagctaaacaaaaacaagaagttggttaagaaacttgccaagaaataccatgcctttttagcatctgaagctattatcaagcaaattccccgtcttctgggccctggtctcaacaaggcaggaaagttccctaccctggtcactcatcaagaatctcttgaatctaaagtaaatgagactaaggcaatggttaagttccaattgaagaaggttctttgtatgggtgtggccgttggcaatattgccatggaagagaagcaagtttttcagaacgttcaaatgagtgtcaatttccttgtttctttgttgaaaaagaattggcaaaatgtgaggtgcttgtacctgaagagtacaatggggaaggcatatcgagtcttctgaggaattttcataacctagatagttctgtttgtttgtcttaaatggaagaagttgagataagatttctatatttatgattgatgaaaaattttcctgtttgtttccttttagtaaaccattagctgcacaatcgtcaacacttgtgatgggagtaatgtgtttttttgtttcactctatatgttctgtagatttttgtttcaatttatttgattattgcttagtttcaattaaa

SEQ ID NO: 1255 - DNA, 1015 bp, Ipomoea nil
gaccctctctcagctccgattcagatattttgaagggaaagaaaaatctttcgccatgagcaagttgcaaagtgatgccgtgagggaagcaatctcccaattaatgggggattctaaggagaagaaccgcaagttcactgagaccattgagcttcaaattgggctgaagaactatgatccccagaaggacaagcgtttcagtggttcagtcaaattgcctcacattccacgccctaagatgaaagtatgcatgcttggtgatgctcagcatgtggaggaggctgaaaaaattggcatggagtatatggatgttgaggggttaaagaagctcaacaaaaacaagaagctggtgaagaagcttgcaaagaagtaccatgctttcttggcatctgaagctgtaattaaacagatccctcgtctcttgggccctggtcttaacaaggcaggcaagttcccaaccttggtgacacatcaggagtccttggagacgaaggttaatgaaacaaaggctactgtaaaatttcagcttaagaaggtcctctgtatgggtgttgctgttggtaatgttgccatggaggaaaagcagatcttccagaatgttcaaatgagcgtgaactttctggtatcattgctgaaaaagaactggcagaatgtgaggtgcctatatctcaagacaacaatgggaaggcctattcgggtcttttaacttggaattgtgtcttttgtattctttatttaagctctataggtagacattgcacaatcagtcttgtactctgccattgtctagaaccatttttgtttcgatgtcctcgtggatttccctgttattgttcaaggcttatcactgggtatttggatttgttgagatttttgatatcagtctctctttgatttcatttttgaagagtgtaggacgagtggattagataccattttactacaacatacttaatcctgcacacttttatctaatccttgtttgcgtactgtagtaatgtcttgagaatatttt

SEQ ID NO: 1256 - DNA, 854 bp, Leymus cinereus x Leymus triticoides
gtgctcccaccgccggcgccatgagtaagttgcagagcgaatccctgagggaggctataacaaacattaccaatgattgccgtgagaagaaccgcaagttcgttgaaaccattgagctgcagattggtctgaagaactatgacccgcaaaaggacaagcgtttcagtggctctgttaagcttcctcacatccctcgcccaaagatgagggtttgcatgcttggtgatgcccagcatgttgaagaggcagggaagatgggcctagactgtatggatgtggaatcccttaagaagatgaacaaaaacaagaagctagtcaagaagcttgcaaagaagtatcatgctttccttgcatctgaggctatcattaagcaaattccccgacttctaggacctggtcttaacaaggcaggaaagtttccaactttggtgtctcaccaggagtcccttgagtccaaggttaatgagaccaaggccacagtcaagttccagttgaaaaaggtgctatgcatgggtgttgccgttggccacctgggtatggaggagaagcagatcttccagaacgtgcagatgagtgtgaacttccttgtctctctgttgaagaagaattggcaaaacgtgagatgcttgtacctgaagagcacgatgggaaaggtgtaccggttgttctagtcttctaggatttccaggagatttgacaacttgagaacttttgttcctttctcaattatcaaactttcgtgcgcgacgagtgacaattattgtcttgtactgagatggtttgttctattgtctggaatttcatgacattttatccgttgtccctgtgccttactactgctctgcctgctgtca

SEQ ID NO: 1257 - DNA, 1044 bp, Zea mays
acgctataaccctaggcctcttggtatttaattcccagcagcagctgcccacacgccgccgccgttcgctgctcggcgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaatgagacaaaggctacagttaagttccagctgaagaaggtgctttgcatgggtgttgctgttggcaactgcggcatggatgagaagcagatcttccagaatgtgcaaatgagtgtcaacttcctcgtgtcgctcttgaaaaagaattggcagaatgtgagatgcttgtacctgaagagcactatgggaaaggtgtaccggctgttctaaattttccaattaggcttagaatttccaggagactcgagtgcttggacacttgccattttccctaccatccatttttttgagcaactatggattatctagttacaaacttggtcttgtacttgatgttttgttcttgataccgaacctatgacattgttaccttatttcaatgtttctctcgtcacccacaggccgggggctacgatgtccttgagtcctatccgtacggtagcct

SEQ ID NO: 1258 - DNA, 1066 bp, Cucumis melo
cttcgttcttccattatatatttattctcagttcggccgtcgaaaaaccctagcttcgtgtcttctcaccagtctgtagctacttcctgggaaagacaaagctccgaaaatgagcaaacttcagagtgatgcgttgagagaagccatttcatctatctttgctgatagcggtgaaaagaagcgcaaattcactgagaccattgaacttcagattggactgaagaactatgatccacaaaaggacaagcgtttcagtggttcagtgaagttgccccatatccctcgccctaagatgaagatctgcatgcttggagatgcttcacacgttgaagaggcagagaagattggtttggattatatggatgttgaaggtctgaagaagctaaacaaaaacaagaagttggtgaagaaacttgccaagaaataccatgcctttttagcatctgaagctattatcaagcaaattccccgtcttctgggccctgggctcaacaaggcaggaaagttccctaccctggtcactcaccaagaatctcttgaatctaaagtaaatgagactaaggcaatggttaagttccaattgaagaaggttctttgtatgggtgttgccgttggcaatattgccatggaagagaagcaagtttttcagaacgttcaaatgagcgtcaatttccttgtttctttgttgaaaaagaattggcaaaatgtgaggtgcttgtacctgaagagtacaatggggaaggcatatcgagtcttctgaggaattttcatagcctagataacagttctgtttgttcttaaatcgaagaagttgagataagatttctatatttatgattgatgaaaaattttcctgtttgtttccttttagcaaaccattagctgcacaatcgtcaacacttgtgatgggagtaatgtgttttttgtttcactctacatgttctgtagatttttgttttaatttattgtttgattattgtttggtttcaattaaagaacatctaatcaattcgtgcaggtgcttccagttattcaaaattaatgttatgaaaatttttaaaaaaaa

SEQ ID NO: 1259 - DNA, 914 bp, Pennisetum glaucum
cagagtacgcggggatccgttcttgtccgcctcttcgcaggaacgctgctcgcaccagcaccgccggcgccatgagtaagttgcagagcgatgttctgagggaggcgattgcctcaattaccaatgacgcccgtgaaaagcagcgcaagtttgttgaaaccattgagctgcagattggactgaagaactatgaccctcaaaaggacaagcgtttcagtggttctgttaagctgcctcacatccctcgccctaagatgaaggtttgcatgcttggtgatgctcagcatgtcgaggaggcagggagaatgggtctggacagtatggatgtggaagccctcaagaagatgaacaaaaacaagaagctagttaagaagcttgcaaagaaataccatgctttccttgcatctgaggccatcattaagcaaattcctcgtcttcttggacctggtcttaacaaggcaggaaagttccctactttggtgtcccatcaggaatcccttgaatccaaggttaacgaaaccaaggctacagttaagttccagctgaagaaggtgctttgcatgggtgttgctgttggcaactgcggcatggacgagaagcagatcttccagaatgtgcaaatgagcgtcaacttccttgtgtcactcttgaagaagaattggcagaatgtgagatgcctgtacctgaagagcactatgggaaaggtgtaccggttgttctaaatctttatcttaggcttgtagaattttcaggagacttactggggtacttttgctattttatctaccaccatttttttgtgccaaccagtgaggattaaggagttaaatccccattgtcttgtgcgagatgttttccttcttgttatcgaacctatggcaatatcttatttcaacatttttgtcgctacctaa

SEQ ID NO: 1260 - DNA, 884 bp, Momordica charantia
gagggtctcttcttttcctccggactgaagtgtatggtattttagcgaaggcgaaggttcgaatatgagtaagcttcagagtgatgcgttgagagaagctatcacatctatcttctctgatagcaatgagaaaaagaggaaatttaccgagaccattgaacttcagatcgggctgaagaactatgaccctcaaaaggataagcgtttcagtggttctgtgaagttgccccacattccccgtccgaagatgaagatttgcatgcttggagatgcattgcacgttgaggaggccgagaagattggtttagattatatggatgtggagggcttgaagaagcttaataagaacaagaaattggtgaagaaacttgccaaaaagtaccatgccttcttggcatctgaagctgtaatcaagcagatccctcgtcttctaggacctgggctcaacaaagcaggaaagttcccaacattggtgacacaccaagaatcgctcgaatccaaagttaacgagaccaaggcaatggtcaagtttcaattgaagaaagtgctttgcatgggagttgcagtgggaaatgtttccatggaggagaagcaagtcttccaaaacgtgcaaatgagtgtcaatttcctggtttctttgttgaagaagaactggcagaatgttaggtgcctgtacctgaagagcacaatggggaagtcgtaccgagttttctaagctctgttagtgatctagtcagtcttgtgttcgatctttctactgttgaagttattttttgaagagcagttttgcgaattgagcgtttttttaatgatcattgaacaaagaaacagggatgcttttttctcctctaaagtgactattgataatgaagttttcaattcct

SEQ ID NO: 1261 - DNA, 979 bp, Mimulus guttatus
ctcttaaatccatcgacactctcacaaaccctaatcaaggctttctcttaagcttaattttcgttttcggcggcttcgggaatcatgagtaagcttcagagcgatgccgttagggaagcaatcacccagattgccgcagattgtaaggagaagaaccgtaagttcaccgagacgattgagctccagattggactcaagaactacgacccgcaaaaagacaagcgtttcagtggctctgtgaagttgccccatatcccgaggcccaagatgaagatttgcatgcttggtgatgctcagcatgttgaagaggccactaagattggtctcgagtccatggatgtggaggctcttaagaagctaaacaagaacaagaagttggtgaagaagcttgcaaagaaataccatgctttcttggcctccgaagctgtcattaaacagattccccgtctcttaggtcccggtcttaacaaagcaggtaaattcccgacccttgtgtctcaccaggaatctcttgaagcgaaggtgaacgagacaaaggcgactgtcaagttccaattgaagaaggtgctctgcatgggagttgctgttgggaatctatcaatggaggagaagcaaatcttccaaaacgtgcaaatgagcgtcaacttccttgtttcccttttgaagaagaattggcaaaatgtgagatgcttgtacttgaagagcactatgggacgtcctcaacgggtcttttaagaaagttgaatttgagttttgttttgtttcgtttcctatttgcttaggacaaaaaaggttgtaagagagtaacatagatttgaatgttttctccagaaatgggattctttttggttttctgctatggttacattgtgagggatacttttgtttatggattttattttatttgtgatttcattaccatttgtctgttgcttatgttttgttatttaattggttataactgccgggcttgtgatgg

SEQ ID NO: 1262 - DNA, 881 bp, Tropaeolum majus
agccactttagttttcagcgtctgaatctccttctacttgtttttaggagtttaccctttgtagaattttcagtgtttcaacatgagtaagctccagagtgaggcacttagggaagccatcaccaccattgtgactgcttctaaggagaagcagaggaagttcactgagaccattgaactccaaattggtttgaagaactatgatcctcaaaaggacaagcgtttcagtggatcagtgaagttgccacacattcctcgcccaaagatgaaggcctgcatgcttggagatgcccaacacgtagaagaggcagaaaagattgggcttgactacatggatgttgaggctttgaaaaagctcaacaagaacaagaagttggttaagaaactagctaagaaataccacgctttcttggcatccgaatctgttatcaagcagattcctcgtctcttgggccctggtctcaacaaagcaggaaagttccctacccttgttagtcaccaggagtctcttgaggctaaggttaacgagattaaggcaacagtgaagtttcaattgaagaaggtgctatgcatgggtgtggctgttggtaactgtgctatggaggaaaaacagattttccagaatgttcaaatgagtgtcaactttctcgtgtccctgttgaagaagaattggcaaaatgtgcggtgcttgtatctgaagagtacaatgggtccttcaaacagagtgttttaggttagcctcaagtatctgggagcattataatatctaaactgtttgttttactttgttttagttggaagagtagaaaacctatctttattgaaacaaaaattttgtttgagattttgattattgtctaattacatttggaggatatcac

SEQ ID NO: 1263 - DNA, 900 bp, Tropaeolum majus
actactatcttcaattcattatatttgcagccactttagttttcagcgtctgaatctccttctacttgtttttaggagtttaccctttgtagaattttcagtgtttcaacatgagtaagctccagagtgaggcacttagggaagccatcaccaccattgtgactgcttctaaggagaagcagaggaagttcactgagaccattgaactccaaattggtttgaagaactatgatcctcaaaaggacaagcgtttcagtggatcagtgaagttgccacacattcctcgcccaaagatgaaggcctgcatgcttggagatgcccaacacgtagaagaggcagaaaagattgggcttgactacatggatgttgaggctttgaaaaagctcaacaagaacaagaagttggttaagaaactagctaagaaataccacgctttcttggcatccgaatctgttatcaagcagattcctcgtctcttgggccctggtctcaacaaagcaggaaagttccctacccttgttagtcaccaggagtctcttgaggctaaggttaacgagattaaggcaacagtgaagtttcaattgaagaaggtgctatgcatgggtgtggctgttggtaactgtgctatggaggaaaaacagattttccagaatgttcaaatgagtgtcaactttctcgtgtccctgttgaagaagaattggcaaaatgtgcggtgcttgtatctgaagagtacaatgggtccttcaaacagagtgttttaggttagcctcaagtatctgggagcattataatatctaaactgtttgttttactttgttttagttggacgagtagaaaacctatctttattgaaacaaaaattttgtttgagattttgattattgtctaattacatttgga

SEQ ID NO: 1264 - DNA, 1236 bp, Orobanche aegyptiaca
aaatataattagaaaatgtaaattatcaaatgaatgagtaatatgcaaagattcccaccatcttaataataacgagaaaagcatatacaataatccaaaccctattataactaagcccaataaagaacccaattactattaaagtgggctcgttaaagcccaaatcgagagcccgaccgtcgacctgttctagggtttgggataccaatatttagccgttttcacttcactcacattcacaaaccctagtcgcggttttcctatcagaagtgaattcaggaagataagaagacttgaaccatgagtaagcttcagaatgaagccttgagggaagccattactcagattgtcgctgactgtaaggagaagaagaggaatttcattgaaactattgagcttcagattggattgaagaactatgacccacagaaggataagcgtttcagtgggtctgttaagttgccccacatcccaaggccaaaaatgaagatctgcatgcttggtgatgctcagcatgttgaagaggcagaaaagattggccttgagtctatggatgtggaggccctgaagaagttaaacaaaaacaagaagttagtgaaaaagcttgcaaagaagtatcatgctttcttagcctcggaggcagttatcaagcagattccccgtcttttgggaccgggccttaacaaggcaggtaagttccccactcttgtgactcaccaggagtcacttgagtcgaaggtgaacgagaccaaggctactgttaagttccaactgaaaaaggtgctttgcatgggggttgctgttgggaaccttgacatggaggagaagcaaatctttcaaaatgtccaaatgagcataaacttccttgtttctcttcttaagaaaaattggcagaatgtgaagtgcctgtatttgaagagtactatggggaagccccagcggatcttctaagctgttgatttgattttggtttgacgagtagttgtacgtgcaaaaatatgactggatatttctcagaaatgggaagttttttgaatttctattgttgtgatagtgctgagttcgactttggatatttattatctttatttgatctatatttttgcgtacaagtttctgttctggccggtacctggttattgataattgccgtgttcttgttcagctgtgtgtcggtttatttgacagtaactctataatatgcttctgaatttgttaaaatctgagaagttgatt

SEQ ID NO: 1265 - DNA, 879 bp, Petunia hybrida
ttacggtgaagtttcaaggagaaagacagataattttgagccatgagtaagcttcagagtgatgcccttagagaagccatctctgtgattacaaaagattcagcggagaagaaaaggaagttcactgaaacaattgaactccagattggactgaagaactatgacccccaaaaggacaagcgtttcagtggatcagtcaagctgccccacatccctcgtcctaagatgaaagtttgtatgctgggggatgctcagcatgttgaggaggcagaaaagattggattagaatatatggatgtagaaggcttgaagaagcttaacaaaaataagaagttggtcaagaagcttgctaagaaatatcatgctttcttggcttctgaagctgtcatcaagcagattccccgtctcttggggcctggtctgaacaaggcaggaaaatttcccacccttgttacacaccaggagtcactcgaatccaaggttaatgagatcaaggcaactgtcaagtttcagttgaaaaaggtgctttgcatgggagttgctgttggaaacatggatatggaagagaaacaaattttccagaatgtgcaaatgagtgtgaatttcctagtctcattgctgaagaagaattggcaaaatgttaggtgcctgtactcgaagagcaccatgggaaagacacaacgtatcttttaaggagattttcgttttgttctcggaattttcaggcattctgttgtgtgagctataaactctttgaaattttgagtagtaaaaaggggtatctgtttgaatattattatggaagtattagagattgttttgcttcaatgcttgaaatggcagcatttgcattatcttgagatttaagtgattatacca

SEQ ID NO: 1266 - DNA, 935 bp, Petunia hybrida
ttcacgccgctctcaaccctaatcagggtttctctcacacagaagtgaaatattgaagcatttgagccatgagtaagcttcagagtgatgccctcagagaagccatctctgtaattaagaaagcttcagaggataagaagagaaaattcacggaaactattgagctccagattgggcttaagaactatgatcctcaaaaagacaagcgtttcagtgggtctgttaagcttccccacattccacgccctaagatgaagatttgcatgctgggagatgctcagcatgtggaggaggcagaaaagattggcctggaatacatggatgtggaaggcctcaagaagcttaacaagaacaagaagttggtcaagaagcttgcgaagaagtaccatgctttcttggcttcagaagctgtcatcaagcagattccccgtctcttgggtcctggtctgaacaaggcagggaagtttcccacccttgttacccaccaggagtcccttgagtctaaggttaatgagaccaaggctactgtaaagtttcagttgaagaaggttctctgcatgggtgttgctgttggaaatcttgatatggatgagaaacaaatcttccaaaatgtgcaaatgagtgtgaatttcctggtgtcattgctaaagaagaattggcaaaacgtaaggtgcttgtacttgaagagcacaatgggaaagacacagcgtgtgttctaagatgattgtcttgattttggaacttttcgagcattctgctttgtaagagatatcgttaaaattttggatagatgtcatcctggataatggaatgtttaatcatgatagggattgtttgccacaggcattttgttttgaagagatagtgctgatcttgttctcttatatatttatcaatggtgatttctatggcatgataaacaagaaaaaaaaaaa

SEQ ID NO: 1267 - DNA, 1027 bp, Sequoia sempervirens
atgtcattcgtgtgaacacattggcggttgcgggcaatgaagagagtttagcaaaaccctagcttgggtttttttctcttatcgttatcagcccttgctgttgttagggaaagtaaacggaaaagaacagaggagaggagagcagaagggcggcgttgtatcagccatgagtaagcttcagagcgatgttttgagggaggcgataacaggcttggtgggagagagcaaagacaagaagagaaagtttgtggagacgatcgaattgcagattgggctgaagaattatgaccctcagaaggataagcgcttcagtggctctgtcaaactccctcacatccctcgccccaagatgaagctctgcatgctcggtgatgcccagcacgttgaagaggctgagaaaataggattggactacatggatgtcgaaggattaaagaaaatgaacaagaacaagaaattggttaagaagcttgccaagaaatatcatgcttttcttgcatcagaagcaattatcaagcagattcctcgacttcttggccctggtctaaacaaggctggtaagtttcctactttggtgtcacatcaagagtcattggagggaaaagtaaatgaaacaaaagccactatcaagttccaattgaagaaagttctgtgtatgggtgttgccgtgggtaactgtggcatggaggaaaagcaaatattccagaatgttcagttgagtgtcaactttctggtgtccttgctcaagaagaattggcagaatgtcaggtgtctctatctgaagagcaccatgggaaagccatctcggatattctaaatgagcaatttagtcagcttttgctcaatgaacattggtggaatatgttttgttttgttggtttagggttgtcgggtgttcagacaatttattctaatgcaaaattgcatttgatttcaatataacattttgcagaggcatatgttatgcaataggcaggctcagatttatgttgtaactgagggagattctatttttgactcacaattg

SEQ ID NO: 1268 - DNA, 988 bp, Taxus baccata
taacgcaagctgcgtgaacaaagtttaacaaaaccctagcttatggcctcgttagtttcttttcccacctgtgcttccgattgctaggggacacgacgagagggttgtgcggcggcataagcatgagtaagcttcagagtgatgtgttgagggaagcgataacgggggtggttgcagagagcaacgagaagaaaggaagtttgtcgaaacactagagttgcagattggcctgaagaactatgatcctcagaaggacaagcgcttcagcggctccgtcaagctcccccacattcctcgccctaagatgaagctctgcatgctcggcgatgcccagcatattgaagaggcagagaaaataggtttggactacatggatgtagaaggactaaagaaaatgaacaagaacaagaagctggttaagaagcttgcgaagaaataccatgcttttcttgcatcagaagcgattattaagcaaattcctcgacttcttggtcctggtctaaacaaggctggtaagtttcctactttggtgtcccaccaagagtcattggaggcaaaagtaaatgaaacaaaagccactatcaagttccaattgaagaaagttctgtgtatgggtgttgctgtgggtaattgtggcatggacgaaaaacaaatattccagaatgttcagctgagtgttaactttctggtgtccttactaaagaagaactggcaaaacgtacgttgcctttatttgaagagtaccatgggcaagccttcccggatattctaattctgcaatttatcgacagcttttgctaaatgaaacactggaatatatgttttgttttgttgacttacgaggttcaagcaatttattttattaggactttgcacttgatttcaacataacgttttgcaaaggcataggtccgaggcatgatgcagtcgagggaaatttaatttgattttcttacaaattcaataatgattgatgttctctttctcc

SEQ ID NO: 1269 - DNA, 904 bp, Thellungiella halophila
gagagggcttcagctgcttcacctttcagggtcagagattcgtgaactgagagaaacccaagatgagtaagcttcagagtgaggctcttagagaagccatcacaactgtcaagagcaaatctgaggataagaaacgtaactttgtggagacagtggagcttcagattggtctgaagaactatgacccacaaaaggacaagcgtttcagtggttctgtcaagctcccacacattcctcgcccgaaaatgaagatctgtatgcttggagatgcccagcatgttgaagaggctgagaagatgggactagactatatggatgttgaggctttgaagaagctcaacaaaaacaagaagcttgttaagaagcttgctaagaagtaccatgctttcttggcttctgaatccgtcattaagcagattccccgtcttcttggtcctggtcttaacaaggcaggaaagttcccaactctggtgagccatcaagagtcgttggaatcaaaggtgaatgagacgaaagcaactgtgaagttccagttgaagaaagttctgtgtatgggtgttgctgttggtaacctttccatggaagagaagcagctctttcagaacgtgcagatgagcgtcaactttcttgtctcgctattgaagaagaattggcaaaacgtaaggtgtttgtacttgaagagcaccatgggaccaccacaaaggatcttttgagctatctactccatcagtccaacttcgagttttgctttgtgtttttttttttcagagatcttgtgcttcttgagatatggtttggaatgatattattagcagaattcaagtgctagtttgctttttggtagacgatatatgcaatgtcctacaatatttacaattcaattttatccatctactatctcatg

SEQ ID NO: 1270 - DNA, 960 bp, Amsonia hubrichtii
ttttgcagtctcctgaactccaaagaggcagtggacttgttcatctgtggaaggaaaaactaatctttcaccatgagtaagctacagagtgatgctgttaaagaagcaatcgcccagattgttacggattctaagggggataatggggagaaaaagcgtaagttcacagaaactgttgagcttcagattgggctgaagaactacgacccccaaaaggacaagcgttttagtggctctgttaaactcccacatatcccgcgcccgaagatgaagatttgcatgcttggtgatgctcagcatgtggaagaggcagagaagattggtcttgagtatatggatgttgagggcttgaagaaactcaacaaaaacaagaaattggtgaagaagcttgccaagaagtatcatgcttttctggcatctgaagcggtgatcaagcagatcccgcgtcttttgggtcctggtcttaacaaggcaggcaaatttcctaccctggtcactcatcaggaatccttggagtctaaagtaaatgaaacaaaggccacagtcaagtttcagctcaagaaggtcctttgtatgggtgttgctgtgggcaatttggacatggaggagaaacaaattttccagaatgttcaaatgagcgtcaactttctcgtatcactattaaagaagaattggcaaaatgtgaggtgcttgtatctgaagagtaccatggggaggccacaacgcatcttctgagcagtttgttttcatttactggtgttctaaaatcagtttagtttgagtcaaagagtgggcagttggatacactttttggtcaatgtttcagttatttttgcttaccaatgttaatggattcttctgcaattttgaactgagcaatgaaattttagttccagataagacaatttatactttgtattatttttttgttgagctactgtgggtggatcatcaaattgt

SEQ ID NO: 1271 - DNA, 940 bp, Vinca minor
tttcttccttcagtagtcttccatagagttaatccgtgaagatcaagactgatccttcacaatgagtaagctacagagtgatgctgtgagagaagccatttctcagattgttgctgactgtaataaagaggataagaaacgtaagtttactgagaccgttgagcttcagattggactgaagaactatgacccccaaaaggacaagcgtttcagtggctcagtcaaactgccacatatccctcgccccaagatgaaggtttgcatgcttggtgatgctcagcatgttggagaggctgaaaagattgggctcgagtacatggatgttgagggtttgaaaaaacttaacaagaacaagaaacttgttaagaagcttgccaagaagtatcatgctttcctggcatctgaggcagttatcaagcagattccccgtcttctgggtcctggtcttaacaaggcaggtaaatttcctacattggtcagtcatcaggaatccttggagtcgaaagtgaatgaaataaaagccacagtgaagtttcaactcaagaaggttctttgcatgggtgttgctgtgggcaatttgtccatggaagagaagcaaattttccagaatgttcaaatgagcgtcaactttctcgtatcactgctaaagaagaattggcaaaacgtgaggtgcttgtatcttaagagtaccatggggaggcctcaacgtatcttctgagcagttgttcttatttactttgttttaagatcagtttagtgcatgtcaaagagttggcatctgaacacacttcgtggtgaatgtcccgaatatttttgcttactttttaaaatgtattctgtgattttgaaccttgctatgaaattttatatttacctttgtcaacgcttataattgtaagacagttattacaggttggtgggcgtttgaacagtaaattga

SEQ ID NO: 1272 - DNA, 894 bp, Vinca minor
cagtcttccatagagggtctctctctctcgaacatctcataggcagtgcacttgtggaaagctagactgaattttcaccatgagtaagctgcagagtgatgctgttagagaagcaatttctcagattgttgctgactgtaataaagaagataagaaacgcaagtttactgagactgttgagcttcagattggactgaagaactatgacccacaaaaggacaagcgtttcagtggctcggtcaaactgccacatatccctcgtcccaagatgaaggtttgcatgcttggtgatgctcagcatgttggagaggctgagaagattgggcttgaatacatggatgttgagggtttgaagaaacttaacaagaacaagaaacttgttaagaagcttgcgaagaagtatcatgctttcctggcatctgaagcagttatcaagcagattccccgtcttctgggccctggtcttaacaaggcaggaaaatttcctacactggtcagtcatcaggaatccttggagtcgaaagtgaatgaaataaaagccacagtgaagtttcaactcaagaaggttctttgcatgggtgttgctgtgggcaatttgtccatggaagagaagcaaattttccagaatgttcaaatgagtgtcaactttcttgtatcactgctaaagaagaattggcagaatgtgaggtgcttgtatctgaagagtaccatgggaaggcctcaacgtatcttctgagcagttgtttttattcactccgttttaagttcagtttagtgcgaatcaaaagagttggcagtttaatacacttttgtggtgaatgtgtggaatatttttacttaattttttaaatggattctgcaattttgaacctatcaatgaaattctagtttcct

SEQ ID NO: 1273 - DNA, 916 bp, Valeriana officinalis
tctttgccgcacctcaaaactagggttcttcgtccagttgcgaagcttaatctccaaacatgagtaagctacagagtgaggctctgagagaagcaatcactcagattgctggagatgcccgaggtgataagaagagaaatttcacagagacgattgagcttcagatcggtctcaagaactacgatccacaaaaggacaaacgtttcagtggctctgtcaaattgccccacattcctcgtcctaagatgaaggtttgcatgcttggagatgcccagcatgttgaagaggcagaaaagattggtttggaatacatggacgtagaagggctaaagaagctaaacaaaaacaagaaattggtcaagaaacttgctaaaaagtaccatgctttcttagcttctgaggctgttatcaagcaaattccccgtcttctcggccctggtctcaacaaagcaggaaagtttcctactcttgttactcaccaagaatcactggagtctaaagtgaacgagattaaagcgacagttaagtttcagttgaagaaagttctgtgtatgggagttgctgttggaaattgcgctatggatgacaagcaaattttccagaatgtgcagatgagtgtcaattttctcgtctctttgttgaagaaaaactggcaaaatgtgagatgtttgtacttgaagagcaccatgggaaagccgcagcgcatcttttaagctcaagtttgttttttcaattaggttaaacttattttgagcacttatcaaactttgatatatttctatcattacttgagattttgtgttgattttcatatttggtaatctattctcctttggtttttatgtttgtaagttggatttatcaaagattgatcatgaaggttagaatttcatcaattattgcaatcgttactagt

SEQ ID NO: 1274 - DNA, 875 bp, Valeriana officinalis
gggaggtttaattttcaaacatgagtaagctacagagtgaggctctgagagaagcaatcactcagattgctggagacgcaagaggtgataagaagagaaatttcacagagacgattgagcttcagatcggtctcaagaactacgatccacaaaaggacaaacgtttcagtggatctgttaaattgccgcacattcctcgtcctaagatgaaggtttgcatgcttggagatgcccagcacgttgaggaggcagaaaagattggattggaatacatggacgtggaagggctaaaaaagctaaacaagaacaagaaattggtcaagaaactcgccaaaaagtaccatgctttcttagcttctgaggctgttatcaagcaaattccccgtcttctaggccctggtctcaacaaagcaggaaagtttcctacacttgttactcaccaagaatcactggagtctaaagtgaacgagattaaagcgacagttaagtttcagttgaagaaagttctgtgtatgggagttgctgttggtaactgcgctatggatgataagcaaattttccagaatgtgcagatgagcgtcaatttcctcgtctctttgttgaagaaaaattggcaaaatgtgaggtgtttgtacctgaagagcaccatgggaaagccccagcggatcttttgagctctttcaattaggttaaacttgttttgagcacttatcaaactttgagatatttttatcactacttgaaattttgtgtgttgattttcgtttctggtaatctgttcttggatttttgtgtttgtaagttgaatttatcaaaaattgatcatgaaggctagaattttatcaattattggaatcttcatttctcctcaaaaa

SEQ ID NO: 1275 - DNA, 1009 bp, Brassica juncea
ccaaaatgagtaagctccagagtgaagccgtgagagaggcgatatcctccatgatcactcactgcaaggagacaaagccacgcaagttcactgagaccatcgaactccagattggtctcaagaactatgacccacaaaaggacaaacggtttagcggatcggttaagttgcctcacattccaaggcccaagatgaagatctgcatgctcggtgatgcccagcacgttgaagaggctgagaagattggattagagtctatggatgtggaagcacttaagaagctgaacaagaacaagaagcttgttaagaagctggcaaagaagttccatgctttccttgcttctgaatcagtcatcaaacagattccacgtcttcttggtcctggtctcaacaaggcaggaaagttcccaactcttgttagccaccaagagtctttggaatccaaagtgaatgagacaaaggcaacagtgaagttccagctcaagaaggttctttgcatgggtgtcgctgttgggaaccttgacatggaggagaagcagatctttcagaatgttcagatgagcgtcaacttccttgtttcacttctgaagaagaactggcaaaacgtgaggtgcttgtacttgaagagcacaatgggtccaccaaaccgtgtgttctaagattattattattatctcaaagtttctcttaaggtatcatcaaaggctgagaagagatttgattttcatttctgtcgtgagccttttacttgttggattaattcgagaatccttcctttgtaggatcaatattttcttgaaagacaattttgtttctattattgcaattattattagtgggtttttcaatatcgttctttaagaaaataggaaaatatataacatgcaagtccgtagccgatcgtaaatttagtaccatctgtgtggatttgacttcgtttagtagtataattgtatgtgaagtttatctcttgagtacgtgtggatttgacttcgtttagtagtataat

SEQ ID NO: 1276 - DNA, 823 bp, Brassica juncea
ccaaaatgagtaagctccagagtgaagccgtgagagaggcgatatccgccatgatcactcactgcaaggagacaaagccccgcaagttcactgagacaatcgaactccagattggtcttaagaactacgaccctcaaaaggacaaacggttcagcggttctgtcaagttgcctcacattccaaggccaaagatgaagatttgcatgcttggtgatgcccagcacgttgaagaggctgagaagattggattagagtctatggatgtggaagcacttaagaagctgaacaagaacaagaagcttgttaagaagctggcaaagaagttccatgctttccttgcttctgaatcagtcatcaaacagattccacgtcttcttggtcctggtctcaacaaggcaggaaagttcccaactcttgttagccaccaagagtctttggaatccaaggtgaatgagacaaaggcaacagtgaagttccagctcaagaaggttctttgcatgggtgtcgctgttgggaatctcggcatggaagagaagcagatctttcagaatgttcagatgagtgtcaacttccttgtttcactcttgaagaaaaactggcaaaacgtgaggtgcttgtacttgaagagtactatgggtccaccaaaccgtgttttctaagctttgtatctcaaagtttctctttaaggtatcgtcgaagctgagtggagatttaaatttcatttctgtcgtgagtcttcgattaatttcagaatccttacttggtaggatcaagattttcttgaaagacaattttgtttctgttattgcttttgttattagtg

SEQ ID NO: 1277 - DNA, 786 bp, Brassica oleracea
ggttctttctctgtctccgttctatccaaaaggagagaatagtagctgaggaagtgccaaaatgagtaagctccagagtgaagccgtgaaagatgcgatatcaaccattatcactcactgcaaggagacgaagcctcgcaagttcaccgagactatcgagctccagattggtctcaagaactatgaccctcaaaaggacaagaggtttagcggttccgttaagttgcctcacattcctaggcccaagatgaagatttgcatgctcggtgacgcccagcacgttgaagaggctgagaagattgggttagagtctatggatgtggaagctcttaagaagctgaacaagaacaagaagcttgtcaagaagctagctaagaagttccatgctttccttgcttctgaatctgtcatcaagcagattccccgtcttcttggtcctggtctcaacaaggcaggaaagttcccaactcttgttagtcaccaagagtctttggagtccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgttaggtgcttgtacttgaagagcacaatgagtccacccacccgtgttttctaagattattttatctcaaagtttctctcaaggtgtcatctggctgtgaggagatttcattttcatttctgtca

SEQ ID NO: 1278 - DNA, 848 bp, Brassica rapa
gtttccgatcttccacaggtggaacagtatctgagaaactgccaaaatgagtaagctccagagtgaagccgtgagagaggcgatctcctcaatgatcactcactgcaaggagacaaagccacgcaagttcaccgagaccatcgaactccagattggtctcaagaactatgacccacaaaaggacaaacggtttagcggatccgttaagttgcctcacattccaaggcccaagatgaagatctgcatgctcggtgacgcccagcacgttgaagaggctgagaagattgggttagactctatggatgttgaagctcttaagaagttgaacaagaacaagaaacttgttaagaagctagccaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtgaagttccagctcaagaaggttttgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgggtccaccaaaccgtgttttctaagatgtttttatctcaaagtttctctcaaggtgtcatcagactgagaggaaatttgattttcttctcagtcatgagccttcttcttggattacttcctgaatctttactttgtaggatcaagcttttgtttaaagacaattttgtttct

SEQ ID NO: 1279 - DNA, 1008 bp, Brassica napus
gggctgtttccgatcttccacaggtggaacagtatctgagaaactccccaaaatgagtaagctccagagcgaagccgtgagagaggcgatatcctcaatgatcacccactgcaaggagacaaagccacgcaagttcactgagaccatcgaactccagattggtcttaagaactatgacccacaaaaggacaagcggtttagcggatccgttaagttgcctcacattccaaggcccaagatgaagatctgcatgctcggtgacgcccagcacgttgaagaggctgagaagattggattggactctatggatgttgaagctctcaagaagttgaacaagaacaagaaacttgttaagaagctcgccaagaagttccatgctttccttgcttctgagtctgtcattaagcagattcctcgtcttcttggtcctggtctcaacaaagcaggaaagttccctacacttgttagccaccaagagtctttggaggccaaggtgaatgagactaaagcaacagtcaagttccagctcaagaaggttctctgcatgggtgtcgctgttgggaatctcggcatggaggagaagcagatctttcagaatgttcagatgagcgttaacttccttgtttcgctcttgaagaaaaactggcaaaacgtgaggtgtttgtacttgaagagtacaatgggtccaccaaaccgtgttttctaagatgtttttatctcaaagtttctcccaaggtgtcatcagactcggaggacaattgatgagccttcttcttggattactttgtaggatcaagcttttgtttcattacagttttgtttctgttattattagtgggattttctctattttgagttttcaagatttgcgatttcgtgacaaacacattgtttagactttaaagcttagtcttggactcttggatgaatttgaccaatcaaatggtccgtcttttctttacttaacattccttgaatcaaccaaactagattcttagtcagtgcaac

SEQ ID NO: 1280 - DNA, 1495 bp, Brassica napus
aggcaaataattctttcatgtattcatagctccctttggaagaacatttacctgggaaaagcttagctaattgtaaactgacgtttgaagctttgcatagttcagagtttgagacaaaaaaaaagaaacggataagagttagatagaacttttgtttgtattttgggcttggaagtatataatagccagcaaacacccaattgttggatattttaaatatgggcctatatcatattgggctttccattagttgaaacagaatgggcttagggtttcgttcccttctgtcttgctcatatatcatataagttgcacaaaccttctttcgctgtttccgatcttccacaggtattcattcttcttcgtcttcatcgaaacgtttctccttgtgatctgacatcctcttgactttacgtttcaggtggaacagtatctgagaaactccccaaaatgagtaagctccagagcgaagccgtgagagaggcgatatcctcaatgatcacccactgcaaggagacaaagccacgcaagttcactgagaccatcgaactccagattggtcttaagaactatgacccacaaaaggacaagcggtttagcggatccgttaagttgcctcacattccaaggcccaagatgaagatctgcatgctcggtgacgcccagcacgttgaagaggctgagaagattggattggactctatggatgttgaagctctcaagaagttgaacaagaacaagaaacttgttaagaagctcgccaagaagttccatgctttccttgcttctgagtctgtcattaagcagattcctcgtcttcttggtcctggtctcaacaaagcaggaaagttccctacacttgttagccaccaagagtctttggaggccaaggtgaatgagactaaagcaacagtcaagttccagctcaagaaggttctctgcatgggtgtcgctgttgggaatctcggcatggaggagaagcagatctttcagaatgttcagatgagcgttaacttccttgtttcgctcttgaagaaaaactggcaaaacgtgaggtgtttgtacttgaagagtacaatgggtccaccaaaccgtgttttctaagatgtttttatctcaaagtttctcccaaggtgtcatcagactcggaggacaattgatgagccttcttcttggattactttgtaggatcaagcttttgtttcattacagttttgtttctgttattattagtgggattttctctattttgagttttcaagatttgcgatttcgtgacaaacacattgtttagactttaaagcttagtcttggactcttggatgaatttgaccaatcaaatggtccgtcttttctttacttaacattccttgaatcaaccaaactagattcttagtcagtgcaacaatatttgatttgatttttttactgtggtatatcgattttggctttcacttaaaccgaaagacataaacttgctttttttactctgttt

SEQ ID NO: 1281 - DNA, 943 bp, Brassica napus
ggccgttctctctctctgtttccgatcttccacaggtggaacagtatctgagaaactgccaaaatgagtaagctccagagtgaagccgtgagagaggcgatctcctcaatgatcactcactgcaaggagacaaagccacgcaagttcaccgagaccatcgaactccagattggtctcaagaactatgacccacaaaaggacaaacggtttagcggatccgttaagttgcctcacattccaaggcccaagatgaagatctgcatgctcggtgacgcccagcacgttgaagaggctgagaagattgggttagactctatggatgttgaagctcttaagaagttgaacaagaacaagaaacttgttaagaagctagccaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtgaagttccagctcaagaaggttttgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgggtccaccaaaccgtgttttctaagatgtttttatctcaaagtttctctcaaggtgtcatcagactgagaggaaatttgattttcttctcagtcatgagccttcttcttggattacttcctgaatctttactttgtaggatcaagcttttgtttaaagacaattttgtttctgttattattagtgggattttctctattttaagtttttaagatttgcgattatgtgaagacaacacatcgtttgaagtt

SEQ ID NO: 1282 - DNA, 893 bp, Brassica napus
ggtttccgatcttccacaggtggaacagtatctgagaaactgccaaaatgagtaagctccagagtgaagccgtgagagaggcgatctcctcaatgatcactcactgcaaggagacaaagccacgcaagttcaccgagaccatcgaactccagattggtctcaagaactatgacccacaaaaggacaaacggtttagcggatccgttaagttgcctcacattccaaggcccaagatgaagatctgcatgctcggtgacgcccagcacgttgaagaggctgagaagattgggttagactctatggatgttgaagctcttaagaagttgaacaagaacaagaaacttgttaagaagctagccaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtgaagttccagctcaagaaggttttgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgggtccaccaaaccgtgttttctaagatgtttttatctcaaagtttctctcaaggtgtcatcagactgagaggaaatttgattttcttctcagtcatgagccttcttcttggattacttcctgaatctttactttgtaggatcaagcttttgtttaaagacaattttgtttctgttattattagtgggattttctctattttaagtttttaagattt

SEQ ID NO: 1283 - DNA, 1027 bp, Brassica rapa
gccgttctctctctctgtttccgatcttccacaggtggaacagtatctgagaaactgccaaaatgagtaagctccagagtgaagccgtgagagaggcgatctcctcaatgatcactcactgcaaggagacaaagccacgcaagttcaccgagaccatcgaactccagattggtctcaagaactatgacccacaaaaggacaaacggtttagcggatccgttaagttgcctcacattccaaggcccaagatgaagatctgcatgctcggtgacgcccagcacgttgaagaggctgagaagattgggttagactctatggatgttgaagctcttaagaagttgaacaagaacaagaaacttgttaagaagctagccaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtgaagttccagctcaagaaggttttgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgggtccaccaaaccgtgttttctaagatgtttttatctcaaagtttctctcaaggtgtcatcagactgagaggaaatttgattttcttctcagtcatgagccttcttcttggattacttcctgaatctttactttgtaggatcaagcttttgtttaaagacaattttgtttctgttattattagtgggattttctctattttaagtttttaagatttgcgattatgtgaagacaacacatcgtttgaagtttagtctggtttgattatgagtcaaaacaaatgatccgtcctgtctttactttaacattcctctaatcaaccgaacatgattctta

SEQ ID NO: 1284 - DNA, 867 bp, Cucurbita pepo
cacaggactaagtgtatagtgtccttgagacggcgaagattcgaaaatgagtaagcttcagagtgaagcattgagagaagccatctcatctatcttcactgatagcaatgagaaaaagaggaagtttaccgagaccattgagcttcagatcgggctgaagaactatgatcctcaaaaggacaagcgtttcagtggttctgtgaagttgccccacattccccgccccaagatgaagatttgcatgcttggtgatgccttgcacgttgaagaggccgaaaagattggtctagactatatggacgtggaaggcttgaagaagctaaataagaacaagaaattggtgaagaagctcgccaaaaataccacgcctttttggcttctgaagctgttatcaagcagatccctcgtcttctgggccctggtctcaacaaagcaggaaaattcccaacattggtgacacaccaagaatcgcttgagtccaaggttaatgagaccaaggcaatggttaagtttcaactgaagaaggttctttgcatgggagtggccgtgggaaatgtcgccatggaggagaagcaagtcttccaaaatgttcaaatgagcgtcaatttcctggtttctttattgaaaaagaactggcagaatgttaggtgcctgtacctgaagagcacaatggggaagtcgtaccgggttttctaagctctgttagcaatctagtcagttttatgtttgatctttttactgttgacgttatttttgaagagcagttttgtgaattgagcgtttttgattgaatgattcttcaacaaagaaacaaggatgctttttgtcctttaaaagacaattgataatgaagtttttattcccatc

SEQ ID NO: 1285 - DNA, 838 bp, Secale cereale
gctcccaccgccggacgccatgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgcttgagtccaaggttaatgagaccaaggccacagtcaagttccagttgaagaggttctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactatagtcttctaggatttccaggagattgacaacttgggaacttttgttgctttctcaattattatcaaattttcgtgcgtggccagtgacagttaaacagttgcaactattgtcttgtactgagatggtttgttctattgtctggaatttcatgacattttatcct

SEQ ID NO: 1286 - DNA, 1045 bp, Picea glauca
cctcaggattttatttgtgactattcgagggtcgtttggagaagagcagcagtaggacgacgaagaagaggcagaggcagaggaagcaaggcgcccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcggttcagtggctctgtgaagttgcctcacattcctcgccccaagatgaaggtttgcatgcttggagatgcccagcatgtggaagaggctgaaaaattaggcttggattatatggatgtggaaggactcaagaaaatgaacaaaaacaagaaattagttaagaagcttgcaaagaaatatcatgcctttcttgcttcagaagcaatcatcaaacagatacctcgacttcttgggcctggtctcaacaaggctggcaaatttcctacccttgtatctcaccaagagtccctggaggggaaagttaatgaaacctaagcaactgtcaaattccaattaaaaaaggtactatgtatggggttgctgtgggaaactgtggaatggaagaaaagcaattttttcagaatgtgcaattgagtgttaacttccttgtatcactactgaagaagaactggcagaatgtaaggtgcttatatttgaagactaccatgggaaagcctaaccgcattttctgagtgcggaacagagcggagatatttcaatggcacttccttttgtataactattaaacataggttatgtttatttagtttcgaccaaacaaatcagttttaatgcaactacttacgaattgaggaagagatgtgctggtaaattgctgttttgaacaataagagttgttttctattgaaatagctctggtcatggttttagaccttaaacctaacattcaatgttttaaaatcatgccgtggtcgtgaagtctatcttgattttcttataatgtcatattgttagagag

SEQ ID NO: 1287 - DNA, 864 bp, Curcuma longa
gcctcaggtttgaaggaggaagacgtagacgtgaaaaatgagcaagttgcagagtcatttactcagggaagcaatctctctgatgttggcgattgtctagagaagaagcgcaacttcactgaaacaattgagttgcaaattggtctgaaaaattatgatccccaaaaagatcagcgattcagtggttctgtgaagctcccacacattccacgccctaaaatgaaagtttgcatgttgggtgacgcacaacatatcgaggaggctgagaagataggacttgattacatggatgttgaaagtttgaaaaagatgaacaaaaataagaagcttgtcaagaaacttgctaagaagtaccatgctttccttgcatcagaggctatcattaagcagattcctcgtcttcttggtcctggccttaacaaggcagggaaatttcccacattggttactcaccaagaaactttggaatctaaagtcaatgagaccaaggcaatggtaaaatttcaactgaagaaggtgctttgcatgggtgttgcagttggcaacgttgccatggaggaaaagcatatttttcagaatgtgcaaatgagtgtgaatttacttgtgtcattgctgaagaagaactggcaaaatgtgagatgcctgtatctgaagagcacaatggggaaaccatctcgcattttctaactcattgcttgctcgggttggccatcaaagagatcatatttctctgtttttccccttgaactatgttcagagttggatcgtagaaactttatgttgttgctgtcttaacattctgtggattttgaatgatttgctattcaagtgtgataaatttgctgtttcatttaacacaaaaac

SEQ ID NO: 1288 - DNA, 1361 bp, Aquilegia formosa
ctctctctctctctctcgccttgtctctatttccaaattcacaaaaggatgaaatagatgttagatctgtttaatagaacatcagatctacttgttatttgaagctctagtaccaatttctaacttcgattgatttctcaataggtttttttttttttttttatcagttgaagtggtttgggaacgagaaattctgaaatatgagtaagcttcagagtgatgtactacgagaaggtatctcacagattgtcaatgaatccaagcaaaaagaacgcaagtttgtaggaacaattgagctccagattgggttgaagaattatgacccacaaaaagacaagcgtttcagtggatctgtgaagctgccacatatccctcgtcctaagatgaaggtctgcatgcttggtgatgctcagcatgttgaagaagcagaaaagattggattggaatatatggatgtagaggggctcaagaagctgaacaaaaacaagaagttggtcaagaagcttgcaaagaaattccatgcttttcttgcttcagaagctgtcatcaagcaaattccccgtcttctgggccctggtctgaataaggcaggaaagttcccaactcttgtaactcatcaagaatctcttgagagtaaagtcaatgaaaccaaggctatggtgaagttccaactgaagaaagtactatgcatgggagttgctgtggggaaccttggaatggatgagaagcagatatttcaaaatgtccaactcagtgtcaacttccttgtatctttgttgaaaaagaactggcaaaatgttcgatgcttgtatctgaagagcacaatggggaagccattccgcatcttctaaggacttcgcttacttcgttatatgggcagagttgaagcaaccttgagcaagttttttgttctatttgtggaaattttgtttaatgttctctttgaccttatgacgcggataacagttttgaagttcttttatggatacgattgtgatctgacttttaaatcacatttcatatgttgatgttttatactctggatccccagtcttgggcatgtagtaaattatctttaatttgcagcaatgctttgtatacccagaaacgtgcaggagtgagcagatgatctatgtccttttctgccagaaataatacacgttcacatctaatatggatgataatagcatctgatgacctagcaatagtaaatttgatgtgcaactgatatttatgcatgtagttatagtcagccaatagtgggagaatggcgttcgtatgctttatgactccagctagacttccccacttcgaaagatattgatatggttttaaggcttagctaattgtcagttgcaact

SEQ ID NO: 1289 - DNA, 813 bp, Cucurbita pepo
ggactgaagtgtagagcatctttgcaaaggcgaagattcgaatatgagtaagcttcagagtgaggcattgagagaagctatctcatctatcttcactgatagcaatgagaaaaagagaaattttactgagaccattgagcttcagatcgggctgaagaactatgaccctcaaaaggacaagcgtttcagtggttctgtgaagttgccgcacattccccgtcccaagatgaagctttgcatgcttggagatgccttgcacgttgaggaggccgaaaagattggtctagactacatggatgtggaaggcttgaagaagctaaacaagaacaagaaattggtgaagaagctcgccaagaaataccatgcctttttggcatctgaggctgtaattaagcagataccacgtcttctcggccctggtctcaacaaagcaggaaagttcccaacattggtgacacaccaagaatcgctggaatcgaaagttaacgagaccaaggcaatggtcaaatttcaacttaagaaggttctgtgcatgggggttgccgttgggaatgttgccatggaggagaagcaagtcttccaaaacgtgcaaatgagcgttaatttcctggtttcgttgttgaaaaagaactggcagaacgttaggtgcctgtacctgaagagcacaatggggaagtcataccgggttttctaagctctgttaggaaacttgtcaatcttgtgttcgttccttttatcgttgaagttattttctcgaagagcagttttgtgaattgagcgtttttggatatgattcttgaattaagaaacaaa

SEQ ID NO: 1290 - DNA, 961 bp, Cucurbita pepo
tttcgtttcttcttaccagccagtttgtagctgctgcttagggaagacaaggctccgaaaatgagcaagcttcagagcgaagcgttgagagaagccatttcctctatcttcggtgatagcagtgaaaagaaacgcaactttactgagaccattgaacttcaaattggactcaagaactatgatccacagaaggacaagcgtttcagtggatcagtgaagttgccccatatccctcgccctaagatgaagatttgcatgcttggagatgctttgcacgttgaagaggcagagaagattggtttagattatatggacgtggaaggtctgaagaagctaaacaagaacaagaaattggtgaagaaacttgccaaaaaatatcacgcctttttagcttctgaagctgttatcaagcaaattccccgtcttctgggccctgggctcaacaaggcaggaaagttccctacccttgttactcaccaagagtcccttgagtctaaagtaaatgagacgaaggcaatggttaagtttcagttgaagaaggttctttgcatgggtgtggccgtgggcaatgttgccatggaggagaagcaagtttttcagaacgttcaaatgagtgtcaatttcctcgtttccttgttgaaaaagaactggcaaaacgtgagatgcttgtacctgaagagtactatggggaaggcatatcgagtcttctgaggaattttcaaaacttagaacagtactgtttgctcttaaattgaagaaccaggttgagatgaaaattctatgtttatgattgatgaaaatttcctgtttgttcttttttgttattaaaccattagctgcacaatcgttaacacttatgatgggtgtaatgctttttatttttccatcttgtttcacgatacatgttttgtagatgtattttttaaaaaagtatgattcatatctcataattcaaacaaac

SEQ ID NO: 1291 - DNA, 1002 bp, Euonymus alatus
gggttttgggttgttagatactatcaacacacgttgatatatagggtttatataattcgtcgggtacgcatccgctagctagggtttctttcaccttctgtagaactatcggcgaacgggcttgttggaagggcaaacatgagtaagcttcagagtgatgccctgagagaagctatctcaaccattgtcaaagattgcacagagaagaagcgaaactttgtgcagactattgaactccagatcgggttgaagaattatgatccccaaaaagataagcgtttcagtggttctgtgaagctgccacatattcctcgtccgaaaatgaaagtatgcatgcttggagatgctcagcatgtagaacaggcagagaaaattggtttggattatatggacgtggaagcattgaagaagctaaacaagaacaaaaaacttgttaagaagcttgccaagaagtaccatgcctttttggcttcagaatctgtcatcaaacagatccctcgtcttttgggtcctggtcttaacaaggcaggaaagttccctacacttgttagtcatcaggagtcccttgagtctaaagtcaacgagaccaaggcaacagtgaagttccagttgaagaaggttctctgcatgggagttgcagtgggaaatgtctctatggaggagaagcagatatttcagaatgttcaaatgagtgtcaacttccttgtttccttgttgaagaagaactggcagaatgtgaagtgcttgtacctgaagagcaccatgggcagtcccaaccgtatcttctgagttaaatttttatctgtggaagttgtgcaaggagaactattgtgacaaaaaaaagtattttatcagaatgctcatgttttccttttgtttggttacttactttgtttccttggtgagtagtattaaaatgtgaagacttgcactagattttgttggagaaatttaatcttttgcattaaaatttgaacctcaattggaactttgttattttcg

SEQ ID NO: 1292 - DNA, 929 bp, Fagopyrum esculentum
tcgccgtttggcaactgatctctcgagtttttgagattgactggtgcttatttcacacaccggatcattcaccatgagtaaacttcagagtgaagctttgagggaggccatctctggtatcacgaatgattcaaaagagaaggcaaggaaatttacagagaccattgagcttcaaattggtttgaagaattatgatccacaaaaggacaagcgtttcagcggttccgtcaaactcccccacatccctcgtcccaagatgaaggtgtgcatgcttggagatgctcagcatgttgaagagtctgaaaaaatgggactggattacatggatgttgaagctcttaagaagctgaacaagaacaagaaactggtgaaaaagcttgccaagaaataccatgcatttttggcttctgaatcagtcatcaagcagattccgcgtttgcttggtcccggacttaacaaagcaggaaagtttcctactcttgtttcccaccaagaatcattggaatccaaggttaatgaaatcaaggccacagtgaagttccagctcaagaaggtgctttgcatgggtgttgctgtcggaaactgcggaatggaagagaaacagatcttccagaacgttcaaatgagcatcaacttccttgtttctttgttgaagaagaactggcaaaatgttcgctgcctatacctcaagagtacgatgggaaagccataccgtatcttttaacctatggttattagagttttgagtttcttagtgaaagaccacaacatggaatcaaaggatcttgtttggttggtcttctttttgtttaattgtttcatcagtactatctcaagttttggtgatcaattattatgctgcagacttcatacacaattttggtattcctatacgagtctgaaatttcgtagtctgtcttttatatagc

SEQ ID NO: 1293 - DNA, 990 bp, Humulus lupulus
ctctcttcgccttgctcagctgcggttgcagaccagtgtttggttcttctctattagagtattcatctgggagaaactgtagtgaggaagtatgagtaagctcagtagtgatgctgtgagagagggcatcgcccagattgttatcaactcgaaagagaagaaccgtaagttcactgagaccattgagcttcaaattggattgaagaactatgacccccaaaaagacaagcgtttcagtgggtctgttaagcttcctcacattcctcgtcctaagatgaagatttgcatgttgggagatgctcaacacgttgaagaggctgagaaaataggattggactatatggatgtagaaggattgaaaaagcttaacaagaacaagaaattggtcaagaagctcgccaagaagttccatgcttttttggcttctgaagctgtcattaagcaaattcctcgtcttctgggtcctggactcaacaaggcaggtaagtttccaacattggtcacccaccaggaatctttggagtcgaaagtcaacgaaaccaaagccatggtgaagttccaacttaagaaggtcctttgtatgggagttgctgttggaaatttatccatggaggagaagcagatcttccagaatgtgcaaatgagtgtcaattttctagtgtcattattgaagaagaactggcaaaatgtgaggtgcttgtacctgaagagtaccatgggaagtgcaatccgtatcttttaatttcccatatgctctatgaaattgtggtagtagtgggaggaaagcattgcaaacatttaagcaagacatttttgttttgagattgcgtcaacctgcaattttgtttttgttggattcgcctagtttgtaatttttataactactgtgacattaagattttgtggcttttaaaggagaattatttatttcttcacgttttggctttgctttcttttgccaccgggctattgaatttggtatttaatttg

SEQ ID NO: 1294 - DNA, 850 bp, Olea europaea
cgccactgtcactcgttgccgtcttccaaaccctaaatagaagtgaaacgggaagagaaaaagatctccggccatgagtaagcttcagagtgaggcccttcgagaagctatctcagtaattactactgataccaaggagaagaatcgtaactttgttgagacaattgagctccagattgggctcaaaaactatgatccacagaaggataaacgttttagtgggtcagtgaagttgccccacattcctcgccccaagatgaagatttgcatgcttggggatgctcagcatgttgaggaggcagagaaaattggtctggaatccatggacgtagaggctttaaaaaaattgaacaaaaacaagaaactggttaagaagcttgctaaaagatatcatgctttcctagcctccgaagctgttataaagcagattccccgtctcttaggacctggtcttaacaaggcaggcaagttcccgactcttgtttctcaccaggaatctcttgaatcaaaggtcaacgaaaccaaggccacagtgaaattccaattgaagaaggtgctttgcatgggagttgctgtaggaaactgcgctatggaggagaagcagatttttcagaatgtgcaaatgagtgtcaactttctagtttcacttttgaagaaaaactggcagaatgtgaggtgcttgtacctaaaaagtacaatggggaagcctcagcgcatcttttaaggagattatgttttgttttctgttcaaccgattttagagatagttttggagctaaggcaatggatttccccctgtaataacaattttttattttttcttggggctggatggggcgttcaaaaatct

SEQ ID NO: 1295 - DNA, 959 bp, Plantago ovata
tgaagtaagaatttggcataaagatcttcttccaccatcatgagtaagcttcagagtgaggccctgagagaagccatcacggctattactgccgatgccaaggagaaaaatcgtaaattcactgagacgattgagctccagattggtttgaagaactatgatccccaaaaggacaagcgtttcagcggctctgtcaagttgccccacatcccaagacctaagatgaaaatctgtatgcttggggatgctcagcacgttgaagaggctgagaaaattggcatggagtccatggatgttgaggctctgaagaagttgaacaagaacaagaaacttgttaagaagcttgcaaagaaataccatgctttcttggcctctgaagctgtgattaagcagattccccgtctcttgggacccggtctcaacaaggcaggtaagttccccacccttgtcagtcatcaggagtcactggagtccaaggtcaatgagaccaaggccacagtcaagttccagttgaagaaggtgctctgcatgggagttgctgttggtaactgtgccatggaagataagcagatcttccagaatgtgcaaatgagcgtcaacttcctcgtttcactcttgaaaaagaattggcagaacgtgaggtgcttgtacctgaagaccacaatgggcaagccacaacgtatcttttaaggagctgtttgagattttatttggaaccgtatgaagagttgtaagggggcagaaactctggaatatttcctttatggaaatttttggtttttaagcactgttatgatactttggccagaaatgttatgggtactttattacagggtatttttggttgcatggtttgttccgccatatggtgaaattagatgctttcatttttgtccatgtttgttctggtatactgtactaccatcatagatgttatttttgtcttctgctcatgtgtt

SEQ ID NO: 1296 - DNA, 1113 bp, Papaver somniferum
gttctcaattcactctctctttcggccgatttttcttcttctccggaaaccctaaaaaggtttctcttgtttcggaggatttgaacatacaaaaaactctcaaccatgagtaagttagcggctgatgttgtgaaggaagcaattgctcagattgttgctgagtctaaagagaagaatcgtaattttactgagactattgagcttcaaattggtttgaagaattatgatccacaaaaggacaagcgtttcagtggttctgtgaggctaccacatatccctcgtcctaagatgaaggtttgcatgcttggggatgctcagcatgttgaagaggctcagagtataggtttagaccatatggatgtggagggtttgaagaggcttaacaagaacaagaaattggtcaagaagcttgctaagaaataccatgctttccttgcatctgaagccgtaattaagcaaattcctcgtcttcttggacctggtctcaacaaggcaggaaaattcccaactcttgttacccatcaagagtctctggagtcgaaggttaatgaaaccaaggccatggtcaagtttcaattaaaaaaggtactctgcatgggtgttgcagtagggaaccttggaatggaggagagacaaatcttccagaatgtgcaactgagtgttaacttcctcgtatcactattgaaaaagaattggcaaaacgtaaggtgcttgtacttgaagagcacaatgggaaaggtgaaccgtgtcttttaagtggaagaaacaagaactctgccacatttatcagcaatattatcaagttctctcttttgagataacttttctagcagttgaatttagttttggttaaatactagcagaaaatttgaattattaattttaaagatcaggatatgttttggtacagtaatttttctagtaagaattttttggacctttggtcttgggtattacttaagtgttccagtttttgtaagtcggtactgtatttctctagctctataggatgaacagatgaagtgtacaagtacaactatacatttcttagaccacattgactgcttagaagctcattcttggttagaatggagaatcgagaatttctctaac

SEQ ID NO: 1297 - DNA, 780 bp, Papaver somniferum
aaaggtttctcttaattcggaggatttgaacatacaaaaaaactctaaccatgagtaagttagcggctgatgttgtgaaggaagcaattgctcagattgttgctgagtctaaagagaagaatcgtaattttactgagactattgagcttcaaattggtttgaagaattatgatccacaaaaggacaagcgtttcagtggttctgtgaggctgccacatatccctcgtcctaagatgaaggtttgcatgcttggggatgctcagcatgtggaagaggctcagagtataggcttagaccatatggatgtggagggtttgaagaggcttaacaagaacaagaaattggtcaagaagcttgctaagaaataccatgctttccttgcatctgaagccgtaattaagcaaattcctcgtcttcttggacctggtctcaataaggcaggaaaattcccaactcttgttacccatcaggagtctctggagtcaaaggttaatgaaactaaggccatggtgaagtttcaattaaagaaggtactctgtatgggtgttgcagtagggaacctcggaatggaggagagacaaatcttccagaatgttcaactgagtgttaacttcctcgtatcattattgaaaaagaattggcaaaacgtaaggtgcttgtacctgaagagcacaatgggaaaggtgaaccgtgtcttttaaggaagtcaggaagaaacaagaactctgcacattatcagcaatagtatcaagttttcacttttgagataacctttctagc

SEQ ID NO: 1298 - DNA, 963 bp, Pteridium aquilinum
tccatagctgggtgagttctttctctcactcacagcagcgcatccgcagggaggcggcgagcaaccaagcaagcaagcatgagtaagcttcagagcgatgtgctgagggaagcgatcacacagattttggcggattccaaggagaagaacaggaagttcgtagagactgttgagcttcagattgggctcaagaactatgatcctcaaaaggacaagaggttcagcgggtcagtgaagcttgctcacatccctcggcccaagatgaaagtgtgtatgcttggagatgctcagcatgtggaggaggccgaaaagattggcttggactgcatggatgttgatgcattgaagaaaatgaacaagaacaagaagcttgtaaagaagctggcgaagaagtatcatgctttcttggcctctgaggcagtcattaagcagattcctcgtctccttggccctggtttgaacaaagccggaaagtttcctactcttgtccagcaccaagagtcacttgagggtaaggtgaatgagacaaaagcgacggttaagtttcagctcaagaaggtgctctgtatgggtgttgctgttgggaatttggaaatggaagagaagcagttgttccagaatgtccagcttagcgtgaactttctggtttctcttttgaagaagaattggcaaaatgtaagagttttgtacttgaagactaccatgggaaagccagtgcgaatcttttaagctgatgtggaagcggaacttcagactagatgttttaatggagagcccacaagctgcaagttgctctaacgtgtatgccttttgtggggctaatggctgcctcacactgtttgcacatttaaagaccatgacaagagtttctatgaattcaattttggctcgagtcttacttttctgatttgataatgtagttttggcatggttttcatgcgaagtaaattaccaaggaatttc

SEQ ID NO: 1299 - DNA, 894 bp, Secale cereale
gtgctcccaccgccggcgccatgagtaagttgcagagcgacgccctgagggaggcaatcacaaacattatcaatgactgccgtgagaagaaccgcaagttcgtcgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctggtcaagaagcttgcgaagaagtatcatgctttccttgcatctgaggctatcattaagcagattccccgacttcttggacctggtcttaacaaggcaggaaagtttccaacgttggtgtctcaccaggaatcccttgagtccaaggttaatgagaccaaggccacagtcaagttccagttgaagaaggttctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactatagtcttctaggatttccaggagattgacaacttgggaacttttgttgctttctcaattattatcaaattttcgtgcgtggccagtgacagttaaacagttgcaactattgtcttgtactgagatggtttgttctattgtctggaatttcatgacattttatcctttaaaaaaaaaaaaaactagagactgcagacgacacagggagtagggggggggg

SEQ ID NO: 1300 - DNA, 941 bp, Secale cereale
tgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggccacagtcaagttccagttgaagaaggttctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactatagtcttctaggatttccaggagattgacaacttgggaacttttgttgctttctcaattattatcaaattttcgtgcgtggccagtgacagttaaacagttgcaactattgtcttgtactgagatggtttgttctattgtctggaatttcatgacattttatccttttgcccctttgccttactgcttgatgcttgctgtcaatcagtttaacaccagattcagcattggtatttacgacagtaagctgtgtttgatagcaaagtattataaaaaccagagtatttt

SEQ ID NO: 1301 - DNA, 1014 bp, Tripterygium wilfordii
ggacaactatcggcgagcgggcttgttggaagggcaaatatgagtaagcttcagagtgatgccctgagagaggctatatcaaccattgtcaaggagtccgcagagaaaaagagaaactttgttcagactattgaactccagattgggttgaagaattatgatccccaaaaggataagcgtttcagtggttctgtgaagttgccgcatattcctcgtccaaaaatgaaagtatgcatgctgggagatgctcagcatgtagaagaggcagagaaaatggggttggattatatggacgtggaagcattgaagaagctaaacaagaataaaaaacttgtcaagaagcttgcaaagaagtaccatgcctttttggcttcagaatctgtcatcaaacagatcccccgtcttttggggcccggtctcaacaaggcaggaaagtttcctacacttgtcagtcatcaagagtcccttgagtctaaagttaacgagaccaaggcaatggtgaagttccagttgaagaaggttctctgcatgggagttgctgtgggaaatgtctcaatggaggagaagcagatatttcagaatgtgcaaatgagtgttaacttccttgtttcgttgttgaagaagaattggcagaatgtgaagtgcttgtacctgaagagcaccatgggcagtccaaaccgcatcttttgattttaaactattctgttgaagttgtgcaaggagaactagtgtgacaaaatacttaagaaagtgttttatcagaatggccatgttttcattctgtttgacatgcacaatatttttgttggaatttttttttcgcattctagttttggacctcaactggatcttttggtattattgtttttgtcattaatttctttgtgcaataggttctatgttcagattcgttgtcatgctgatgcttttgtaggattccatagtttgtgctactggcatccatcgcatttgtggcctttttcggatggcagtgttggtattgttactcaacct

SEQ ID NO: 1302 - DNA, 1079 bp, Citrullus lanatus
gcccttcttgctggatcgcctctcttcggtcttccattatatatctattctcagtttagccgtcgaaaaaccctagcctcgtttcttctcaccagtctgtagctgctccttaggaaagacgaagctccgaaaatgagcaaacttcagagcgatgctttgagagaagccatttcatctatcttcgctgatagcagtgaaaagaagcgcaactttactgagaccattgagcttcagattggactgaagaactatgatccacaaaaggacaagcgtttcagtggatcagtgaagttgccccatatccctcgccctaagatgaagatttgcatgcttggagatgcctctcacgttgaagaggcagagaaaattggtttggattatatggatgttgaaggtctgaagaagctaaacaaaaacaagaagttggtgaagaaacttgccaagaagtatcatgcctttttagcatccgaagctattattaagcaaattccccgtcttctgggccctgggctcaacaaggcagggaagttccctaccctggtcactcaccaagaatctctcgaatctaaagtaaatgagactaaggcaatggttaagttccaattgaagaaggttctttgtatgggtgtggccgtaggcaatgtggccatggaagagaaacaagttttccagaacgttcaaatgagtgtcaatttccttgtttccttgttgaaaaagaattggcaaaacgtgaggtgcttgtacctgaagagtacaatggggaaggcatatcgagtcttctgaggaattttcataacttagatagtactgtttgttcttaaattgaagaaccaagttgagatgaaattctatatttatgattgatgaaaaattttcctgcttgtttttttgtttagtaaaaaccattagctgcacaatcgttaacacttgtgatgggagtaatgtgttttttttgttcactttcttgtttcactttacatgttttatagatttatttcggttttaatttattgttctgatattgcttaatttcaactagagatattaaatcagttagcgcaagctcttccagcttgagg

SEQ ID NO: 1303 - DNA, 797 bp, Antirrhinum majus
  misc_feature (14)..(14): n is a, c, g, or t
  misc_feature (750)..(750): n is a, c, g, or t
ggggcaggttaaancctaatccagaagttgaatttgggaggacagaagatattgaagcatgagtaaacttcagagtgaggccctgagggaagcgatcagcgtgatatctggtgatgtaaaggagaagaagcgcaacttcacggagacaattgagcttcagattgggctcaagaactatgatccccagaaagataagcgtttcagtgggtccgtcaagttgccccacatccctagacccaagatgaagatctgcatgcttggtgatgcccagcacgtcgaagaggctgcaaaaattggtcttgaatccatggacgtggaggctctcaagaagttgaacaaaaacaagaaattggtaaagaagcttgcaaagaagtatcatgctttcctagcctcagaagcagttattaagcagattccccgcctcttgggtcctggtctcaacaaggcaggaaagtttcccacacttgtatctcatcaggaatcactcgagtccaaggtgaatgagaccaaggctactgtgaagttccagttgaagaaggtgctgtgcatgggagttgctgttggcaactgcggtatggaggagaagcaaattttccaaaatgtgcaaatgagtgtcaactttctcgtctcccttttgaagaagaattggcagaatgtgaggtgtttgtacttgaagagtaccatggggaagccacagcgcatcttctgagagcgtatcttattttggttttggagtcgttagaaacaganattgtaagagagtggacacaattaaatatttccctggttttgggatt

SEQ ID NO: 1304 - DNA, 1376 bp, Aquilegia formosa
aagcagtaagcgctctctctctctctctcgccttgtatctatttccaaattcacaaaaggatgaaatagatgttagatctgtttaatagaacatcagatctacttgttatttgaagctctagtaccaatttctaacttcgattgatttctcaataggttttttttttttttttttttatcagttgaagtggtttgggaacgagaaattctgaaatatgagtaagcttcagagtgatgtactacgagaaggtatctcacagattgtcaatgaatccaagcaaaaagaacgcaagtttgtaggaacaattgagctccagattgggttgaagaattatgacccacaaaaagacaagcgtttcagtggatctgtgaagctgccacatatccctcgtcctaagatgaaggtctgcatgcttggtgatgctcagcatgttgaagaagcggaaaagattggattggaatatatggatgtagaggggctcaagaagctgaacaaaaacaagaagttggtcaagaagcttgcaaagaaattccatgcttttcttgcttcagaagctgtcatcaagcaaattccccgtcttctgggccctggtctgaataaggcaggaaagttcccaactcttgtaactcatcaagaatctcttgagagtaaagtcaatgaaaccaaggctatggtgaagttccaactgaagaaagtactatgcatgggagttgctgtggggaaccttggaatggatgagaagcagatatttcaaaatgtccaactcagtgtcaacttccttgtatctttgttgaaaaagaactggcaaaatgttcgatgcttgtatctgaagagcacaatggggaagccattccgcatcttctaaggactttacttacttcattatatgggcagtgttgaagcaaccttgagcaaattttttgttctatttgtggaaattttgtttaatgttctctttgaccttatgacgtggataacagttttgaagttcttttatggatacgattgtgatctgacttttaaattacatttcatatgttgatgttttgtactctggatccccagtcttgggcatgtagtaaattatctttaatttgcagcaatgctttgtatacccagaaacgtgcaggagtgagcagatgatctatggccttttctgccagaaataatacacgttcacatctaatatggatgataatagcatctgatgacctagcaatagtaaatttgatgtgcaactgatatttatgcatatagttatagtctgccaatagtgggagaatggcgttcgtatgctttatgactccagctagacttccccacttcgaaagatattgatatgtttttaaggcttagctaattgtcagttgcaact

SEQ ID NO: 1305 - DNA, 1085 bp, Aquilegia formosa
gttttcgtttcttgcagtcgggtaagcattgaagtggtttgggaacgagaaattctgaaatatgagtaagcttcagagtgatgtactacgagaaggtatctcacagattgtcaatgaatctaagcaaaaagaacgcaagtttgtaggaacaattgagctccagattgggttgaagaattatgacccacaaaaagacaagcgtttcagtggatctgtgaagctgccacatatccctcgtcctaagatgaaggtctgcatgcttggtgatgctcagcatgttgaagaagcagaaaagattggattggaatatatggatgtagaggggctcaagaagctgaacaaaaacaagaagttggtcaagaagcttgcaaagaaattccatgcttttcttgcttcagaagctgtcatcaagcaaattccccgtcttctgggccctggtctgaataaggcaggaaagttcccaactcttgtaactcatcaagaatctcttgagagtaaagtcaatgaaaccaaggctatggtgaagttccaactgaagaaagtactatgcatgggagttgctgtggggaaccttggaatggatgagaagcagatatttcaaaatgtccaactcagtgtcaacttccttgtatctttgttgaaaaagaactggcaaaatgttcgatgcttgtatctgaagagcacaatggggaagccattccgcatcttctaaggacttcgcttacttcgttatatgggcagcgttgaagcaaccttgagcaagttttgtgttctctttgtggaaattttgtttaatgttctctttgcccttatgacgcggataacagttttgaagttcttttatggatacagttgtgatctgacttttaaatcacatttcatattgtgggagagtggtgttcatatgctttatgactccaagtagacttccaacctcgaaagatgtattgatatgtttttaagccttagctaattgtccgttgcaacttctggtcaaaaaagcttctggtctaaaacaagctatggggtatttcagcttatggttgcagttctgtatttcagttttcaacaaacttttcagcagg

SEQ ID NO: 1306 - DNA, 919 bp, Hordeum vulgare
tcccctcccccctccctgcatcgtcgcggaacagtgctcccaccgccggcgccatgagtaagttgcagagcgatgccctgagggaggctatcacaaacattaccaatgactgccgtgagaagaaccgcaagttcgttgaaaccattgagctgcagattggtctgaagaactatgacccgcaaaaggacaaacgtttcagtggctctgttaagcttcctcacatccctcgcccaaagatgagggtttgcatgcttggtgatgcccagcatgttgaagaggcagggaaaatgggccttgactgtatggatgtggaatcgctgaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggagtcccttgagtccaaggttaatgagaccaaggccactgtcaagttccagttgaaaaaggtgctttgcatgggtgttgccgttggccacctgggtatggaggagaagcagatcttccagaacgtgcagatgagcgtgaacttccttgtctctctgttgaagaagaattggcaaaacgtgcggtgcctgtacctgaagagcacaatgggaaaggtgtaccggttgttctagactctagtcttctaggatttccaggagattgacaacttgggaacttttgttgctttctcaattatcaaattttcgtgcgcgtcgagtgacaattattgtcttgtactgagatggtttgttctattgtctggaacttcatgacattttatccgttgtccctgtgccttcctactgttctgctagctgtcaatcatcagcttaacgctagattcagc

SEQ ID NO: 1307 - DNA, 857 bp, Cleome spinosa
ataccataggatcttagtcgcttccgaggaaattagggtttctgcagcttcatctttcaggatagggtgtggctgaattgatagaaacagaagatgagtaagcttcagagtgatgctttgagagaagccatctcaatcatcaaagggaaatgtgaggagaagaaacgtaactttgtggagacaattgagcttcagattggtctgaagaactatgatcctcaaaaggacaagcgtttcagtggctctgtcaagcttcctcacattcctcgccctaagatgaaggtttgcatgcttggagatgcccagcatgtggaggaggctgagaagatgggtttggactacatggatgttgaggccttgaagaaactcaacaagaacaagaagctcgtcaagaagcttgctaaaaagtatcatgctttcttggcttctgaatctgtcattaagcagattccccgtcttcttggtcctggtcttaacaaagcaggaaagttcccaactcttgtatcccaccaagagtcattggaatcaaaggtgaacgagacgaaagccacggtcaagttccagctgaagaaggttctatgcatgggagttgctgttggaaaccttgcaatggaagagaagcagatcttccagaatgttcagatgagcgtaaacttcctcgtctccctcctcaagaagaactggcaaaacgttaggtgtttgtatctaaagagcaccatgggcccaccccaacgtatcttctgagtttttcttcattggcgaagtgattataagcagttctggtttgcttttgtttacatctttggaacagtgaaggagatcttgtcttatgttttgttttttcacaaagttttgat

SEQ ID NO: 1308 - DNA, 883 bp, Cleome spinosa
aggggtttctgcagcttcatctctcaggatcgggattcgcttgattgagagatactcaagatgagtaagcttcagagtgaggcccttagagaagccatctcgaccattaaggcgaaatgcgaggaaaagaaacgtaactttgtggagacaatcgagcttcagattggcctgaagaactatgacccgcaaaaggacaagcgtttcagtggctctgtcaagcttcctcacatccccagacctaaaatgaagatctgcatgcttggagatgcccagcacgtagaagaggctgagaagatgggtctggactacatggacgtcgaggccttgaagaaactcaacaagaacaagaagctcgtcaagaagcttgcaaagaaataccatgctttcttggcctctgaatctgtcattaagcagattccccgtcttcttggacctggtctcaacaaggcaggaaagtttccaactctggtgtcccaccaagaatcgttggaatcaaaggtgaacgagaccaaagctacggtcaagttccagctgaagaaggttctctgcatgggtgttgcggttgggaacctctccatggaagagaagcagatcttccagaacgttcagatgagcgtaaacttcctcgtctccctcctcaagaagaactggcaaaatgttaggtgtttgtacctcaagagcaccatgggaccggttcaacgaatcttctgagctttcttcgtttccctccgagggcggaatctgtagggtctaagctgcttttgtttggttttttttgttgtttctgatatcgttttttgaaacagtaaaatgatgtctttgctatgtgtttctgaagttttgttgaatcttgaagcagtgccattgaacttctatgaagtcg

SEQ ID NO: 1309 - DNA, 983 bp, Solanum melongena
cccatttagaactttgctttaaccctcaaaacttcttgccaccactccgccgctaactcaatttgcagagagattcttcccccttctgctttgagcaatgagtaagcttcagagtgatgccctaagagaagccatctctgtgattaagaatgatgcaaatgaaaagaaaaggaagttcaccgaaaccattgagctccagattgggctgaaaaactatgatcctcaaaaggacaagcgtttcagtggttcagttaagttgccacacattcctcgccctaaaatgaagatttgcatgcttggagatgcccagcatgtggaagaggctgaaaagattggtttggagtacatggacgtggaaagcctaaagaagcttaacaaaaacaagaagttggttaagaagctcgcaaagaagtaccatgctttcttggcatcagaagctgttatcaagcagatcccccgtctcttggggcctggcttgaacaaggcaggcaagtttcctacacttgtttcccaccaggaatcactcgagtccaaggttaatgagaccaaggccactatcaaattccagttgaagaaggtgctttgcatgggagttgccgtaggaaatatggatatggaggagaaacaaatcttccagaacgtgcagatgagcgtcaactttctagtgtccttgctaaagaagaattggcaaaatgtaagatgcttgtacttgaagagtacgatgggaaagactcaacgcatcttctaaggatattgtattacaatcttggcagtttcaggcgtcgtttcggcttgtatggcgcgatagatactattgaattttttgtttagttgcactcctggatactctgttgaatatttgatatcaagttttatgatgattttgtttttattttcttctttccaatgctaccaccattaattttcttgaagattgtcaaatttcatcctttttgctcaaaaaaaaaaaaaaaaaacatgtc

SEQ ID NO: 1310 - DNA, 949 bp, Actinidia deliciosa
  misc_feature (756)..(756): n is a, c, g, or t
  misc_feature (774)..(774): n is a, c, g, or t
  misc_feature (822)..(822): n is a, c, g, or t
  misc_feature (842)..(842): n is a, c, g, or t
  misc_feature (866)..(866): n is a, c, g, or t
  misc_feature (870)..(870): n is a, c, g, or t
  misc_feature (906)..(906): n is a, c, g, or t
  misc_feature (909)..(909): n is a, c, g, or t
  misc_feature (911)..(914): n is a, c, g, or t
  misc_feature (917)..(917): n is a, c, g, or t
  misc_feature (920)..(920): n is a, c, g, or t
ctaatctcgtttcccttgattgtgtgaacaggtgatctatagattagctgtcgaaagcgaaaatcgttcgccatgagtaagctccaaagtgacgctgtcagggaagccatctcccagattgctggagattccaaggaaaaaaagcggaagtttgtggagaccattgagctccaaattggtttgaagaactatgatccccagaaggataagcgtttcagtggttctgtgaaactgccacacattccccgtcctaagatgaaggtttgcatgcttggtgatgctcagcatgttgaagaggcagagaagataggaatggattatatggatgtggaaggactaaagaagcttaacaagaacaagaaattggtgaagaagctagcgaaaaagtaccatgcatttctagcatctgaagctgtcatcaagcagatccctcgcctcttgggccctggcctgaacaaggcaggaaagtttccaacactagtgactcatcaagagtccctcgagtcaaaagttaatgaaacaaaagcaacagtgaagtttcaacttaagaaggttctttgcatgggtgttgctgtgggcaattgcggtatggaggataagcagatcttccagaatgttcaaatgagtgtaaactttcttgtttcattgctgaagaagaattggcaaaatgtgcggtgcttgtaccttaagagtactatgggaaggccggtccgcatcttttaagaagatatatatacttgttgggagctccgtagngtgagaccaagcgcgganaagactgcattacatttttgtttgttttctgagattagctttcttgtntggactagtgaatgctgcgncttaagaattcttatggtggttgngaantataagattcgttgtttttgttttctttacttggtnctngnnnnaantanttattcatttgttttcaatctaaaaaaaa

SEQ ID NO: 1311 - DNA, 1084 bp, Lotus japonicus
ttttttctaaggaaaaccaaacccggcctagtacttatatcggttcacagtgtgctcagcttcttcccagctccagccgccaaatctcattagggtttcgccactgctgtgagctcttcttccactgattccaaacgatgagtaagcttcagaatgatgctgtcagagaagctatctctggaatcatgactgattccaaggagaagaatcgcaaatttgtggagaccattgaactccagattggtctcaagaactatgatccccagaaagacaagcgtttcagtggctctgtcaagttgcctcatatccctcgacccaagatgaagatttgcatgcttggtgatgctcaacacgtcgaagaggcggagaagattggattggactggatggatgtcgaagcattgaagaagctgaacaaaaataagaagttggtgaagaagctagctaagaaataccatgcatttttagcttctgaggctgtcattaagcagattcctcgtcttttgggtcctggtctcaacaaggcaggcaagttccctacacttgtcactcaccaagaatcccttgaagcaaaggttaacgagaccaaggctatggtcaaatttcagctaaaaaaggtgctctgcatgggagtcgccgtgggtaatgttagcatggaggaaaaacagatctttcaaaacgtgcaactgagtgttaacttccttgtctctttgttgaaaaagaactggcaaaatgttaggtgcttgtatctgaagagtaccatggggaaatcgtaccgcgtcttttaagggatttattatgctactgtttttggataaaaattttggttttatatttgaatattgggtaatgttaagtttgctacattcagtgctgcttgtgtacgctttctaattgttataattcaaatctgtagtacccgctgcttctagtcgaaaatgccactattccagtgtcgcatgttctggtttttaactgaatactgtttcaatagggttctggtggatgctgttcacttgttcgatggcgattattgtcactttaaaattgtgtacatcatataactctagttttcttgaagact

SEQ ID NO: 1312 - DNA, 799 bp, Marchantia polymorpha
agaactctcacctgccaaccgaacaggagcatcgagctcgaacgcgatgagtaagctgcagagcgatgtcctcagggaggccatcacccaggtggtgaccgaggctaaggagaagaaccgcaagttcacagaaactgtggaattgcagatcggtctcaagaactacgacccgcaaaaagacaagcgtttcagcggatctgttaagttaccccatgttcccagaccgaagatgaaggtgtgcatgctcggagacgcccagcacgtcgaggaagccgagaagatgggtctcgactacatggacatcgaatctttgaagaagatgaacaagaacaagaagctcgtgaagaagctggctaagaagtaccacgcctttcttgcttcagaggctgtcattaagcagatcccccgtcttttgggtccaggtttgaacaaggctggaaagtttcctgcccttgtttcccatcaagagtctctagaagctaaggtgaacgagaccaaggccatggttaagttccaattgaagaaggtgctctgtatgggagttgctgtcggcaattgcgaaatggaggagaagcagatcttccagaacactcaattgagtgttaacttccttgtctctttgctgaagaagaactggcaaaacgtaagagtcttgtacctcaagacatccatgggaaagccagtccgaatctactagtgctgctgaataattttttggttctcaagccaattatcagggtgaccgcccttgggtttttaccctaaatgctcaaattaatgaaattttaccatttcatag

SEQ ID NO: 1313 - DNA, 832 bp, Marchantia polymorpha
ccttctcagacagtcttgaagacactgtaatccgccggaccgaacaggagcatccagctcgaacgcgatgagtaagctgcagagcgatgtcctcagggaggccatcacccaggtggtgaccgaggctaaggagaagaaccgcaagttcacagaaactgtggaattgcagatcggtctcaagaactacgacccgcaaaaagacaagcgcttcagcgggtctgttaagttgccccatgttcccagaccgaagatgaaggtgtgcatgctcggagacgcccagcacgtcgaggaagcagagaagatgggtctcgactacatggacatcgaatctttgaagaagatgaacaagaacaagaagctcgtgaagaagctggcgaagaagtaccacgcctttctcgcttcagaggctgtcattaagcaaatcccccgtctcttgggtcctggtttgaataaggctggaaagtttcctgcccttgtgtcccaccaggagtctctggaagctaaggtgaatgagaccaaggccatggttaagttccaattgaagaaggtgctctgtatgggagttgctgtcggtaattgcgaaatggaggagaagcagatcttccagaacactcaattgagtgttaacttccttgtctctttgctgaagaagaactggcaaaacgtaagagtcctgtacctcaagacatccatgggaaagccagtccgaatctactagtgctgcatcgtaataatgtgcctaaattatgtaacagggtgatcgcccttgggtttttaccctaaatgttcacatttatgaaacctcgaaggccatttaacggtaaaaaaaaaa

SEQ ID NO: 1314 - DNA, 1216 bp, Capsicum annuum
gcacgaggaaaaaacatcctacatctcatatcagaacttcttttaaccctcaaatttccagccaccactccgccgctcgctcagtctctctcatctcccttccctttccatttgcaagagaaaattttcctccgtttcgactttcagccatgagtaagcttcagagtgaagccctaagagaagccatctccgtgattaagaatgatgcaaatgagaagaaaaggaagttcactgaaaccattgagcttcagattgggctgaaaaactatgatcctcaaaaggacaagcgtttcagtggttcagttaagttgccacacattcctcgccctaagatgaagatttgcatgcttggagatgctcagcatgtgggagaggcagaaaagattggcttggagtacatggacgtggaaggcctgaagaagcttaacaagaacaagaagttggttaagaagcttgcaaagaaataccatgctttccttgcatcagaagctgtaatcaagcagatcccccgtctcttggggcctggtttgaacaaggcaggtaagtttcctacccttgtttcccaccaggaatcacttgagtctaaagttaacgagaccaaggccactattaaattccagttgaagaaggtgctttgcatgggagttgccgtaggtaatatggatatggaggagaaacaaatcttccagaacgtgcagatgagtgtcaactttctagtgtccctgctaaagaagaattggcaaaatgtcagatgcttgtacttgaagagtaccatgggaaagactcaacgcatattctaaggatattgtagtacaatcttggcagtttcaggctttttgccttgtatccgcttacagatgctatttttgtttagttgtgctcctgggtactttgttgaactctatattagttttatgacgattttgcttttgttttctcctttccaatgttgccgccatgggagaactggtattatagttttatatgtacttgtttttagttttatgtcttttttaccgaaaatcttcattatcacacataggatcatcaagagatattttctcccacgactcctgtttattttctttaagattgtgaaatttcatttctaaaggaagagtcaatttttgtgtagccttttttgcttttcaactttgtagaatttggcatctctaaattagtttatttctgaagcatatagtaaaaattgttgtgg

SEQ ID NO: 1315 - DNA, 963 bp, Cajanus cajan
agggttttcgcttcagctctccgagatcttcagtcgctgatttgaaaagatgagtaagcttcagagtgatgctttgcgagaggccatctcaggaatcatggccgattccaaggagaagaatcgcaaatttgtggagaccattgagctccagattggattgaagaactacgatccacaaaaggacaagcgtttcagcggctctgtcaagttgccccacatccctcgccccaagatgaaaatttgcatgcttggtgatgctcaacatgttgaagaggcggaaaagattggattggactggatggatgtcgaagccctgaagaagctgaataaaaataagaagttggtgaagaagctagctaaaaaataccatgcctttttagcttctgaagcagtcattaagcagattccacgtcttttgggtcctggtctcaacaaggcaggaaagttccctacacttgttactcaccaggaaactcttgagtcaaaggttaatgagtccaaggctatggtcaaatttcaacttaagaaggtgctctgcatgggagtagctgtgggcaatgttagcatggaggaaaagcaaatcttccaaaatgtgcaattgagtgttaacttcttggtatccttgttgaaaaagaactggcagaatgttaggtgcttgtatctgaagagtaccatgggaaaatcttaccgtgtcttttgagggatttcttttttcatttcggtgaatttgtgatcgcgcttgatacattatcttaatagctagatacaaattttcatcttgttacagttttgttggatgatcttttatggttagtgtttcgtgttcatgttcaaagttcaaacattcgattatgatatgcattatttttggtgctgctttcctaattgctataactcaatcccatttcagcttttataaattcctttatttatttggacctaacaaaaaaaagtaaaactcta

SEQ ID NO: 1316 - DNA, 945 bp, Cajanus cajan
tttgtttttcacagctctccgagatcttcagtcgctgatttgaaaagatgagtaagcttcagagtgatgctttgcgagaggccatctcaggaatcatggccgattccaaggagaagaatcgcaaatttgtggagaccattgagctccagattggattgaagaactacgatccacaaaaggacaagcgtttcagcggctctgtcaagttgccccacatccctcgccccaagatgaaaatttgcatgcttggtgatgctcaacatgttgaagaggcggaaaagattggattggactggatggatgtcgaagccctgaagaagctgaataaaaataagaagttggtgaagaagctagctaaaaaataccatgcctttttagcttctgaagcagtcattaagcagattccacgtcttttgggtcctggtctcaacaaggcaggaaagttccctacacttgttactcaccaggaaactcttgagtcaaaggttaatgagtccaaggctatggtcaaatttcaacttaagaaggtgctctgcatgggagtagctgtgggcaatgttagcatggaggaaaagcaaatcttccaaaatgtgcaattgagtgttaacttcttggtatccttgttgaaaaagaactggcagaatgttaggtgcttgtatctgaagagtaccatgggaaaatcttaccgtgtcttttgagggatttcttttttcatttcggtgaatttgtgatcgcgcttgatacattatcttaatagctagatacaaattttcatcttgttacagttttgttggatgatcttttatggttagtgtttcgtgttcatgttcaaagttcaaacattcgattatgatatgcattatttttggtgctgctttcctaattgctataactcaatcccatttcagcttttataaattcctttattttattttggcctcaaaa

SEQ ID NO: 1317 - DNA, 864 bp, Pseudoroegneria spicata
ctcccccctgcctcgtcgcggaacagtgctcacaccgccggcgccatgagtaagttgcagagcgacgccctgagggaggcaatcacaaacattaccaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctagtcaagaagcttgcaaagaagtatcatgctttccttgcatctgaggctatcattaagcagattccccgacttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgaggacttttgttgttttctcaactatcaaattttcgtgcgtggcaagcgacaattaaaccgttggattattgtcttgtactgagatggtttgttctattgtctggaatttgatgacattttatccaaga

SEQ ID NO: 1318 - DNA, 847 bp, Salvia sclarea
ctcacaacccctgctctagggtttttcttcagtgattcgggaagctaattgatcgtgaacgatgagtaagcttcagagtgaggcgctgagggaagccatcactgtgattgttgcagaggctaatgagaagaagcgcaacttcactcagactgttgagctccagattggactcaagaactacgacccccaaaaggacaagcgtttcagtggctctgtgaggttgccccatatcccgagacccaaaatgaaactctgcatgcttggagacgcccagcatgttgaggaggcggagaagatcggcctcgagtccatggatgtggaagcactgaagaagttgaacaagaacaagaaactggtgaagaagctagcaaagaggtaccatgctttcttggcctcagaagcagttattaagcagattccacgtctcttgggacctggtcttaacaaggcaggtaagttccctactcttgtgacacaccaggagtcgcttgaagccaaggtgaacgagacaaaggccactgttaagttccagttgaagaaggtgctttgcatgggtgtagctgttggaaacctcgacatggaggagaagcagatcttccaaaatgtgcaaatgagtgtcaacttcctcgtttcccttttgaaaaagaattggcaaaatgtgaggtgcttgtacttgaagagtacaatgggaagagtgcagcgtattttctgataagtttataaacttttgttattgaattctcagagggagcagaaaatattctaaattctaaactttccagaaatgggaacgttttggttttctctttttgtgttgttgaactctttttagctgttgcggatactc

SEQ ID NO: 1319 - DNA, 1056 bp, Glycine max
cctaccctgaacatctgccatttgggttttatccctcccttgttctgcactgcggccgataacaattttctgttttgtgtgatttttttgttctttgtttacagctctgcgagatcttgagtcgccgatttgaaaagatgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgttaggtgcttgtatctgaagagtacaatggggaaatgttaccgtgtcttttgaggaatttctttttttatttcggtgaaattgtgatcgcgcatgatatgttgattaatcttaatagctagatacaaattatcatcttgttacagttttgtgggatggatttttatgttaaagtgtttcgttttcatgttcaaaaacatttgataatgatatgcgctgtttttggtgctgcttttgtttttactcaattgcgtgttctattttggcctcaattttagctgaacatcctgtgaaccatgatataaattatgtagaaaaataa

SEQ ID NO: 1320 - DNA, 1089 bp, Glycine max
agggttttggctcgaggtattttttctaccccgaacatctgctgttgggttttatccctccattgctttgcactgccgccgataacaattttctgtatcgtgtattttttttttctttgttcacagctctgcgagatcttcattcgccgattttaaaagatgagtaagcttcagagtgatgctttgcgtgaagccatttcaggaatcatggccgattccaaggagaagaatcgcaaatttgtggagaccatcgaactccaaatcgggttgaaaaactacgatccacagaaggacaagcgtttcagtggctctgtcaagctgccccacatccctcgccccaagatgaaaatttgcatgcttggtgatgctcagcatgttgaagaggcggagaagataggactggactggatggatgtggaagccctgaagaagctaaacaaaaataagaagttggtgaagaaactagctaaaaagtaccatgcctttttagcttctgaagcagtcattaagcagattcctcgtcttttgggtcctggtctcaacaaggcaggaaagttccctacacttgttactcaccaggaaactcttgagtcaaaggttaacgagtccaaggccatggttaaatttcaacttaagaaggtgctctgcatgggagtagctgtggggaatgttagtatggaggaaaagcaaatcttccaaaatgttcaactgagtgttaatttccttgtctctttgttgaaaaagaactggcaaaatgtcaggtgcttgtatctgaagagtacaatggggaaatcttaccgtgtcttttgaggaattttttttttaatccggtgaatttgtgatcgcgcttgatacattgattatcttaatagctagatacaaactatcatcttgttacagttttgttggctggatttttatgttagtgtttcgtgttcgtgttcatgttcaaacatttgataatgatatgcgctgtttttggtgctgcttttgtttttactcatgaatgcgtgttctattttggcctcaatttaaagatcctgtacgtagcgtttgatttaatatatgagaaattatgatcaataagat

SEQ ID NO: 1321 - DNA, 859 bp, Nicotiana tabacum
  misc_feature (741)..(741): n is a, c, g, or t
  misc_feature (752)..(752): n is a, c, g, or t
  misc_feature (779)..(779): n is a, c, g, or t
  misc_feature (793)..(793): n is a, c, g, or t
  misc_feature (797)..(797): n is a, c, g, or t
ctgctttctgtttgcagcaattcttgaagtgctcctttgagccatgagtaagcttcagagtgatgccctaagagaagccatcactgtgattaagagtgcttcaaatgagaagaaaaggaagttcactgaaaccattgagcttcagattgggctgaaaaactatgatccccaaaaggacaagcgtttcagtggttcagtcaagttgcctcacattcctcgccctaagatgaagatttgcatgcttggagatgctcagcatgttgaagaggcagaaaagatcgggttggagtacatggatgtggaaggcctgaagaagcttaacaaaaacaagaagttggttaagaagctcgcaaagaaataccatgcttttttggcatcagaagctgttataaagcaaattccccgtctcttggggcctggcttgaacaaagccggtaaatttcctagccttgttacccaccaggaatcgctcgagtctaaggttaacgagaccaaggccactataaaattccaattgaagaaggtgctttgcatgggagttgctgtcggtaatatggatatggaggagaaacaaatcttccagaatgtgcagatgagtgtcaactttctagtgtctttgctaaaaaagaactggcaaaatgtgagatgcctgtacttgaagagtaccatgggaaagactcaacgcgtcttctaaggaaattgtattacaatcttggcagttctggcgttttgctttgtatncgctatagatnctattgatcctggatagtatttttggntagttgtgatcctngatnttgtcttgaacttgatatcagttttgtgatgattttattttctccttttaagatggtaccac

SEQ ID NO: 1322 - DNA, 903 bp, Nicotiana tabacum
atcgagggttttctcttacagtgaagcttgaaggagaagatttttgagccatgagtaagcttcagagtgatgcccttagagaagccatctctgtgattaagaatgattgtgcggagaagaaaagaaaattcactgaaactattgagctccagatcgggctgaagaactatgacccccaaaaggacaaacgtttcagtgggtccgttaagttgccccacattcctcgccctaaaatgaagatttgtatgcttggagatgctcagcatgttgaggaggcagaaaagataggtttggagtacatggatgtggaaagcttgaaaaagcttaacaaaaataagaaattggttaagaagcttgcaaagaaataccatgctttcttggcttcagagtctgtcatcaagcagattcctcgtttgttggggcccggcctgaacaaggcgggtaagtttccgagtcttgtttcacaccaggagtcacttgaatccaaggttaatgagaccaaagctactatcaagtttcaattgaaaaaggtgctttgcatgggtgttgctgttggaaacttggatatggaggagaaacagatcttccagaatgtgcaaatgagtgtcaattttctagtgtcgttgctgaaaaagaattggcaaaatgtaaggtgcctgtacttgaagagcaccatgggaaagccacagcgcgtcttttaaggagatttttgtttcgctgttggaagttttcagcattttgggtttgtgagcgatagatactcttgaaatttttgggtagtagttctggttctatttgaatactataacattgttcgggattgttttgcttcaactttgtcttctttaaagatgttagcagtgattgcaatagcattcaaggtgccaatttcttctcaaaaaa

SEQ ID NO: 1323 - DNA, 896 bp, Nicotiana tabacum
gggggtcactcgaacggcgcttacaaaccctaatttgggttttctcctacagtgaatttagaaggcaaaagagaagtgcttgagctatgagtaagcttcagagtgaagccctaagagaagcaatctctgtaattaagaatgattgcaatgagaagaagaggaagttcacagagacaattgagctccagattgggcttaagaactatgatccccaaaaggacaagcgtttcagtggatctgtgaaactgcctcacattcctcgtcctaagatgaagatttgtatgctcggagatgctcagcacgttgaggaggctgaaaagatcgggttggagtacatggatgtggaaagcctcaagaagcttaacaagaacaagaagctagttaagaagcttgccaagaagtaccatgctttcttggcttcagaatctgtcatcaagcagattcctcgtctcttgggtcccggtctgaacaaggctggtaaatttcctagccttgtttcccaccaggagtcactcgagtctaaggttaacgaaaccaaggccacaatcaagttccaattgaagaaagtgctttgcatgggtgttgctgttggcaatcttgacatggaggagaaacaaatcttccagaatgtgcaaatgagtgtgaatttccttgtgtcattgctaaagaaaaattggcaaaacgtgaggtgtttgtacttgaagagcacaatggggaagacacagcgtgtcttttaagataattgtctcgttgttgcaactttttgggcattttgcttgtaagagatactaatgaaaattttggatagttgtcatcctggataatggttttattgtaatatcattacagggatcgttttgccagacatttttattttaaaagatgttagcactgtt

SEQ ID NO: 1324 - DNA, 974 bp, Triticum aestivum
gccgccccctcctcccaccctgcctcgtcgcggaacagtgctcccaccgccggcgccatgagtaagttgcagagcgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgtcaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcccttgagtccaaggttaatgagaccaaggccacagtcaagttccagttgaaaaaggtgctttgcatgggtgttgccgttggccacctgggtatggaggagaagcagatcttccagaacgtgcagatgagcgtcaacttcctcgtctctctgttgaagaagaattggcaaaacgtgagatgcttgtacctgaagagcacgatgggaaaggtgtaccggttgttctaggctctagtcttctaggatttccaggagattgacaacttgggaacttttgttgctttctcaattatcaaattttcgtgcgcgacgagtgacaattattgtcttgtactgagatggtttgttctattgtctggaacttgatgacattttatccgttgtccctgtgccttcctactgctctgcctgctgtcagccatcagcttaacgctaggttcagcattggtccattggtatttacgaccgtcagaatcttattttaccgtgtgtcc

SEQ ID NO: 1325 - DNA, 802 bp, Aquilegia formosa
gggaagcaaaccggtgaaatctctgttgaaagatgagtaagcttcagagtgatgtgctgagagagggaatcacccaaattactaatggagccaaagagaagaagcgtaactttactgagacagttgagctccagattggtcttaagaactatgacccccaaaaagataagcgattcagtggttcagtcaagttgccacacatcccccgtcctaagatgaagatctgcatgcttggagatgctcagcatgtcgaagaggcagagaaaatcggtttagagtatatggatgtggagggtttaaagaagctgaacaaaaacaagaaactggtgaaaaagcttgcaaagaaataccatgcttttctagcatcagaagctgtcattaagcagattcccagacttcttggtcctggtcttaacaaggcaggaaaattcccaactcttgttacccatcaggaatcattggaatcaaaagttaacgaatcgaaggctatggtgaaatttcaactgaaaaaggttctttgcatgggagttgctgtgggaaatctcggaatggatgagaagcagatcttccagaatgttcaactcagtgtcaactttcttgtctcactgttgaaaaagaactggcagaatgtgagatgtttgtacctgaagagttcaatggggaagccagtccgtatcttctaaacatttgaatttttttaggttgagtacattgtgtactgagttagtgagcaggattataaacgtattttggaaattctcagatttgtcatggttgtactattgagatctttagttgaatg

SEQ ID NO: 1326 - DNA, 750 bp, Cicer arietinum
ttgtttcgcagctctgagatctagcttgttagtcaccgattctagatcaaaatgagtaagcttcagagtgaagctctgagagaagctatctctggaatcactgctgattccaaggagaagaaccgtaaatttgttgagactattgaacttcaaattgggctgaagaactacgacccacaaaaggacaagcgtttcagtggctctgtcaagttgccccacatccctcgccctaagatgaaaatttgcatgcttggagatgcccaacatgttgaagaggcagagaagataggattggattggatggatgttgaagccttgaaaaagcttaacaaaaataagaaattggtgaagaaattagccaagaagtaccatgctttcttagcttctgaggcagtcattaagcagattcctcggcttttgggtcctggtctcaacaaagcagggaagttcccagcacttgtctctcaccaagaatctcttgaatcaaaggtgaacgagacaaaagctatggtgaaatttcagcttaagaaggtgctctgcatgggagttgccgtgggcaacattagcatggatgaaaagcaaatttttcagaatgttcaacttagtgttaacttccttgtctcattgttgaaaaagaactggcagaatgtcaggtgcttgtatctgaagagttccatgggaaaatcttaccgagtattttaaggggtagttctattttgtttttgtttttctaatattctagtgagtttg

SEQ ID NO: 1327 - DNA, 968 bp, Cirsium arvense
ggatagtcgttcgattacttttctagtagcggcttcaatcgaactgctccaggcgatctttaaaattctaggtttatattgcaccataaatcaccaattcactttgtaatctaacatttacataggtggaggagctgtgcaaaggggaaatctttcaccatgagtaagttaggaagtgaagcggtcagagaagccatcacccagattacgactgaggccaaggagaaaaaccgtaagtttacagagactattgagcttcagattgggttgaagaactacgatccccaaaaagacaaacgtttcagtggcacggttaagttgccacacattcctcgtcctaagttgaaggtctgcatgcttggtgatgctcaacatgttgaagaggcacagaagataggattggaatacatggatgttgaagggttgaagaagcttaacaaaaacaaaaagttggtcaagaagcttgctaagaagcaccaagcttttctggcatctgaatcagtcattaagcagattccccgtctcttgggacctggtctcaacaaagcaggaaaatttccgacacttgttacacatcaggagtcgttggagtcgaaagttaatgaaataaaggcaacagtgaagtttcagcttaagaaggttctctgtatgggggttgctgtaggaaattgcagcatggaagagaagcagatcttccagaatgttcaaatgagcgtaaactttctcgtttctttattgaagaaaaactggcaaaacgttaggtgcttgtacctgaagactaccatggggaagccggtgcgtgtcttttagtaagctgagatttgatgatttttttccaacacatacatttgataacatctgctacaaatggttcgatattttggctttaaatcgagtcattattatcattcttatcttaaatctgtatttttggtatccttagatttgcaatatgatagaagagaatc

SEQ ID NO: 1328 - DNA, 1022 bp, Cucurbita pepo
ttcggtcttccattatatatctattatcagctgccgtcgaaaaccctagcttagcttcttctcaccagtgagtctgtagctgctccttgaaaagaaagggttccgaaaatgagcaaacttcagagtgaagcgttgagagaagccatttcatctatctttggtgatagcactgaaaagaagcgcaactttactgagactattgaacttcagattggactgaagaactatgatcctcagaaggacaagcgtttcagtggatcagtgaagttgcctcatatccctcgccctaagatgaagctttgcatgcttggagatgctttgcacgttgaagaggcagagaagattggtatggattatatggatgtggaaggtttgaagaagctaaacaagaacaagaagttggtgaagaaacttgccaagaaatatcatgcctttttggcatctgaagctgttatcaagcaaattccccgtcttctgggccctgggctcaacaaggcaggtaagttccctaccctggttactcaccaagaatccctcgagtcgaaagtcaacgagacaaaggcaatggttaaatttcaactaaaaaaggttctttgcatgggtgttgccgtcggtaacgtcgccatggaggagaagcaagttttccagaacgttcaaatgagtgtcaatttccttgtttccttgttgaaaaagaattggcaaaacgtgaggtgcttgtacctgaagagtactatgggaaaggcatatcgagtcttctgagaacttttcaaattttagatagtactgtttgctctttcgtttaagacccaaccagttgaggtgaaattctatattatgattggttaaagttttcctgtttattttctttattatttttgtttagcacaaaacaaaaccactagctgcacaaccgttaacactcatgatggaagtaatgttttcttttttcctatttgttcttcttattgttttgttcgtattttttttcctaatttattatacgttcttattttgtcttaaat

SEQ ID NO: 1329 - DNA, 958 bp, Euonymus alatus
tctcactggtagcagccgcgagttcaagctctagctagggtttctttcccctttaggacaactatcggcaagcgggcttttttgaagggcaaacatgagtaagcttcagagtgatgccctgagagaagctatcacaaccattgtaaaagagtccacagagaaaaagaaaaactttgttcagactattgaacttcagattgggttgaagaattatgatccccaaaaagataagcgtttcagcggttctgtaaagttgcctcatattcctcgtccaaaaatgaaagtatgcatgcttggagatgctcagcacgtagaacaggcagagaaaataggtttggattatatggacgtggaagcattgaagaagctaaacaagaataaaaaacttgtcaagaagctcgccaagaagtaccatgcttttttggcttcagaatctgtcatcaaacagatccctcgtcttttggggcctggcctcaacaaggcaggtaagtttcctacacttgttagtcatcaagagtcccttgagtcgaaagttaacgagactaaggcaacggtgaagttccagttgaagaaggttctctgcatgggagttgctgtgggaaatgtctctatggaggagaaacagatatttcagaatgtgcaaatgagtgttaacttccttgtttccttgttgaagaagaactggcagaatgtgaagtgcctttacctgaagagcaccatgggcagtccaaaccgcatcttctaagttatttttcccccccgttgaatttgtgtaaagagagaactagtgcgacaaatgcctaaaaagtgtttggcagaatggtcatgccttctgtttggctggtcactttttttccccttgcgactagtgttaaaatattgacacatgcacaagattttgtgggagaagttgatttttttgcattctaattttggagctcaactggagcttttagag

SEQ ID NO: 1330 - DNA, 771 bp, Euonymus alatus
ggcagctgcgagttctagctctagctagggtttctctcccctttggacaactatcggcgaacgggcttgttggaagggcaaacatgagtaagcttcagagtgatgccctgagagaagctattacaaccattgtgaaagagtccacagagaaaaagaaaaactttgttcagactattgaacttcagattgggttgaagaattatgatccccaaaaagataagcgtttcagcggttctgtaaagttgcctcatattcctcgtccaaaaatgaaagtatgcatgcttggagatgctcagcacgtagaacaggcagagaaaataggtttggattatatggacgtggaagcattgaagaagctaaacaagaataaaaaacttgtcaagaagctcgccaagaagtaccatgcttttttggcttcagaatctgtcatcaaacagatccctcgtcttttggggcctggcctcaacaaggcaggtaagtttcctacacttgttagtcatcaagagtcccttgagtcgaaagttaacgagactaaggcaacggtgaagttccagttgaagaaggttctctgcatgggagttgctgtgggaaatgtctctatggaggagaaacagatatttcagaatgtgcaaatgagtgttaacttccttgtttccttgttgaagaagaactggcagaatgtgaagtgcctttacctgaagagcaccatgggcagtccaaaccgcatcttctaagttattttaccccacgttgaatttgtgtaaagagaga

SEQ ID NO: 1331 - DNA, 943 bp, Fraxinus spp
gactcttgccgtcttccaaaccctaatatagaagtgaaacgggaagagaaaaggatctccggccatgagtaagcttcagagtgaggcccttagagaagctatctcagtaattactactgatgtcaaggagaagaatcgtaactttgttgagacaattgagctccagattgggctgaaaaactatgatccacagaaggataaacgttttagtggctcagtgaagttgcctcacattcctcgccccaagatgaagatttgcatgcttggtgatgctcagcatgttgaggaggcagagaaaattggtatggaatccatggacgtagaggctttaaaaaagttgaacaaaaacaagaaactggttaagaagcttgctaaaagatatcatgctttcttagcctccgaagctgttatcaagcagattccccgtctcttaggacctggtcttaacaaggcaggtaagttcccgactcttgtttctcaccaggaatctcttgaatcaaaggtcaacgaaaccaaggccacagtgaaattccaattgaagaaagtgctttgcatgggagttgctgtaggaaactgcggtatggaggagaagcagatctttcagaatgtgcaaatgagtgtcaactttctagtttcacttttgaagaaaaactggcagaacgtgagatgcttgtacctaaaaagtacaatggggaagcctcagcgcatcttttaaggacattatattttatttctgttcgactggttttagagatagttttgtggagctaaagcaatggagttttcccctgtaatagcaagtttttatttatctttggtcttgatactgcgttcagacatcatattgattgttttattttgttgtttttctactgagtcgggatttatttttgcttactgtaccgacatttctatcaggaatagccagtttaccttttgcttg

SEQ ID NO: 1332 - DNA, 903 bp, Carpinus betulus
atcgcgagcctccgaagcctcactctaagagcagccattggagaagcgcctgaaacgacaaagctctacccatgagtaagcttcagagcgaaacgcttagggaggtgatctcccaggtgttgaacgccgcgaaggagaagaatcgtaagttcacggagaccgtggagcttcaaatcgggttgaagaactacgatccccagaaggacaagcgtttcagtggctccgtgaaactccctcacattcctcgccctaagatgaaggtctgcatgctcggtgacgctcagcacgtcgaagaggcggagaagataggattggagtatatggatgtggaggctctgaaaaaacttaacaagaacaagaagctggtcaagaagctggccaagaagtaccatgcctttttagcatctgaatccgtcattaagcagattcctcgtcttttgggccctggtcttaacaaggcaggtaagtttcccacactggtgactcatcaggaaaccctggagtcgaaggttattgaagtaaaagcaatggtgaagtttcaacttaagaaggttctttgtatgggcgttgctgtggggaattgcagtatggaggaaaagcagctcttccagaacgtgcaaatgagtatcaacttccttgtttcattgttgaagaaaaattggcaaaatgtgaggtgcttgcatctgaagagtaccatgggatcggcaatcaggctctattgagttcgtttctctgtttacaagatgtcaaaatgttttatgaatgttttgtaagcaagacatcgttgaggaatgctgttatggctttttggttctcctttttggattctttggcttcgaagtttagttaatgctgataatgttgttttaagttgatttttattggtggttgattaaagaaaat

SEQ ID NO: 1333 - DNA, 1055 bp, Platanus occidentalis
gaaccccctgtcggcagctttgttttaggttctcacttctgcaaaaaaagaaagcgttgcagcaatgagtaagcttcagagtgatgttctgagggaggccattggccagatcatgggtgctgccaaggaaaagaaccgtaagttcactgagaccattgaacttcagattggtctgaagaactatgacccacagaaggacaagcgtttcagtggttctgtaaaattgcctcatatccctcgtcctaaaatgaaggtgtgcatgcttggagatgcacagcatgttgaggaggctgagaggatgggattggagtctatggacgttgaagcattgaagaaaatgaacaagaacaagaagttggttaagaagcttgctaagaaataccatgctttccttgcttcagaggcaatcatcaagcaaattccaaggctccttggtcctggtctcaacaaggccggtaaatttcctactttggtttcccatcaggagtcgttggagtcaaaggtcaacgagaccaaggccatggtcaagttccagcttaagaaagttctctgcatgggtgttgctgtggggaactgtgacatggatgagaagcaagtctttcagaatgtgcagctcagtgtcaatttccttgtctccctgttgaagaagaattggcaaaatgtccgatgcttaaatctgaagactacgatgggcaagccatacagaattttctgagttaagtattttgttccttttgttcgcagtacacacttaaattcatggtggatgagaattcatagttgtgggctatctttttctgttacaaaagcattaaggttttacatcttgttgctttgttttttatctagttagactggacctttgtttaaagttgattattttgttttctaaaggagacaataccaagtaagcaaatctggatttttgagacttcattaattattggatggtaacatgtacttgtgatatttgggaattctgcttctccaccttctaatccttttacattgttgtatgtttttgtcttttgctgtatcgttaaataaaataaaat

SEQ ID NO: 1334 - DNA, 857 bp, Eutrema parvulum
taagctccagagtgaagccctgagagaggcgatatccgccattgtcactcactgcaaggagacaaagccgcgcaagttcactgagactatcgagctccagattggtcttaagaactatgacccacaaaaggacaagaggtttagcggatccgttaaattgcctcacattcccaggccaaagatgaagatttgcatgctcggagacgcccagcacgttgaagaggctgaaaagattggattagactctatggatgtcgaagctcttaagaagttgaacaagaacaagaaacttgttaagaagctcgccaagaaattccaggctttccttgcttctgaatctgtcattaagcagattccccgtcttcttggtcccggtctcaacaaggcaggaaagttcccaactcttgttagccaccaagagtctttggaatccaaagtgaatgagacaaaggcaacagtgaagttccagctcaagaaggttctttgcatgggagtcgctgttgggaatcttgacatggaagagaagcagatctttcagaatgttcaaatgagcgtcaacttcctcgtttcactcttgaagaaaaactggcaaaatgtgaggtgcttgtacttgaagagtacaatgggtccaccaactcgggttttctaagatttttatctccaagtttctcccaaggttgaggaaatttgttgattttcttttctgtcatgagccttcttcttcttcttggattaatttcagaacccttacttggtagcatccagattttcttaaaagacaattttgtttctattattgctattatcattagtggtttttctccatttaagttatcaatatcattttagttttcgtc

SEQ ID NO: 1335 - DNA, 1154 bp, Citrullus lanatus
ttctcctttgtttcaccttcatattcttaatagcattactttaatccccacttcatgtttttctggattttgcgcatttttatgtctgttgggtgcttttcttttgggttcgatttgcagttttcctttgcttactgctcatgattatatcaattgctccattgttatttgcttttttttgaagtttcttaccgtttctgtactctgtttgtgcacaggactgaagtgtatagtgtctttgcgaaggcgaagattcgaaaatgagtaagcttcagagtgatgcattgagagaagctatctcatctatcttcactgatagcaatgagaaaaagaggaagtttactgagaccattgagcttcagatcgggctgaagaactatgatcctcaaaaggacaagcgtttcagtggttctgtgaagttgccacacattccccgtcccaagatgaagatatgcatgctaggggatgcctcgcacgttgaagaggccgagaaaattggcttagactatatggatgtggaaggcttgaagaagctaaataagaacaagaaattggtgaagaagcttgccaaaaaataccatgcctttttggcatctgaagctataatcaagcagatccctcgtcttctaggccctggtctcaacaaagcaggaaagttcccaacattggtgacacaccaagaaacgcttgaatccaaagttaacgagaccaaggcaatggtcaagtttcaactgaagaaggtcctttgtatgggagttgccgttggaaatgttgccatggatgagaagcaagtcttccagaatgttcaaatgagtgtcaatttcctggtttctttgttgaaaaagaactggcagaatgtcaggtgcctgtacctgaagagcacgatgggcaagtcataccgggttttctaagctctattagcaatctagtcagtcttgtgttcgatctttttactgttgacgttattttttgaagagcagttttgtgaattgagcgtttttgaatgattattgaacaaagaaacagggatgattttttctcctttaaagtgacaattgataacgaagttttttattcccatcaaccaaacccatcatgaacgttcgtttacgtttttactgtgcctggtctgatactattataattgttggttt

SEQ ID NO: 1336 - DNA, 802 bp, Aquilegia formosa
gggaagcaaaccggtgaaatctctgttgaaagatgagtaagcttcagagtgatgtgctgagagagggaatcacccaaattactaatggagccaaagagaagaagcgtaactttactgagacagttgagctccagattggtcttaagaactatgacccccaaaaagataagcgattcagtggttcagtcaagttgccacacatcccccgtcctaagatgaagatctgcatgcttggagatgctcagcatgtcgaagaggcagagaaaatcggtttagagtatatggatgtggagggtttaaagaagctgaacaaaaacaagaaactggtgaaaaagcttgcaaagaaataccatgcttttctagcatcagaagctgtcattaagcagattcccagacttcttggtcctggtcttaacaaggcaggaaaattcccaactcttgttacccatcaggaatcattggaatcaaaagttaacgaatcgaaggctatggtgaagtttcaattgaaaaaggttctttgcatgggagttgctgtgggaaatctcggaatggatgagaagcagatcttccagaatgttcaactcagtgtcaactttctcgtctcactgttgaaaaagaactggcagaatgtgagatgtttgtacctgaagagttcaatggggaagccagtccgtatcttctaaacatttgaatttttttaagttgagtacattgtgtactgagttagtgagcaggattataaacgtattttggaaattctcagatttgtcatggttgtactattgagatctttagttgaatg

SEQ ID NO: 1337 - DNA, 1013 bp, Arabidopsis thaliana
atataagtaacagacgattgcttgtgacgccgttctttctctgtttccgaccttcccacaggaagcaaatttgtttcagggagtaccaaaatgagtaagcttcagagtgaagccgtgagagaggcaataagctccattatcactcactgtaaggagacaaagccacgcaacttcactgagactattgaactccagattggtctcaagaactatgaccctcaaaaggacaagagatttagcggttctgtgaaattgcctcacgttcctaggccaaagatgaagatttgcatgcttggtgatgcccagcacgtcgaagaggctgagaagattggattggaatctatggatgttgaagctcttaagaagttgaacaagaacaagaaacttgttaagaagcttgctaagaaattccatgctttccttgcttctgaatctgtcattaagcagattcctcgtcttcttggtcctggtctcaacaaggcaggaaaattcccaactcttgttagccaccaagagtctttggaatccaaagtgaatgagacaaaggcaacagtgaagttccagctcaagaaggttctatgtatgggagttgctgtcggtaatctttccatggaggagaagcagatctttcaaaatgttcagatgagtgttaacttcctcgtttctctcttgaagaaaaactggcaaaatgtgaggtgcttgtacttgaagagcacaatgggtccaccaaaccgagttttctaaggttattattattacaaagtttctctaaggtatcatcactctttaggaaatttgattttcttttgctgtcatgagccttcttcttgttgggttaaacttcaaattccagtatcccgacttttgtaggatcaagattttttttaaagacaattttgtttcttttgttgctattattattagtggattttttctccatttaagcactcaaattttgctatctttgttatcatcaatatcatttaagtttgtcttttgacttgtcccaatgt

SEQ ID NO: 1338 - DNA, 991 bp, Brassica juncea
ccaaaatgagtaagctccagagtgaagccgtgagagaggcgatatcctccatgatcactcactgcaaggagacaaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagacaattttatttctattttgctattatgattagtgttttttgccttaagtttttcaagatttgcgatttcgttatcattatcgttatatagtgcagtacgtcaaatgatcttatatcacaacaaaaataatgtataatttgattttttttaaggtaacatcaactcttttattatttccattaaagcccgc

SEQ ID NO: 1339 - DNA, 831 bp, Brassica oleracea
  misc_feature (170)..(170): n is a, c, g, or t
  misc_feature (341)..(341): n is a, c, g, or t
  misc_feature (362)..(362): n is a, c, g, or t
gcgggggccgtccttacagcatccgaggaagtttgccaaaaatgagtaagctccagagtgaagccgtgagagaggcgatctcctccatgatcactcactgcaaggagacaaagccacgcaagttcaccgagaccatcgagctccagattggtctcaagaactacgacccncaaaaggacaaacggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaaacttgtnaagaagctagcgaagaagttncacgctttccttgcttctgaatctgttattaagcagattcctcgtcttcttggtcctggtctcaacaaggcaggaaagttcccaactcttgtgagccaccaagagtctttggaagccaaagtgaatgagaccaaggcaactgtgaagttccagctcaagaaggttctttgcatgggtgtcgctgttggtaaccttgacatggaggagaagcagatctttcagaatgttcagatgagtgtcaacttccttgtttcgcttctgaagaaaaactggcaaaatgtgaggtgtttgtacttgaagagtacaatgggtccaccaaaccgtgtgttctaagcttattattatctcagagtttctctaaagatatcatcatcttcaaggctgagaatagatttgattttcatttctgttgtgagccttctctacttcttggattaatttcagaatccgtttttggtaggatcatttt

SEQ ID NO: 1340 - DNA, 890 bp, Brassica rapa
  misc_feature (880)..(880): n is a, c, g, or t
acagcatctgaggaagttacccaaaatgagtaagctccagagtgaagccgtgagagaggcgatatcctccatgatcactcactgcaaggagacaaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagacaattttatttctattttgctattatgattagtgttttttgccttaagtttttcaaganttgcgatttc

SEQ ID NO: 1341 - DNA, 692 bp, Brassica rapa
acagcatctgaggaagttagccaaaatgagtaagctccagagtgaagccgtgagagaggcgatatcctccatgatcactcactgcaaggagacaaagccacgcaagttcaccgagaccatcgaactccagattggtctcaagaactacgaccctcaaaaggacaaacggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaagcttgttaagaagctagctaagaagtttcatgctttccttgcttctgaatctgttattaaacagattcctcgtcttcttggtcctggtcttaacaaggcaggaaagttccctactcttgtgagccaccaagagtctttggaagccaaagtgaatgagaccaaggcgacagtgaagttccagctcaagaaggttctttgcatgggagttgctgttggtaaccttgacatggaggagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcg

SEQ ID NO: 1342 - DNA, 1067 bp, Phaseolus coccineus
agggttatcgacttcaggtatttacactctgaacgtttgccactgggtttttgtttctctttgttctgctccgctagataaccattttgtctgtgtgattcttttcttcacagcgctgtgagagatccttagtcgctgattgaaaaagatgagtaagcttcagagtgatgccttgcgagaagctatcactggaatcatggccgattccaaggagaagaatcgcaaatttgtggagactatcgaactccagattgggctgaaaaactacgatccacaaaaggacaagcgtttcagcggctctgtcaagttgccccacattcctcgccccaagatgaaaatttgcatgcttggtgatgcacaacatgtcgaagaggccgagaagataggtctggactggatggatgtggaagccttgaagaagcttaacaagaataagaagttggtgaagaagctagctaagaagtaccatgcctttttagcttctgaagcagttattaagcagattccacgtctgttgggtcctggtctaaacaaggcaggaaagttccctacacttgttactcaccaggaaactcttgagtctaaagtaaatgagtctaaggctatggtcaaatttcaactcaagaaggtgctctgcatgggagtagccgtgggcaatgtcagcatggaggagaaacaaatcttccaaaatgttcaactgagtgttaacttcctagtatccttgttgaaaaagaactggcaaaatgttaggtgcttgtatctgaagagtaccatggggaaatcttaccgcgtcttttgagcgatatctatttttattttggtgaatttgttatggcccataatacatttatcttaatagctagatgcaaattttcatcttgttacagttttgtgggtttgacttttattgttttcgtgttcatgttcaaacatttgataatgatatgggttatttttggctcttctttcttagttaattgctatgattcttccgtctgatgcaagctcataaatgcatgtattttgtatttggctcatatttagctgaactaagaatttgttttgaa

SEQ ID NO: 1343 - DNA, 970 bp, Phaseolus coccineus
gaacgtttgccactgggtttttgggtttctctttgttctgctccgctagataaccattttgtctgtgtgattcttttcttcacagcgctgtgagagatccttagtcgctgattgaaaaagatgagtaagcttcagagtgatgccttgcgagaagctatcactggaatcatggccgattccaaggagaagaatcgcaaatttgtggagactatcgaactccagattgggctgaaaaactacgatccacaaaaggacaagcgtttcagcggctctgtcaagttgccccacattcctcgccccaagatgaaaatttgcatgcttggtgatgcacaacatgtcgaagaggccgagaagataggtctggactggatggatgtggaagccttgaagaagcttaacaagaataagaagttggtgaagaagctagctaagaagtaccatgcctttttagcttctgaagcagttattaagcagattccacgtctgttgggtcctggtctaaacaaagcaggaaagttccctacacttgttactcaccaggaaactcttgagtctaaagtaaatgagtctaaggctatggtcaaatttcaactcaagaaggtgctctgcatgggagtagccgtgggcaatgtcagcatggaggagaaacaaatcttccaaaatgttcaactgagtgttaacttcctagtatccttgttgaaaaagaactggcaaaatgttaggtgcttgtatctgaagagtaccatggggaaatcttaccgcgtcttttgagcgatatctatttttattttggtgaatttgttatggcccataatacatttatcttaatagctagatgcaaattttcatcttgttacagttttgtgggtttgacttttattgttttcgtgttcatgttcaaacatttgataatgatatgggttatttttggctctgctttcttacctaattgctataattcttccgtctg

SEQ ID NO: 1344 - DNA, 916 bp, Brassica napus
ccgttctatccaaaaggagagaatagtagctgaggaagtgccaaaatgagtaagctccagagtgaagccgtgaaagaggcgatatcaaccattatcactcactgcaaggagacgaagcctcgcaagttcaccgagactatcgagctccagattggtctcaagaactatgaccctcaaaaggacaagaggtttagcggttccgttaagttgcctcacattcctaggcccaagatgaagatttgcatgctcggtgatgcccagcacgttgaagaggctgagaagattgggttagagtccatggatgtggaagctcttaagaagctgaacaagaacaagaagcttgtcaagaagctagctaagaagttccatgctttccttgcttctgaatctgtcatcaagcagattccccgtcttcttggtcctggtctcaacaaggcaggaaagttcccaactcttgttagtcaccaagagtctttggagtccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgttaggtgcttgtacttgaagagcacaatgagtccacccacccgtgttttctaagattattttatctcaaagtttctctcaaggtgtcatctggctgagaggagatttcattttcatttctgtcatgattaagattttgtttaaagacggagttatttataatattccgattactcttggtgaattctctctatttatgttagtttaacccaatcttattacaaaataatggaatacaatcacaagaaatcaataaacagtggtttattat

SEQ ID NO: 1345 - DNA, 998 bp, Brassica napus
atccaaaaggtatacttcttctttaattctctttcttcacctcttcacggctactcttcatcgattctaaacgttcgttgataaaaccttgttttcaggagagaatagtagctgaggaagtgccaaaatgagtaagctccagagtgaagccgtgaaagaggcgatatcaaccattatcactcactgcaaggagacgaagcctcgcaagttcaccgagactatcgagctccagattggtctcaagaactatgaccctcaaaaggacaagaggtttagcggttccgttaagttgcctcacattcctaggcccaagatgaagatttgcatgctcggtgacgcccagcacgttgaagaggctgagaagattgggttagagtctatggatgtggaagctcttaagaagctgaacaagaacaagaagcttgtcaagaagctagctaagaagttccatgctttccttgcttctgaatctgtcatcaagcagattccccgtcttcttggtcctggtctcaacaaggcaggaaagttcccaactcttgttagccaccaagagtctttggagtccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgttaggtgcttgtacttgaagagcacaatgagtccacccacccgtgttttctaagattattttatctcaaagtttctctcaaggtgtcatctggctgagaggagatttcattttcatttctgtcatgattaagattttgtttaaagacggagttatttataatattccgattactcttggtgaattctctctatttatgttagtttaacccaatcttattacaaaataatggaatacaatcacaagaaatcaataaacagtgttttattat

SEQ ID NO: 1346 - DNA, 699 bp, Brassica napus
gggtccttacagcatctgaggaagttagccaaaatgagtaagctccagagtgaagccgtgagagaggcgatatcctccatgatcactcactgcaaggagacaaagccacgcaagttcactgagaccatcgaacttcagattggtctcaagaactacgaccctcaaaaggacaagcggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaagcttgtgaagaagctagctaagaagttccatgctttccttgcttctgaatctgttattaaacagattcctcgtcttcttgggcctgggctcaacaaggcaggaaagtttccaactcttgtgagccaccaagagtctttggaagccaaagtgaatgagactaaggcaacagtgaagttccagctcaagaaggttctttgcatgggagttgctgttggtaaccttgacatggaggagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctc

SEQ ID NO: 1347 - DNA, 985 bp, Brassica napus
ggtccttacagcatccgaggaagtttgccaaaaatgagtaagctccagagtgaagccgtgagagaggcgatctcctccatgatcactcactgcaaggagacaaagccacgcaagttcaccgagaccatcgagctccagattggtctcaagaactacgacccacaaaaggacaaacggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaaacttgtcaagaagctagcgaagaagttccacgctttccttgcttctgaatctgttattaagcagattcctcgtcttcttggtcctggtctcaacaaggcaggaaagttcccaactcttgtgagccaccaagagtctttggaagccaaagtgaatgagaccaaggcaactgtgaagttccagctcaagaaggttctttgcatgggtgtcgctgttggtaaccttgacatggaggagaagcagatctttcagaatgttcagatgagtgtcaacttccttgtttcacttctgaagaagaactggcaaaatgtgaggtgtttgtacttgaagagtacaatgggtccaccaaaccgtgtgttctaagcttattattatcttagagtttctctaaagatatcatcatcttcaaggctgagaatagatttgattttcatttctgttgtgagccttctctacttcttggattaatttcagaatccttttttggtaggatcattttcttcaaagacaattttgtttctttttttgctattatatgattagttgtcttttttcatttaagttttcaagatttgcgatttcgttatcaatatcgaaatataatgtgtcaaatgatcttaacatctgacaacaaaacctttataatatgctttttctgtct

SEQ ID NO: 1348 - DNA, 922 bp, Brassica napus
agccgaggtgtcgatagcttgatatcgaactctatcggtcattacggccgggggtccttacagcatctgaggaagtttgccaaaatgagtaagctccagagtgaagccgtgagagaggcgatatcctccatgatcactcactgcaaggagacaaagccacgcaagttcaccgagacaatcgaactccagattggtctcaagaactacgaccctcaaaaggacaagcggttcagcggttcagtcaagttgcctcacatcccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagttccatgctttccttgcttctgaatctgttattaaacagattcctcgtcttcttggtcctggtctcaacaaggcaggaaagttccctactcttgtgagccaccaagagtctttggaagccaaagtgaatgagacaaaggcaacagtgaagttccagctgaagaaggttctttgcatgggtgtcgctgttggtaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatccttttttggtaggttcaagattttctttataaagacaattttatttctattttgctattatgattagtgttttttgcc

SEQ ID NO: 1349 - DNA, 897 bp, Cleome gynandra
tcggggggggtttctgctgcttcaactttcaggatcggaactcgctgaattgatagcaactcaagatgagtaagcttcagagtgaagccctgagagaagccatctcaaccatcaaggggaaatgcgaggaaaagaaacgcaacttcgtagagacaattgagctccaaattggtctgaagaactatgacccccagaaagacaagcgtttcagcggttctgtcaaactgcctcacattccccgccctaagatgaagatttgcatgcttggagatgcccagcatgttgaagaggctgagaagatgggattagactacatggacgttgaggctttgaagaaactcaacaagaacaagaagctcgtcaagaagcttgcgaaaaagtaccatgctttcttggcttctgaatctgtcattaagcagattccccgtcttctcggtcctggtcttaacaaagcaggaaagttcccaacccttgtgagccaccaagaatctttggaatcaaaggtgaatgagaccaaagccaccgtcaaattccagcttaagaaggttctctgcatgggtgttgccgtcgggaacattggaatggaagagaagcagatcttccagaacgttcagatgagcgtaaacttcctcgtctcccttttgaagaagaactggcaaaacgttaggtgtttgtacctgaagagcaccatgggaccaccccaacggatcttctgagctttgtcattgtctttgattccgggaatgaagtattgtgataggatctgaaatatccgtagtgacctttgtctctggtatctttggaacagtaaacattttgtctttgctctgtttttctcaaagttttgttgaatcttgatgctttgccattgaacctctatgaagcttctttttgtta

SEQ ID NO: 1350 - DNA, 906 bp, Vigna unguiculata
agggttatcggcttcagcgttttgagatccttatccgctgattggaaaagatgagtaagcttcagagtgatgccttgcgagaagctatcactggaatcatggccgattccaaggagaagaatcgcaaatttgtggagactattgaactccagattgggctgaaaaactacgatccacaaaaggacaagcgtttcagtggctctgtcaagttgccccacattcctcgccccaagatgaaaatctgcatgcttggtgatgcacaacatgtcgaagaggccgagaagatcgggctggactggatggatgtggaagccttgaagaagctaaacaagaataagaagttggtgaagaaactagctaaaaagtaccatgcctttttagcttctgaagcagttatcaagcagattccacgtctgttgggtcctggtctaaacaaggcaggaaaattccctacacttgttactcaccaggaaactcttgagtcaaaggtaaacgagtctaaggctatggtcaaatttcaactcaagaaggtgctctgcatgggagtagccgtgggcaatgtcagtatggaggaaaaacaaattttccaaaatgttcaactcagtgttaacttcctggtatccttattgaaaaagaactggcaaaatgttaggtgcttgtatctgaagagtaccatgggaaaatcttaccgcgtcttttgagggatatctattttttatttggttaatgttatggcgcatgatacatttatctcaatagctagatgcaaattttcatcttgatacagttttgcgagttggacctttgttgttagtgttttgtgttcatgttcagacatttgataatgatatgcgttaaattttgctctgctttcttatttacatgttattgacctacttactatta

SEQ ID NO: 1351 - DNA, 989 bp, Cynara scolymus
  misc_feature (52)..(53): n is a, c, g, or t
ctcgcggggccatttataccatttactttctagctacaagcacattcttacnntacataggcggaggagctgcgcaaaggggaaatctttcaccatgagtaagttaggaagtgaggctgtcagagaagccattacccaaattacaactgaggccaaggagaaaaaccgtaagtttacggagaccattgagcttcagattgggttgaagaactatgacccccaaaaagacaaacgtttcagtggcacggtaaagttgccacacattcctcgtcctaagttgaaggtctgcatgctcggtgatgctcaacatgttgaagaggcacagaagataggattggaatacatggatgttgaagggttgaagaagcttaacaaaaacaagaagttggtcaagaagcttgctaagaagcaccaagcctttctggcatccgagtccgtcattaagcagattccgcgtctcttgggccctggtctcaacaaagcaggaaaattcccgacacttgtgacacatcaggagtccttggagtcaaaagttaatgaaataaaggcaacagtgaagtttcagcttaagaaggttctctgtatgggggttgctgtgggaaattgcagcatggaagagaagcagatcttccagaatgttcaaatgagcgtaaactttctcgtttcattattgaagaaaaactggcaaaacgtgaggtgcttgtacctgaagactaccatggggaaaccagtacgtgtcttttagtaaaagccaagattgatgattttagacgacagttgtaggacgacgcatacattcgatatcatctgctacgagtggtttgatattttggctttaaaccaagtcatcattcttatcttaaatctgtatttttggtagtcattagatttgcaatttaatggaagagaatctgaagatcttccatgcttgtaaaatgtttaaatttttgtgcaaatttctaccatatgaatgttgatgttttgttggc

SEQ ID NO: 1352 - DNA, 691 bp, Festuca arundinacea
ggcacgagggcacgaggcgcaccctcgacaaaatccggcgtcgactgatcggcggcaaccatgagtaagctttcaagtgatgcggtcaaggaggccatcgccctgattgttggggaggccagagaaaagaagcgcaagttcactgagactgttgagcttcagattggtcttaagaactacgacccgcaaaaggacaagcgtttcagcggctctgttaagctgccccatataccccgcccgaagatgagggtgtgcatgcttggtgatgcccagcatgtcgaccaggctgagaaattggggcttgactccatggatgttgaaagtctcaaaaagatgaacaagaacaagaagcttgttaagaagctagccaagaagtaccatgctttcttagcatcagaggccatcatcaagcagatcccccgtctccttggtcctggtctcaacaaggcaggcaagttccccacactggttagtcactccgagtctcttgaagccaaggtgaacgagacaaaagcaacagtcaagttccagctgaagaaggttctttgcatgggtgttgctgtgggtaacttgtccatggatgagaagcagatccaacagaacctccaaatgagcgtcaacttccttgtgtcccttctgaagaagaactggcagaatgtgaggtgcctgtacgtgaagagcaccatgggga

SEQ ID NO: 1353 - DNA, 1073 bp, Ipomoea batatas
tttaggaagcaacgtcggccactcgcccctgcaggctcgctgtcgcgactccaaagaattcggcagaggctctcttgccctcctttccatccacttctgtttttttacaggtgttcatttgtgtttgcctatgaatcctaactcttttttgtttttgttggattatgcagatacttagaagggaaagaaaaatctttcgccatgagcaagttgcaaagtgatgctgtgagggaagcaatctcccaattgatgggggattccaaggagaagaaccgcaagttcactgagaccattgagcttcaaattgggctgaagaactatgatccccagaaggacaagcgtttcagtggttctgtcaaattgccacacattccacgccctaagatgaaagtatgcatgcttggtgatgctcagcacgtggaggaggctgaaaaatttggcatggagtatatggatgtggaggggttaaagaagctcaacaaaaacaagaagcttgtgaagaagcttgcaaagaagtaccatgctttcttggcatctgaagctgtaattaaacagatccctcgtctcttgggccctggtcttaacaaggcaggcaagttcccaaccttggtgacacatcaggagtccttggagacaaaggttaatgaaacaaaggctactgtaaaatttcagcttaagaaggtcctctgtatgggtgttgctgttggtaatgttgccatggaggagaagcagatcttccagaatgttcaaatgagcgtgaactttctggtatcattgctgaaaaagaactggcagaatgtgaggtgcctatatctcaagacaacaatgggaaggcctattcggatcttttaactcggagttgtctctcttgtattctttatttaagctctataggtagacattgcacaatcagtcttgtactctgccattgtctagaaccatttttgtttcgatgtcctcttggatttccctgtttttgttcaagccttattactgggtatttggatttgttgaggtttgtgatatcagtctctttgattccgtttatgaaattgctgtagaaatgagagagc

SEQ ID NO: 1354 - DNA, 978 bp, Actinidia deliciosa
tcctcatacccccagtaggttccctccctcgcatcgatttgctgctaatctctttctttggttgtgtaaacaggtgatctacagatcatttgttgaaagcgaaactcattaaccatgagtaagctccaaagcgacgctgtcagggaagccatctcccagattgctggagatgccaaggaaaaaaagcggaagtttgtggagaccattgagcttcaaattggtttaaagaactatgatccccagaaggataagcgtttcagtggttctgtgaaactgccacacatcccccgtcctaagatgaaggtttgcatgcttggtgatgctcagcatgtagaagaggcagagaagataggaatggattatatggatgtggaagggctgaagaagcttaacaagaacaagaaattagtcaagaagctagcgaaaaagtaccatgcatttctagcatctgaagctgtcatcaagcagatccctcgcctcttgggccctggcctgaacaaggcaggaaagtttccaactctagtgactcatcaagagtcccttgagtcaaaagttaatgaaacaaaagcaacagtgaagtttcaacttaagaaggttctttgcatgggtgttgctgtgggcaattgtggtatggaggataagcagatcttccagaatgttcaaatgagtgtaaactttcttgtttcattgctgaagaagaattggcaaaatgtccggtgcttgtcccttaggagtactatgggaaggccggcccgcatcttttaagaagatatatatacttgttgggaactccgcagggtgagaccaagcccggacaagacttcattacatttttggagttcatcagatcccctttttgtttgttttctgagattattagctttcttgtctgaactagtgaatgctgcgactaaagaattcttatggtggttgagaattataagattcgttgttttttgtttctttaaaaaaaaaaaa

SEQ ID NO: 1355 - DNA, 887 bp, Tropaeolum majus
gctacattcagcgtctcttgtttcctccatatttccaggagctcttcctccgtagaatttccagtgtttcatcaacatgagtaagcttcagagcgaggcacttagggaagccatctcaaccattatgactgcttccaaggagaagcagcgtaacttcacagagaccattgaacttcaaattggtttgaagaactatgatccccaaaaggataagcgtttcagtggctccgtcaagttgccccacattcctcgcccaaagatgaaggcctgcatgcttggagatgcccagcatgtagaagaggcaacgaagattggtttggattatatggatgttgaagctttgaagaagcttaacaagaacaagaagcttgttaagaagctagcaaagaagtaccatgctttcttagcatcggagtctgtcatcaagcagatccctcgtcttttgggccctggtcttaacaaagcaggtaagtttcctacacttgttagccaccaagagtctcttgaggctaaggtcaacgagatcaaggcaactgttaagttccagttgaagaaggttctatgcatgggtgttgctgtcggtaactgcggtatggaggagaagcagattttccagaatgtgcaaatgagcgtcaactttcttgtttctttattgaaaaagaattggcaaaacgtgaggtgcttgtatctgaagagtacgatgggcccttcaaacagagtgttttaagttgttttgttttgaaaaagagcttgggattgttctcctgtttgtttttaatttatgtttcagttgaaccactagaaactttaacagtaatatttgagatttttgctttggtttaattgtttttataggcaccttaaatttgtttaatttggtttcttac

SEQ ID NO: 1356 - DNA, 856 bp, Tropaeolum majus
aggctcttatattagctgctatcttgctacattcagcgtctcttgtttcctccatatttccaggagctcttcctccgtagaatttccagtgtttcatcaacatgagtaagcttcagagcgaggcacttagggaagccatctcaaccattatgactgcttccaaggagaagcagcgtaacttcacagagaccattgaacttcaaattggtttgaagaactatgatccccaaaaggataagcgtttcagtggctccgtcaagttgccccacattcctcgcccaaagatgaaggcctgcatgcttggagatgcccagcatgtagaagaggcaacgaagattggtttggattatatggatgttgaagctttgaagaagcttaacaagaacaagaagcttgttaagaagctagcaaagaagtaccatgctttcttagcatcggagtctgtcatcaagcagatccctcgtcttttgggccctggtcttaacaaagcaggtaagtttcctacacttgttagccaccaagagtctcttgaggctaaggtcaacgagatcaaggcaactgttaagttccagttgaagaaggttctatgcatgggtgttgctgtcggtaactgcggtatggaggagaagcagattttccagaatgtgcaaatgagcgtcaactttcttgtttctttattgaaaaagaattggcaaaacgtgaggtgcttgtatctgaagagtacgatgggcccttcaaacagagtgttttaagttgttttgttttgaaaaagagcttgggattgttctcctgtttgtttttaatttatgtttcagttgaaccactagaaactttaacagtaatatttgagattttt

SEQ ID NO: 1357 - DNA, 1039 bp, Avena sativa
cctcccctcccctcccctgcctcgtcgcggatcagtgctttcaccgccggcgccatgagtaagttgcagagtgactccctgagggaggcaatcacaggtattaccagtgactgtcgtgagaagaaccgcaagttcagcgaaaccattgagctgcagattggactgaagaactatgacccgcaaaaggataagcgtttcagtggctctgttaagcttcctcacatccctcgcccaaagatgagggtctgcatgcttggtgatgcccagcacgttgaagaggcagggaaaatgaacctagattatatggatgtggaatccctcaagaagatgaacaagaacaagaagctagtcaagaagcttgcaaaaaaatatcatgcttttcttgcatctgaggccatcattaagcagattccccgacttcttggacctggtcttaacaaggcaggaaaattcccaactctggtgtcccatcaggagtccctcgaagccaaggttaatgagacaaaggctacagtgaagttccagctgaagaaggtgctctgcatgggtgttgccgttggccacatgggtatggacgagaagcaaatcttccagaatgtgcagatgagcgtgaatttccttgtttctctgttgaagaagaattggcaaaacgtgaggtgcttgtacctgaagagcacaatgggaaagccgcaccggttgttctagacctgtcttatctctttaggcttctaggatatccaggaggttgacagcttgggaacttttgttgttctcagttaccaaattttcgtgaggcaagtgacgattaaacaaaacagtccgaattattccgtcttgtactgagatggtcagttctctcctgctggaacttcatgatattctatccattgagatgctctcaaggctttctcttttgattcttgtgtttgtgcctttctattttctctttggaatctctgcgaaggctacgagatcacaagtagatttaacagcattggacctgtgatgcttccaaaatttagatcaaattatttttacc

SEQ ID NO: 1358 - DNA, 1043 bp, Avena sativa
gccgcctcccctcccctcccctgcctcgtcgcggatcagtgctttcaccgccggcgccatgagtaagttgcagagtgactccctgagggaggcaatcacaggtattaccagtgactgtcgtgagaagaaccgcaagttcagcgaaaccattgagctgcagattggactgaagaactatgacccgcaaaaggataagcgtttcagtggctctgttaagcttcctcacatccctcgcccaaagatgagggtctgcatgcttggtgatgcccagcacgttgaagaggcagggaaaatgaacctagattatatggatgtggaatccctcaagaagatgaacaagaacaagaagctagtcaagaagcttgcaaaaaaatatcatgcttttcttgcatctgaggccatcattaagcagattccccgacttcttggacctggtcttaacaaggcaggaaaattcccaactctggtgtcccatcaggagtccctcgaagccaaggttaatgagacaaaggctacagtgaagttccagctgaagaaggtgctctgcatgggtgttgccgttggccacatgggtatggacgagaagcaaatcttccagaatgtgcagatgagcgtgaatttccttgtttctctgttgaagaagaattggcaaaacgtgaggtgcttgtacctgaagagcacaatgggaaagccgcaccggttgttctagacctgtcttatctctttaggcttctaggatatccaggaggttgacagcttgggaacttttgttgttctcagttaccaaattttcgtgaggcaagtgacgattaaacaaaagagtccgaattattccgtcttgtactgagatggtcagttctctcctgctggaacttcatgatattctatccattgagatgctctcaaggctttctcttttgattcttgtgtttgtgcctttctattttctctttggaatctctgcgaaggctacgagatcacaagtagatttaacagcattggacctgtgatgcttccaaaatttagatcaaattatttttacc

SEQ ID NO: 1359 - DNA, 1075 bp, Cajanus cajan
cggggggattccacgggtccacgctatatacttgttcctcccgccgcgcgaaaccctagctagggtttggcctgcgcttttagatctatatccacctagcccttcatttggaaaaccccaagtttcaaacatgagtaagcttcagagtgatgctcttagggaggcaatctcaggaatcatggctgattccaaggagaagaaccgtaaatttgtggagaccattgagctccaaattggactgaaaaactatgatccccaaaaggacaagcgttttagtggctctgtcaagttgccccacatccctcgccccaagatgaagatatgcatgcttggtgatgcccaacacgttgaggaggccgagaagataggattggattacatggatgtagaggcattgaagaagcttaacaaaaataagaaattggtgaagaagctagccaaaaaatatcacgcttttttggcttctgaagcagtcatcaagcaaattcctcgtctcttgggacctggtctcaacaaggcagggaagttcccaacacttgtgactcaccaagaaactctcgagtcaaaggttaatgagagtaaggctatgatcaaattccagcttaagaaggtgctctgcatgggagtagctgtggggaatgttagcatggaggaaaaacaaatcttccaaaatgtacaactgagtgttaacttccttgtctcattgttgaaaaagaactggcagaatgtaaggtgcttgtatctgaagagttccatggggaaatcgtaccgtgtcttttgagtggctgttctttaattcagtgaatttctgatcgcacttagtttgcttatttatcttgataggtggacataatttttcatcgttctacaattttgttggatgagtatttttggttaatatttcttgttattgatatgctatgtttcaagtgctttgcaatgtcggataattttaggggtactaaatttaagctacccgtgtttttactatacaactcattgcgctgactatcatgactacatcgtgtttgagtgtattctataattttaggatttcgggtttatttaatatatc

SEQ ID NO: 1360 - DNA, 922 bp, Raphanus sativus
ggaagttactcaaacccttctcatgccgtcctcttagcatctcaggaagtaagccaaaatgagtaagctccagagtgaagccgtgagagaggcgatatccgccatgatcactcactgcaaggagacgaagcctcgcaagttcaccgagaccatcgaactccagattggtcttaagaactacgaccctcaaaaggacaagcgtttcagcggttccgtcaagttgcctcacatcccaaggcctaagatgaagatttgcatgctcggtgatgcccagcacgttgaagaggctgagaagattggattagagtctatggatgtggaagcacttaagaagctgaacaagaacaagaagcttgttaagaagctagcaaagaagttccatgctttccttgcttctgaatccgttatcaaacagattcctcgtcttcttggtcctggtctcaacaaggcaggaaagttcccgactcttgttagccaccaagagtctttggaagccaaagtgaacgagacaaaggcaacagtgaagttccagctcaagaaggttctttgcatgggtgtcgccgttgggaaccttgacatggaggagaagcagatctttcagaatgttcagatgagcgtcaacttcctcgtctcactattgaagaagaactggcaaaacgtgaggtgtttgtacttgaagagcacaatgggtccacctaaccgtgtgttctaagattattattatctcaaagtttctcttaatgtatcatcaaaggctgagattagatttgattttcacttctgtcgtgagctttcttcttcttggattacttccagaatccttacttttgtaggatcaagattttcttaaaagacagttttgtttctattattgctatttttgttagtgtttttttttcatttaagttttcaaaatttaata

SEQ ID NO: 1361 - DNA, 916 bp, Raphanus sativus
agagtaaggctttcctctgcttcacctttcaggttcagagattcgtcaactgagagaaactcaagatgagtaagcttcagagcgaggctcttagagaagccatcacgaccatcaagggcaaatctgaggagaagaagcgtaactttacggagacggttgagcttcagattggtctgaagaactatgacccgcaaaaggacaagcgtttcagtggatctgtcaagctccctcacattcctcgccctaagatgaaggtctgcatgcttggagatgctcagcatgttgaggaggctgagaagatgggactagactctatggatgttgaggctttgaaaaagctcaacaagaacaagaagcttgttaagaagcttgccaagaagtaccatgctttcttggcttctgagtctgtcatcaagcagattccccgtcttcttggtcctggtcttaacaaagcaggaaagttcccaacactggtgagtcaccaagagtcgttggaagggaaggtgaacgagaccaaagcgacagtcaagttccagttgaagaaggttctgtgtatgggtgttgctgttggtaacctttccatggaagagaagcagctctttcagaatgttcagatgagcatcaacttccttgtctctctcttgaagaagaattggcaaaacgtgaggtgtttgtacttgaagagcaccatgggaccaccacagagaatcttttgagttctccactcctatcatcttggaacttttgctttgtggtttttgtttgtttcagagatcttgagttatggttttgtttgttattagcagaactgaggtgttagttttctttttgttaagacattataatatgcaatgttggattttacaatatcgactctccgattcagttttatcttatctattccgtgaattgctca

SEQ ID NO: 1362 - DNA, 908 bp, Raphanus sativus
aaggctttcctctgcttcacctttcaggttcagagattcgtcaactgagataaactcaagatgagtaagcttcagagcgaggctcttagagaagccatcacgaccatcaagggcaaatccgaggagaagaagcgtaactttacggagacggttgagcttcagattggtctgaagaactatgacccgcaaaaggacaagcgtttcagtggatctgtcaagctcccgcacattcctcgccctaagatgaaggtctgcatgcttggagatgctcagcatgttgaggaggctgagaagatgggactagattctatggatgttgaggctttgaaaaagctcaacaagaacaagaagcttgttaagaagcttgccaagaagtaccatgctttcttggcttctgagtctgtcatcaagcagattccccgtcttcttggtcctggtcttaacaaagcaggaaagttcccaacactggtgagtcaccaagagtcgttggaagggaaggtgaacgagaccaaagcgactgtgaagttccagttgaagaaggttctgtgtatgggtgttgctgtcggtaacctttccatggaagagaagcagctcttccagaatgttcagatgagcatcaacttccttgtctcgctcttgaagaagaattggcaaaacgtgaggtgtttgtacttgaagagcaccatgggaccaccacagagaatcttttgagttctcgactcctgtcatcttggaacttttgctttgtggtttttgtttgcttcagagatcttgagttatggttttgtttgatattagcagaactgaggtgttagtttgctttttgttaagacattataatatgcaatgttggattctacaatatcgactctccgattcagttttatcttatctattccgtgaattgc

SEQ ID NO: 1363 - DNA, 914 bp, Raphanus sativus
gcagagtaaggctttcctctgcttcacctttcaggttcagagattcgtcaactttagagaaactcaagatgagtaagcttcagagcgaggctcttagagaagccatcacgaccatcaagggcaaatctgaggagaagaagcgtaactttacggagactgttgagcttcagattggtctgaagaactatgacccgcaaaaggacaagcgtttcagtggatctgtcaagctcccgcacattcctcgccctaagatgaaggtctgcatgcttggagatgctcagcatgttgaggaggctgagaagatgggactagactctatggatgttgaggctttgaaaaagctcaacaagaacaagaagcttgttaagaagcttgccaagaagtaccatgcttttttggcttctgagtcggtcatcaagcagattccccgtcttcttggtcctggtcttaacaaagcaggaaagtttccaacactggtgagtcaccaagagtcgttggaagggaaggtgaacgagaccaaagcgacagtgaagttccagttgaagaaggttctgtgtatgggtgttgctgttggtaacctttccatggaagagaagcagctctttcagaatgttcagatgagcatcaacttccttgtctcgctcttgaagaagaattggcaaaacgtaaggtgtttgtacttgaagagcaccatgggaccaccacagagaatcttttgagttctctactcctgttatcttggaacttttgctttgtgggttttgttttgtttcagagatcttgagttatggttttgtttgatattagcagaactgaggtgttagtttgctttttgttaagacattataatatgcaatgttggattctacaatatcgactctccaattcagttttatcttatgaaatgctttcta

SEQ ID NO: 1364 - DNA, 836 bp, Taxus baccata
aaggaaagcaagagaagagggggtgcggcggacgcctgtatcaaaccatgagtaagctccagagcgacgtgttgagggaggcgattacgggggtagtgacagagagtaaggagaagccaaagaagttcgtggagacgatagagttgcagataggccttaaaaattatgacccccaaaaggataagcgtttcagcggctccgtcaagcttccccacatccctcgtcccaagatgaagctctgtatgctcggagacgcacaacatgttgaagaggctgtgaaaataggcttggactacatggatgtggaaggattaaagaaaatgaacaagaacaaaaaacttgttaagaagctggcaaagaaataccatgcttttctagcatcagaagcaattattaagcagattcctcgactccttggtcctggtctaaacaaggctggtaagtttccgactttggtgtctcaccaagagtcattggaggcaaaaatgaacgaaacaaaagccacaataaaatttcaattgaaaaaagttctctgtatgggtgttgctgtgggtaactgtggaatggaggacaaacaaatattccaaaatgtccagttgagtgtcaactttctggtgtccctgcttaagaagaactggcaaaatgtacgttgtctctacctgaagagcaccatgggcaagccgactcgaatattctaattgtgcattttattgatagcttctgctcaaggagcattggaaaatgtttgtttgttaaacgatttgtttgttgatttgatatagttttatgcagaggcatatgttagctgataggcagggtctgatgcatgttgtaac

SEQ ID NO: 1365 - DNA, 917 bp, Nicotiana tabacum
acggcgctcacaaaccctaattagggttttctcctacagtgaatttagaaggtaaaagagaagtgcttgagacatgagtaagcttcagagtgatgccctaagagaagcaatctctgtaattaagaatgattgcaatgaaaagaagaggaagttcacagagacaattgagctccagattgggcttaagaactatgatccccaaaaggacaagcgtttcagtggatctgtgaaactgcctcacattcctcgtcctaagatgaagatttgcatgctcggagatgctcaacatgtggaggaggccgaaaagatcgggttggagtacatggatgtggaaagcctcaagaagcttaataagaacaagaagctagttaagaagcttgccaagaagtaccatgctttcttggcctcggaatctgtcatcaagcagattcctcgtctcttgggtcccggtctgaacaaggctggtaaatttcctagccttgtttcccaccaggagtcacttgagtctaaggttaatgaaaccaaggctacaattaagttccaattgaagaaggtgctttgcatgggtgttgctgttggaaatcttgatatggaggagaaacaaatattccagaatgtgcaaatgagtgtgaacttccttgtctcattgctaaagaagaattggcaaaatgtgaggtgcttgtacttgaagagcacaatggggaagacacagcgcgtcttttaagatggttgtctaaatgttgcaactttttgggcattttgcttgtaagagttactgatgaaaattttgaatagtctatcatcctggataatggttttaatgtaatatcattatagggattgttttgccagacatttcctttttaagagatgttagtaatgttaatttttctcttatttttatgaacgaggatttc

SEQ ID NO: 1366 - DNA, 876 bp, Nicotiana tabacum
atcgagggttttctcttacagtaaagtttgaaggagaagaattttgagccatgagtaagcttcagagcgatgcccttagagaagccatctctgtgattaagaatgattgtgcagagaagaaaagaaaattcactgagactattgagctccagatcgggctgaagaactatgatccccaaaaggacaaacgtttcagtgggtccgttaaattgccccacattcctcgtcctaaaatgaagatttgtatgcttggagatgctcagcacgttgaggaggcagaaaagataggtttggagtacatggatgtggaaagcttgaaaaagcttaacaaaaataagaaattggttaagaagcttgcaaagaaataccatgctttcttggcttcagagtctgtcatcaagcagattcctcgtttgttggggcccggcctgaacaaggcgggcaagtttccgagtcttgtttcacaccaagagtcacttgaatccaaggttaatgagaccaaagctactatcaagtttcaattgaaaaaggtgctttgcatgggagttgctgttggaaacttggatatggaggagaaacagatcttccagaatgtgcaaatgagtgttaattttctagtgtcgttgctgaaaaagaattggcaaaatgtaaggtgcctgtacttgaagggcaccatgggaaagccacagcgtgtcttttaaggagatttttgtttcgctgttggaagttttcagcattttgggtgtgagctatagatactcttgaaatttttgggtagtagttctggttatctgtttgaatactataacattgttcggtattgttttgcttcaactttgtcttctttaaagatgttagcagtgattaccatagcat

SEQ ID NO: 1367 - DNA, 998 bp, Brassica rapa
cccccattctcttgcctgccgtccttacagcatctgaggaagttacccaaaatgagtaagctccagagtgaagccgtgagagaggcgatatcctccatgatcactcactgcaaggagacaaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagacaattttatttctattttgctattatgattagtgttttttgccttaagtttttcaagatttgcgatttcgttatcattatcgttatatagtgcagtacgtcaaatgatcttatatcacaacaaaaataatgtataatttgatttttctgtc

SEQ ID NO: 1368 - DNA, 906 bp, Brassica napus
agcatctgaggaagtttgccaaaatgagtaagctccagagtgaagccgtgagagaggcgatatcctccatgatcactcactgcaaggagacaaagccacgcaagttcaccgagaccatcgaactccagattggtctcaagaactacgaccctcaaaaggacaagcggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagttccatgctttccttgcttctgaatctgttattaaacagattcctcgtcttcttggtcctggtctcaacaaggcaggaaagttcccaactcttgtgagccaccaagagtctttggaagccaaagtgaatgagactaaggcaacagtgaagttccagctcaagaaggttctttgcatgggagttgctgttggtaaccttgacatggaggagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatccttttttggtaggttcaagattttctttataaagacaattttatttctattttgctattatgattagtgttttttgccttaagtttttcaagatttgcgatttcgttatcattatcgttatat

SEQ ID NO: 1369 - DNA, 1200 bp, Cajanus cajan
attccacgggtccacgctatatacttgttcctcccgccgcgcgaaaccctagctagggtttggcctgcggtactttctctgctctcacaagactttcctattagattttctaccatttttcttctgcttccttcgccgagtccaattctcactttctctttctctgcatttttgttcgcagcttttagatctatatccacctagcccttcatttggaaaaccccaagtttcaaacatgagtaagcttcagagtgatgctcttagggaggcaatctcaggaatcatggctgattccaaggagaagaaccgtaaatttgtggagaccattgagctccaaattggactgaaaaactatgatccccaaaaggacaagcgttttagtggctctgtcaagttgccccacatccctcgccccaagatgaagatatgcatgcttggtgatgcccaacacgttgaggaggccgagaagataggattggattacatggatgtagaggcattgaagaagcttaacaaaaataagaaattggtgaagaagctagccaaaaaatatcacgcttttttggcttctgaagcagtcatcaagcaaattcctcgtctcttgggacctggtctcaacaaggcagggaagttcccaacacttgtgactcaccaagaaactctcgagtcaaaggttaatgagagtaaggctatgatcaaattccagcttaagaaggtgctctgcatgggagtagctgtggggaatgttagcatggaggaaaaacaaatcttccaaaatgtacaactgagtgttaacttccttgtctcattgttgaaaaagaactggcagaatgtaaggtgcttgtatctgaagagttccatggggaaatcgtaccgtgtcttttgagtggctgttctttaattcagtgaatttctgatcgcacttagtttgcttatttatcttgataggtggacataatttttcatcgttctacaattttgttggatgagtatttttggttaatatttcttgttattgatatgctatgtttcaagtgctttgcaatgtcggataattttaggggtactaaatttaagctacccgtgtttttactatacaactcattgcgctgactatcatgactacatcgtgtttgagtgtattctataattttaggatttcgggtttatttaatatatcttttttttatttataagaaa

SEQ ID NO: 1370 - DNA, 846 bp, Lippia dulcis
cccaataagaattatcgttagggtttgcgcgtcaatatttatgcttctgaatctgcggctctcattctctcttcttcagtcaattccagccaccgtctcaccacccttgctctagggttttgttcagtgattcggggaactaattgaccgtgaacgatgagtaagcttcagagtgaggcattgagggaggccatcactgtgattgttgcagatgccaaggagaagaagcgcaacttcacagagactgttgagctccagattggtctcaagaactatgatccccaaaaggcaagcgtttcagggggtccgttagattgccccatatcccgaggccgaaaatgaaaatctgcatgcttggagatgcccagcatgttgaggaggcggagaagattggccttgagtcaatggatgtggaagcactgaagaagttgaataaaaacaagaaattggtgaagaagctagcaaagagatatcatgctttcttggcctcagaagcagtcattaagcagattccacgtctattgggacctggtctgaacaaggcaggtaagttccccactctcgtgactcaccaggagtctcttgaatccaaggtgaacgagaccaaggctaccattaagttccaattgaagaaggtgctctgcatgggtgttgctgttggcaacctcgacatggaggagaagcagatcttccaaaatgtccaaatgagtgtcaacttccttgtttcccttttgaaaaagaattggcaaaacgtgaggtgtttgttcttgaagagcaccatgggaaagccgcaacgtatcttctgagaaatttacaaacttctgttattcgactcgtagaaactac

SEQ ID NO: 1371 - DNA, 798 bp, Secale cereale
tccgccgcgccgccccctccctcctcccctgcctcgtcgcggaacagtgctcccaccgccggcgccatgagtaagttgcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatcccttaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcccttgagtccaaggttaatgagaccaaggccacagtcaagttccagttgaagaaggttctttgatgggtgttgccgttggccacctggatggaggagaagcagatcttccagaacgtgcagatgagcgtgaacttcctcgtctctctgttgaagaagaattggcaaaacgtgagatgcttgtacctgaagagcacgatgggaaaggtgtacccggttgttctagactatagtcttctaggatttccaggagattgacaacttgggaacttttgttgctttctcaattattatcaaattttcgtgcgt

SEQ ID NO: 1372 - DNA, 1017 bp, Cannabis sativa
tgtaattgctatgacaacagtaagcttcagagtgaagtcctcagagaggcaattgccactataatgaacgaatcaagggagaagaatcgtaacttcactgagacaattgaacttcagattggtttgaagaactacgatcctcaaaaggacaagcgtttcagtggctccgttaagttgccccacattcctcgtcccaagatgaaggtttgcatgcttggagatgctcagcatgttgaggaggctgtgaaaattaatttggactacatggatgttgaagggttgaagaagttgaacaagaacaaaaagctggttaaaaagcttgcaaagaaataccatgcctttttagcatcagaggctgttattaagcagattcctcgtcttttaggccccggtctcaacaaggctggtaaatttcccacccttgttactcaccaagaatccctggagtctaaagtcaatgagaccaaggccatggttaagttccagctgaaaaaggttctgtgtatgggtgtcgctgtcggaaacctctccatggaggagaagcaggtcttccaaaacgtgcagatgagtgttaatttccttgtttcactcttgaagaagaattggcaaaacgttaggtgtttgttcctgaagaccaccatggggaagccacaacgcgtgttttaaatatttaatctatttttacatgtatggtggagttttgtagtgagatgttttatgaggttgatacttatataaagtattcagttggaattctcaaagttgcttttttacttagttgtttcaaggtttataacatggtcatgtgttttgttaagaactttttattcttgttgcagaatcaatttttgtttacttattgccccctaatttttgaacacatcatataatggtcttaatatttcacagaatgacaagccgtttagatttcatttattcttaatgaaattgtgaaatatttctatcttgttaatggtgatagactaaaccaagtctactttattttaaatattttca

SEQ ID NO: 1373 - DNA, 2542 bp, Oryza sativa
cggtgtcaaatatttagaaacgagggaacaattgcttacgactcctaatactaatagtataaccatcaatttcctccctgttgccgtacacctgcagctttggaagcttccagttaatagctccttcactcctctcctcctccttccccgatcgagatcatccaaaaatttcttgccaaaggccgcacctttgcagttctcactgcacaggtataaagaaaaggccacgcctttgcctcgtcagttatctcttcgtttcttcttcttcctccttcgacgagagcaagcaagaagccatggcggactacaaccgctacggctacggcggctacggctccaccccgtcagcgccacccgcctcctcctacggctacaccaccacgccctccgccccaccggcctcctcctcctcgtcctacggctacggacatggcggcggcggttacccgtcctccacctacccaccgccgccgccgtcgtcgtcgcaggcgtatcccatggggatggggggcttcctggtgttcccgccggggacgcacccggacgtggagcgcgccttcagggccgtggaccgcgacggcagcggctccatcgacgagcgggagctgcaggacgcgctctcctccgcctaccaccgcttcagcatccgcaccgtccgcctcctcctcttcctcttcaacaaacctgcctcccattccccctctcgcatgggtccagcagagttcgtgtcactgtggaattgccttgggcaatggcggggcattttcgacagatacgatagggacgggagtggaaaaattgagaaagatgagttgagagaagctctacgcagtcttggatatgcggttccaccttctgtccttgagcttcttatcgcgaactacaacaatggagtctccagccgtggcgcgttggactttgacaactttgtggagtgtggaatgattgttaagggtttaactgaaaaattcaaagagaaggatacacgctacagcggctcggcaactctttcatatgacgggttcttgtcaatggtcattcccttcattgtcccttgacttcttcgggtgtctcaagacccaaagagctttgaatttgtacagcttttcagctatgtttctgcttcctagttggatttgtttgtgcaaataggccttggtgattttattgactctgtgccgtactgtgtacttagtaccattttgttttccctatagcctatatcgactgttacctgtgattgcgtctcggttctgacatgctttgatcttagttatcctcaaatgtaattgccttttgatgctaacagataatatgggagagtaaactcagcatctatgttcagtcaagttcttaaaagtctacttgaattatactgtttctgtatcttcaaaaatggggtcaaacggcgccgcatcatgatttcgatgctgcacgattcttgcgagcagcggcaacatttgctatcgattcaaggtcaaaccagaacgaacggtagttggcacaccaattctccccatgaacgaaactattcataaataacacaagcctcatttgcataaatccgaagtgcactgaataaactactacaaaatatgataacatatctcgatgttctcttgggtaagcacaaaactgatatcagtgcaagcagatctaatgtaaggacaagctcagttcaaccgcccagcatcttatcagcttcaatgtggagcaaaccagcttagaacaccctgtacggtttccccattgtgcttttgatgtacaggcacctcacattctgccagttcttcttcaaaagggacacgaggaagttgacgctcatttggatgttttgctggatctgcttctcctccatcgacaagttacccacagcaacacccatgcacagaaccttcttcagctggaacttgactgtagctttcgtctcattgaccttggattcaagagactcctggtgaaaaatggaagacttgcctgccttgtttagaccaggaccaaggagacgggggatctgcttgatgatggcctctgatgctaagaaagcatggtacttcttggcaagcttcttcacaagcttcttgttcttgttcatcttcttaagggcctcaacatccatgtagtcgagcccaatcttctcagcctgtttaaatgccatgtctgaattaaacaaaatggctacaacatcatatcttacctcctcgacatgctgggcatcaccaagcatgcagaccttcatcttggggcgggggatatggggcagcttaacggagccgctgaaacgcttgtccttttgtgggtcatagttcttgagaccaatttgaagctcaacggtctcggtgaacttcctgttcttttccttgcaatcagcaacaacctgggagatggcttccttgagagcctcggtttgtaacttactgcaattgatcgcacaagctcacattcagaatttgttatggaaaagaaagaacatttctgatactcatcaatcagtgcaccatactctggtataatctagaaatcagccatctctactgtttac

SEQ ID NO: 1374 - DNA, 828 bp, Vinca minor
ccccttcagtcttccatagaggcattgatcctgtggaaaacaagactgatttgtcaccatgagcaagctacagagcgatgctgttagggaagcaattacccagattgttactgactgtaataaagaggataagaagcgcaagtttactgagaccgttgagcttcagattggactgaagaactatgacccccaaaaggacaagcgtttcagtggctcagtcaaactgccacatatccctcgccccaagatgaaggtttgcatgcttggtgatgctcagcatgttggagaggctgaaaagattgggctcgagtacatggatgttgagggtttgaaaaaacttaacaagaataaaaaacttgttaagaagcttgccaagaagtatcatgctttcctggcatctgaagcagttatcaaacagattccccgtcttctgggccctggtcttaacaaggcaggtaaatttcctacacttgtcagtcaccaggaatccttggagtcaaaagtgaatgaaataaaagccacagtgaagtttcaactcaagaaggttctctgcatgggtgtcgctgtgggtaatttggacatggaagagaagcaaatttttcagaatgttcaaatgagtgtcaactttctcgtatcactgctgaagaagaattggcagaatgtgaggtgcttgtatctgaagagtactatgggaaggccgcagcgcatcttctgatcagttgtttttatttactttgttttaagatcagttcatttcgagtcaaaagagttggcagttgaatacacttttttgtggtcaaagcctagaatatttttgctttttttttt

SEQ ID NO: 1375 - DNA, 693 bp, Arabidopsis lyrata
tgtagtaagcttcagagtgaagccgtaagagaggcaatatcctccattatcactcactgcaaggagactaagccacgcaacttcactgagactattgaactccagattggtcttaagaactatgaccctcaaaaggacaagagatttagcggttctgttaaattgcctcacgttcctaggccaaagatgaagatttgcatgcttggagatgcccaacacgtcgaagaggctgagaagattggattggaatctatggatgttgaagctcttaagaagttgaacaagaacaagaaacttgttaagaagcttgctaagaaattccatgctttccttgcttcggaatctgtcattaagcagattcctcgtcttcttggtcccggtctcaacaaggcaggaaagttcccaactcttgtcagccaccaagagtctttggaatccaaagtgaatgagacaaaggcaacagtgaagttccagctcaagaaggttctttgtatgggagtcgctgtcgggaatctttccatggaagagaagcagatctttcagaatgttcagatgagtgttaacttccttgtttcacttctgaagaaaaactggcaaaatgtgaggtgcttgtacttgaagagcacaatgggtccaccgaaccgagttttctaaggtttttattacaaagtttctctaaggtatcatcacact

SEQ ID NO: 1376 - DNA, 1090 bp, Brassica rapa
gctcatataaagttacacaaacacttctctggccgttcttttctctgtctcctatctatcgcaaggtatactttcttcttcttcacttggtcacggctactcttcatcgtctctaaacgttccttgataaaaccttgttttgcaggagagactagtagctgaggaagtgccaaaatgagtaagctccagagtgaagccgtgaaggaggcgatatcaaccatcatcacccactgcaaggagacaaagcctcgcaagttcaccgagactatcgagctccagattggtctcaagaactatgaccctcaaaaggacaagaggtttagcggttccgttaagttgcctcacattccaaggcccaagatgaagatttgcatgctcggtgacgcccagcacgttgaagaggctgagaagattgggttagagtctatggatgtggaagctcttaagaagctgaacaagaacaagaagcttgttaagaagctagccaagaagttccatgctttccttgcttctgaatccgtcatcaagcagattccccgtcttcttggtcctggtctcaacaaggcaggaaagttcccaactcttgttagtcaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaagattattttatctctaaagtttctctcaaggtatcatcagggctgagaggagatttcgttttcatttctttcatgattaagattttgtttaaagacagttttatttatattattcctattactcttggtgaattttctctatttatgttagattaacccaatcttattacaaaataacggaataaaatcacaagaaaccaataaacagtgttttattatcataaatataaacaaaacattagatttcacaaagcgaaacaaa

SEQ ID NO: 1377 - DNA, 948 bp, Brassica rapa
ggctcatataaagttacacaaacacttctctggccgttctttctctgtctcctatctatcgcaaggagagactagtagctgaggaagtgccaaaatgagtaagctccagagtgaagccgtgaaggaggcgatatcaaccatcatcacccactgcaaggagacaaagcctcgcaagttcaccgagactatcgagctccagattggtctcaagaactatgaccctcaaaaggacaagaggtttagcggttccgttaagttgcctcacattccaaggcccaagatgaagatttgcatgctcggtgacgcccagcacgttgaagaggctgagaagattgggttagagtctatggatgtggaagctcttaagaagctgaacaagaacaagaagcttgttaagaagctagccaagaagttccatgctttccttgcttctgaatccgtcatcaagcagattccccgtcttcttggtcctggtctcaacaaggcaggaaagttcccaactcttgttagtcaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaagattattttatctctaaagtttctctcaaggtatcatcagggctgagaggagatttcgttttcatttctttcatgattaagattttgtttaaagacagttttatttatattattcctattactcttggtgaattttctctatttatgttagattaacccaatcttattacaaaataacggaataaaatcacaagaaacca

SEQ ID NO: 1378 - DNA, 843 bp, Brassica napus
ggttctttctctgtctcctatctatcgcaaggagagactagtagctgaggaagtgccaaaatgagtaagctccagagtgaagccgtgaaggaggcgatatcaaccatcatcactcactgcaaggagacaaagcctcgcaagttcaccgagactatcgagctccagattggtctcaagaactatgaccctcaaaaggacaagaggtttagcggttccgttaagttgcctcacattccaaggcccaagatgaagatttgcatgctcggtgacgcccagcacgttgaagaggctgagaagattgggttagagtctatggatgtggaagctcttaagaagctgaacaagaacaagaagcttgtcaagaagctagccaagaagttccatgctttccttgcttctgaatccgtcatcaagcagattccacgtcttcttggtcctggtctcaacaaggcaggaaagttcccaactcttgttagccaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaatattattttatctctaaagtttctctcaaggtatcatcagggctgagaggagatttcattttcatttctgtcatgattaagattttgtttaaagacagttttatttatattattcctattactcttggt

SEQ ID NO: 1379 - DNA, 915 bp, Brassica napus
gtcacggctactcttcatcggctctaaacgttcgttgataaaaccttgttttgcaggagagactagtagctgaggaagtgccaaaatgagtaagctccagagtgaagccgtgaaggaggcgatatcaaccatcatcactcactgcaaggagacaaagcctcgcaagttcaccgagactatcgagctccagattggtctcaagaactatgaccctcaaaaggacaagaggtttagcggttccgttaagttgcctcacattccaaggcccaagatgaagatttgcatgctcggtgacgcccagcacgttgaagaggctgagaagattgggttagagtctatggatgtggaagctcttaagaagctgaacaagaacaagaagcttgttaagaagctagccaagaagttccatgctttccttgcttctgaatccgtcatcaagcagattccacgtcttcttggtcctggtctcaacaaggcaggaaagttcccaactcttgttagccaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaatattattttatctctaaagtttctctcaaggtatcatcagggctgagaggagatttcattttcatttctgtcatgattaagattttgtttaaagacagttttatttatattattcctattactcttggtgaaaaaaaaaaaactaaacagatctcacgagacacacggaggagtgc

SEQ ID NO: 1380 - DNA, 906 bp, Raphanus sativus
gggttctctctctctgtctccgatctatcacaaaggagagaatagaggaagtgccaaaatgagtaagctccagagtgaagcagtgagagaggcgatatcgtcaatcatcactcactgcaaggagacaaagcctcgcaagttcaccgagacaatcgagctccagattggtcttaagaactatgaccctcaaaaggacaagaggtttagcggttccgttaagctgcctcacattcctaggcctaagatgaagatttgcatgctcggtgacgcccagcacgttgaagaggctgagaaaattgggttagagtctatggatgtggaagctcttaagaagctgaacaagaacaagaagcttgttaagaagctagctaagaagttccatgctttccttgcttctgaatcggtcatcaagcagattccccgtcttcttggtcctggtctcaacaaggcaggaaagttcccaactcttgtcagccaccaagagtctttggaatccaaagtgaatgagacaaaggcaacagtgaagttccagctcaagaaggttctttgcatgggtgtcgctgttggaaatctcggcatggaggagaagcagatcttccagaatgttcagatgagcgtcaacttccttgtttccctcttgaagaaaaactggcaaaatgtgaggtgcttgtacttgaagagcacaatgagtccacccacccgtgttttctaagatttttgttttatcttttaaggtatcataagaaatttgattttcttttgtcatgagccttcttcttcttcttggattacttccagaactctgtaggatgatcaagattttgtttaaagacatttttatttttactattgttattgctctttggttggtgttctctatttatctactcaatcttattattacca

SEQ ID NO: 1381 - DNA, 899 bp, Raphanus sativus
gttctctctctctgtctccgatctatcacaaaggagagaatagtagctctcaggaagtgccaaaatgagtaagctccagagtgaagccgtgagagaggcgatatcgtccatcatcactcactgcaaggagacaaagcctcgcaagttcaccgagacaatcgagctccagattggtcttaagaactatgaccctcaaaaggacaagaggtttagcggttccgttaagctgcctcacattcctaggcctaagatgaagatttgcatgctcggtgacgcccagcacgttgaagaggctgagaagattgggttagagtctatggatgtggaagcacttaagaagctgaacaagaacaagaagcttgttaagaagctagctaagaagttccatgctttccttgcttctgaatctgttattaaacagattccccgtcttcttggtcctggtctcaacaaggcaggaaagttcccaactcttgttagccaccaagagtctttggaatccaaagtgaatgagaccaaggcaacagtgaagttccagcttaagaaggttctttgcatgggtgtcgctgttggcaatctcggcatggaagagaagcagatcttccagaatgttcagatgagcgtcaacttccttgtttccctcttgaagaaaaactggcaaaatgtgaggtgcttgtacttgaagagcacaatgagtccacccacccgtgttttctaagatttttttgttttatcttttaaggtatcataaaagaaatttgattttctttttgtcatgagccttcttcttcttcttggattacttccagaactctgtaggatgatcaagattttgtttaaagacatttttatttctactttgttggtgttctctatttatctactcaatcttattatta

SEQ ID NO: 1382 - DNA, 683 bp, Secale cereale
tgagtaagttgcagagcgacgccctgagggaggcaatcacaaacattatcaatgactgccgtgagaagaaccgcaagttcgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcagggaaaatgggcctagactgcatggatgtggaatcccttaagaagatgaacaaaaacaagaagctggtcaagaagcttgcgaagaagtatcatgctttccttgcatctgaggctatcattaagcagattccccgacttcttggacctggtcttaacaaggcaggaaagtttccaacgttggtgtctcaccaggaatcccttgagtccaaggttaatgagaccaaggccacagtcgaagttccagttgaagaaggttctttgcatgggtgttgccgttggccacctgggtatggaggagaagcagatcttccagaacgtgcagatgagcgtgaacttcctcgtctctctgttgaagaagaattggcaaaagtgagatgcttgtacctgaagagcacgatgggaaaggtgtaccggttgttctagactatagtcttctaggatttccaggagattgac

SEQ ID NO: 1383 - DNA, 821 bp, Cryptomeria japonica
  misc_feature (111)..(111): n is a, c, g, or t
gacacgagcaggggtttcggtgcggcagtaacaaggatgagtaagcttcagagtgatgtgttgagggaggcgataacaggactggtggcagacagcaaggaaaaaaagagnaagtttgtggagacgatagagctgcagataggtttgaagaactatgacccccagaaggacaagcgcttcagtggctccgttaagctcccccacatccctcgccccaagatgaagctctgcatgcttggggatgcccagcatgttgaagaggctgagaaaataggtctggactatatggatgtggaaggattaaagaaaatgaacaagaacaagaaactggttaagaagcttgcaaagaaatatcatgcttttcttgcatcagaagcaattattaagcagattcctcgacttcttggtcctggtctaaacaaggcaggtaaatttcccactttggtgtcacatcaagagtcattggaggggaaagtaaatgaaaacaaagctacgatcaagttccaattgaagaaagttctctgtatgggtgttgctgtgggtaactgtggcatggaggaaagcaaatatttcagaatgtccagctgagtgtcaactttctggtatccttgcttaagaaaaactggcaaaatgtacgttgcctttatctgaagaccaccatgggcaagccatctcggatattctaatctaatactgcaattagtttcagcttttgttcagtgaactttgagatttgtattgttttgttcatttaatgtatgaggttcaaacagtatatttataaagaattttgcatttgatttgggtttaacccttttttt

SEQ ID NO: 1384 - DNA, 774 bp, Salvia sclarea
ctactagaccttggctgtcactcaattgcagccaccgtctcaccacccctgctctagggattttcttcagtgattcgggcagctaattgaccgtgaacgatgagtaagcttcagagtgaggcgctgagggaagccatcactgtgattgttaaagaagctaatgagaagaagcgcaacttcactcagactgttgagctccagattgggctcaagaactatgacccccaaaaagacaagcgtttcagtggctctgtgaggttgccccacattcccagacccaaaatgaaactctgcatgcttggagatgcccagcatgtcgaggaggctgagaagattggccttgagtccatggatgtggaagcactgaagaagctcaacaagaacaagaaacttgtgaagaagctagcaaagaggtaccatgctttcttggcatcagaagcagttattaagcagattccacgtctcttgggacccggtcttaacaaggcaggtaagttccctactctcgtgactcaccaggagtcccttgaagccaaggtgaacgagaccaaggccactatcaagttccagttgaagaaggtgctgtgcatgggtgtagctgtgggaaacctcgacatggaggagaagcagatcttccaaaacgtgcaaatgagcgtcaacttcctcgtttctcttttgaaaaagattggcaaaacgtgaggtgcttgttcttgaagagcacgatggggaggcctcaacgtattttctaagcagtttataaacttttgttattga

SEQ ID NO: 1385 - DNA, 984 bp, Cannabis sativa
atctttcataaaaaccctagctaccattgtcatctcctctcttctccttttataataaaagtttgtttcagtcggcactctaaaccctacctctcctccatcaacatccatatctgggtactattttctcggagagagaaagtatgagtaagctgagtagtgatgctgtgagagagggcatagctcagattgttatcaactcgaaagagaagaatcgtaagtttactgaaaccattgagcttcaaatcggtttgaagaactatgacccccaaaaagacaagcgtttcagtggctctgttaagcttcctcacattcctcgtcctaagatgaagatttgcatgttgggggatgctcaacacgtggaagaggctgtgaaaataggattggactatatggatgtggagggattgaaaaagcttaacaagaacaagaaacttgtgaagaagcttgccaagaagtttcatgcttttttggcttctgaagctgttattaagcaaattcctcgtcttctgggtcctggactcaacaaggcaggtaagtttccaacattggttacccatcaggagtctttggaggcaaaggtcaatgaaaccaaagccatggtgaagttccaacttaagaaggtgctttgtatgggagttgctgttggaaatttatccatggaggagaagcagatctttcagaatgtgcaaatgagtgtcaattttctagtgtcactattgaagaagaattggcaaaatgtgaggtgcttgtatttgaagagtaccatgggaagtgcaatccgtatcttttaagttaacgtatgcaaactaaaatttaattaagcaagacatttttgttttgagattattgcttcattaaagttgcaattttgtttttgttggattcattcgtccagtttgtaattttgacattaagattttgtggcttctaaaggagaattagcttatctttctttatttcatttcacaccaacttagccat

SEQ ID NO: 1386 - DNA, 1078 bp, Cicer arietinum
gatttcgagcggccgcccgggcaggtctcagatcgattggcgtttccagaggccaactatccaatatgagtaagcttcagagtgatgctttgagagaagccatctcaggaatcacggctgattccaaggagaaaaacaggaaatttgtggagactattgaactccagattggtcttaaaaactatgatccacaaaaggataagcgtttcagtggttctgttaaattgcctcacattcctcgtcccaagatgaaaatctgtatgcttggagacgctcagcatgttgaggaggcagagaaaataggattggactggatggatgttgaagctttgaagaagctaaacaaaaataagaaattggtgaagaaacttgcaaagaagtaccatgcctttttagcttctgaagctgtcatcaagcagattcctcgtctcctgggtcctggtctcaacaaggcaggaaagttccctgcccttgtttcccaccaagaatctctcgagtctaaggtcaatgagactaaggctatggtcaaattccagcttaaaaaagtgctctgcatgggagtagctgttggcaatgtcagtatggatgaaaaacaaattttccaaaatgtacaactgagtgttaacttccttgtctccttgttgaaaaagaactggcaaaatgttaggtgtttgtatctgaagagttccatgggcaaatcttaccgtgtcttttaaagggtttcgaaatcgagtgaatttgggattgctcttggtattttggtcattttagtaactgagacaggagttctcttctatctacagttttgttggactatattttgtcgttagtatttgtgttatttactgtattgcttagcaacttcgggcccttgtttttacatatacagctttttgactacttctctcatgatgcatattttttatgactacttctctatatctaagtctatagaaagcacttcccgattgtccaattagcagcttattacatgtcaatgtataatctgcatttcgtagagctttaacttgggaggaaaatagtgtttataataatttaaggtatcatagattctatt

SEQ ID NO: 1387 - DNA, 1055 bp, Cicer arietinum
tttttctcatttcggtaatttgtcaactcagaattgttatatttggattttctcatactaatttgtgtttttgttacatcaaattttattcaccgtttgaagaggcaatgagtaagcttcagagtgatgctttgagggaagcaatctcaggaatcacggctgattccaaggagaaaaaccgtaaatttgtggagactattgaactccagattggtcttaaaaactatgatccacaaaaggataagcgtttcagtggttctgttaaattgcctcacatccctcgacccaagatgaaaatctgcatgcttggtgatgctcagcatgttgaggaggcagagaaaatcggactggactggatggatgtagaagccttaaagaagctcaacaaaaataagaaactggtgaagaaacttgcaaagaaataccatgcctttttagcttctgaagctgtcatcaagcagattcctcgtcttttgggtcctggtctcaacaaggcaggaaagttccctgcacttgtttcccaccaagaatctcttgagtctaaggtaaatgagaccaaggctatggtcaaattccaacttaagaaagtgctctgcatgggagtagctgtcggcaatatcagtatggatgaaaaacaaatcttccaaaatgtacaactgagtgttaacttcctcgtctctttgttgaaaaagaactggcaaaatgttaggtgcttgtatctgaagagttccatgggcaaatcttaccgtgtcttttaaagggttgtttttaattatgcgaatttggtattgcgcctaatatattggatattttaacagctgggacaagagttctcttctttttacagttttgttggttgagattatgtcgttagtattctgtgtttttgactggtgtttaattgcttagcaactttgcataatgttagggatgctaaatttaattccccagtttatttatacagctttttacccacttctcctgtgatgcatattatgacgatttctatctatgtctatggtaaaaatatcatgattagtaacaaaaaatacgta

SEQ ID NO: 1388 - DNA, 905 bp, Fagopyrum esculentum
gggttcgactcatcatctagggttgtctcagggtgacattcgtttatcttggacaaaaccgagtagtcgccatgagtaagctttcaaatgaagctttaagagaggcagttggcagcattaagaaggatgccactgaaaagcaaaagaagtttacggaaaccattgaacttcagattggtttgaagaattacgacccacaaaaagataagcgtttcagtgggtctgtcaagcttccccatatccctcgtcctaagatgaaggtctgcatgcttggagatgcccagcacgttgaagagtctgagaaaatgggcttggactccatggacgttgaagctcttaagaagttgaacaaaaacaagaagcttgttaagaagcttgccaagaaatatcatgcctttttagcttctgaagctgtcatcaagcagatcccacgtttgcttgggcctggtcttaacaaggcaggaaagttcccgactctagtttcacatcaggaatctttggagtcgaaagtgaatgaaatcaaagcaacagtgaagttccagctgaagaaggttctttgcatgggtgttgctgtcggaaactgtggcatggaggagaaacaaatcttccagaatgtgcagatgagtgtcaatttccttgtttcattgttgaagaagaattggcaaaacgtccgctgcttgtacctgaagagcacaatgggaaagccataccgtatcttttaagctatatccagttttgatttggttttgcagtgaggattggcaattttctgttggttggtctatttgtacttcaattgagcctggacttctgaaatattgggttttctttggactctcgagtagttgatacatttctcaatttatcatagcctttgatctatagagtattgattcttccatctc

SEQ ID NO: 1389 - DNA, 902 bp, Amaranthus tuberculatus
ttttcgtttttgctccatttcaagccgcaatcatgagtaagcttcagagtgaagctgtcagagaggctattactgggattaaaactgactccgcagagaaaggtcgtaagttcactgagacaattgagctccaaattgggctcaagaactatgacccccaaaaggataagcgtttcagtggttctgttaagttgccacacatcccccgtcccaagatgaaagtttgcatgctgggagatgcacagcatgtggaagaggctgagagaataggtttggagtggatggatgtagaggcattgaaaaagctgaacaagaacaaaaagttggtgaagaaactggcaaagaagtatcatgctttccttgcctcagaagcagtcatcaagcagattcctcgattgcttggtcctggtcttaacaaggcaggtaagttccccacccttgtcacccatcaagagcccttggaaaacaaggtgaatgagatcaaggcaacagtcaagttccagctgaagaaggttctctgcatgggtgtggctgtcggtaactgtagtatggaagagaagcaggttttccagaacgttcaaatgagcgtcaatttcctcgtttcattgttgaagaaaaattggcaaaatgtccgatgcttgtacctgaagagtaccatgggcaagccataccgcattttctaagtgttgttacgattttgcttgctttctaggagccgaggttttgttggttttgtagagtactttatttaagcgctagtatactcaaattatcacttttgaatttgaatttaatgtcggaatattttctgcgtagtttctttgttatttgcaacttggattctattttcggaaggtttatttgccgtcaatgcttgattttaaattttaatacaaaaaaaa

SEQ ID NO: 1390 - DNA, 1003 bp, Cichorium intybus
ccctttaagggctttgggctcagataagcccctgaaaccctagctcaagtattgggtatttagggttttgcgattcggccaatcacccttcttggtctggtagcggctgcaatcgaattgctacaggcggaggagccgtgcagaggggaaatccttcaccatgagtaagttagcaagtgaagctgtcagagaagccatcacccagattacaaccgatgccaaggagaagaaccgtaagtttacagagaccattgagctccaaattggtttgaagaactatgatccccaaaaagacaaacgtttcagtggcacagtgaagcttccacacattcctcgccctaaactcaaggtctgcatgcttggtgatgctcaacatgttgaagaggcacagaagataggattggaatacatggatgttgaaggattgaagaagcttaacaaaaacaagaaattggtaaaaaagcttgccaagaaacaccaagcttttctagcatctgaatctgtcatcaagcaaattccccgtctcttaggccctggtctcaacaaagcaggaaagtttcctacacttgtgtcacatcaggagtcattggagtcaaaagttaatgaaacaaaagcaacagtgaagtttcagcttaagaaggttctgtgcatgggtgttgctgtgggaaattgcagcatggaagagaagcaaatcttccagaatgttcaaatgagtgtcaattttctcgtttcgttattgaagaaaaactggcaaaatgtgaggtgcttgtacttgaagactaccatggggaagcctgtacgtgtcttttagtaagatgagaattatgattcttgatatctgtctacaaatgcttcagtatttaggctttgaacaatttaattgtcgtgtttctcatcatcaaatggaaacagtaattttgttagtctttagatttggaatgtactgcgagaatatgaaaatcatccatgcttgtgaaatgttgagtttttgtgtttttctttc

SEQ ID NO: 1391 - DNA, 937 bp, Solanum melongena
agcactgaactgagccaaccttcgtctctcttacggcgctcacaaacactaattagggtttactcatacagaagtgaaattttgaaggagaaaggagaagtatttaagccatgagtaagcttcagagtgaggctcttagagaagccatctctgtaattaagaatgattcagctgagaaaaaaagaaagttctctgagactattgagctccagattgggcttaagaactatgatccccaaaaggacaagcgttttagtggatctgttaagttgcctcatattccacgccctaagatgaagatttgcatgctcggagatgctcagcacgtggaggaggcagaaaagattggtttggagtacatggatgttgagagcctcaagaagcttaataagaacaagaagttagttaagaagcttgcaaagaaataccatgctttcttggcttcagaatctgtcatcaagcagattcctcgtctcttgggtcctggcctgaacaaggcaggtaagtttccaacccttgtttcccaccaggagtcacttgagtctaaggttaacgaaaccaaggctaccatcaagttccagttgaagaaagtgctttgcatgggtgttgccgttggtaattgtgatatggaggagaaacaaatcttccagaacgtgcaaatgagtgtcaacttcttagtgtcgttgctaaagaagaattggcagaacgtaaggtgcttgtacttgaagagcaccatgggcaagactcaacgtatcttttaagacaaacgtctcgttactggagcttttcgtgcattctgtaagagagatactaatgaaaattttggatagttaatcatccttgaatatgttttgaatgttacatcactatatggatcgatcatatttccgagacacttttctgttttttcaagcgatattagctctgttctttgttc

SEQ ID NO: 1392 - DNA, 907 bp, Solanum melongena
atcatcggcgcttacaaaccctaaatcaagggttttatcttacaggtgagtttgaaggagaacgagagatttttcagccatgagtaagcttcagagtgacgccctcagagaagctatctctgttattaagaatgaatcagcagagaagaaaaggaagttcagcgagaccattgagctccagattggactgaagaactatgatccccaaaaggacaagcgtttcagtggatctgtgaagttaccacacattcctcgccctaagatgaagatctgtatgcttggagatgctcagcatgttggggaggcagaaaagatcggtttggagtacatggatgttgaagggttgaagaagcttaacaagaacaagaagctggtcaagaagcttgcaaagaaataccatgctttcttggcttcagaatctgtcatcaagcagattccccgtttgttggggcctggtctgaacaaggcaggtaagtttcccaccctcgtttcgcaccaggagtcgcttgaatccaaggttaatgaaaccaaggccacaatcaagtttcaattgaaaaaggtgctctgcatgggtgttgctgttggaaacatggatatggaggagaagcagatcttccagaatgtgcaaatgagtgtcaattttcttgtttcattgctgaagaagaattggcaaaatgttaggtgcttgtacttgaagagcaccatgggaaagccacaacgtatcttttaagaagatttctgtttctgtcgttggaaattttcaggctttctggttgtgtgagctatagacactcttgaaaattttgggtagttgttattcttgtttcttgttttgaatttctatataaactatttttagagttatgtttgccttagacgtctcttcgttaatgagaatgatgttatc

SEQ ID NO: 1393 - DNA, 711 bp, Eschscholzia californica
gttgtcgttctgttagggtagaaatctgtagtgggtttcacggaaatcgttaaccatgagtaagcttcaaagtgaagttctaagagaagcaatcacccaaatcacagctgatgctaaggagaaggcaagaaagttcactgagacagttgagctccagattggtcttaagaactatgaccctcaaaaggacaagcgtttcagtggttcagtgaagttgccacatatcccccgccctaagatgaaagtgtgcatgcttggagatgctcaacacgtcgaagaggcagagaaaattgggctagactacatggatgtcgaaggattgaagaagcttaacaagaacaagaaattggtcaagaagcttgcaaagaagttccatgcttttctagcatctgaagctgtcattaagcagattcctcgtcttctcggccctggtctcaacaaggcaggaaaatttccaacacttgtgagtcaccaagaatcattggaagccaaagttaacgaaaccaaggctatggtgaagtttcaactgaagaaggttctctgcatgggtgttgctgtgggtaacctcggaatggaagagaagcagatcttccaaaatgtgcaattaagtgtcaacttccttgtatcattgttgaagaagaattggcagaatgtgaggtgcttatacttgaagagtacctgagacacgcaacaggggggtaggcaaggcac

SEQ ID NO: 1394 - DNA, 959 bp, Capsicum annuum
gcacgaggcaaaccctaatcgcaagggtttctcttacaggtgagtgtgaaggagaagagagatttttgagccatgagtaagcttcagagtgaggccctcagagaggctatctctgtgattaagaatgagtcagcagagaagaaaaggaatttcagtgagaccattgagcttcagattggattgaagaactatgatccccaaaaggacaagcgtttcagtggatctgttaagttgccacacattcctcgtcccaagatgaagatctgtatgcttggagatgctcagcatgttggggaggccgaaaagattggtttggagtacatggatgttgaaggcttgaagaagcttaacaagaacaagaagctggtcaagaagcttgcaaagaaataccatgctttcttggcttcagaatctgtgatcaagcagattccccgtttgttgggacctggtctgaacaaggcaggtaagtttcccacccttgtttcacaccaggagtcacttgaatccaaggttaatgagaccaaggccacaatcaagtttcaattgaaaaaggtgctttgcatgggagttgctgttggaaacatggatatggaggagaagcagatcttccagaacgtccaaatgagtgtcaattttcttgtgtcattgctgaagaagaattggcaaaatgttaggtgcttgtacttgaagagcaccatgggaaaaccacaacgtatcttttaagaagatttctgtttctgtcgttggaaattttaaggctttctggttgtgagctattatagacactcttgaaaattttgggtagttgccatttttgttatcttgttttggatattatcaaactattagggatatgtttgctttcgactccctttaatgattccagtagcatccaagatgccaattgcgttactgtaaaaaaaagagagagagagagagagagagagagagcctcgtgc

SEQ ID NO: 1395 - DNA, 842 bp, Capsicum annuum
gcacgaggacagctcttacaaaccctagaaaaatatttttgagccaatgagtaagcttcagagtgaggctgttagagaagccatctctacaattaagaatgattctgctgagaaaaaaagaaagttctctgagactatcgagctccagattgggcttaagaactatgatccccaaaaggacaagcgtttcagtggatctgtgaagttgcctcacattccacgccctaagatgaagatttgcatgctcggagatgctcagcatgtggaggaggcagaaaagatcggtttggagtacatggatgtcgagagtctcaagaagcttaataagaacaagaagttagttaagaagcttgcaaagaaataccatgctttcttggcttcagaatccgtcatcaagcagattcctcgtctcttgggtcctggtttgaacaaggcaggtaagtttcctacccttgttacccaccaagagtctctcgagtctaaggttaacgagaccaaggctaccatcaagttccagttgaagaaggtgctttgcatgggtgttgctgttggaaattgcgatatggatgagaaacaaatcttccagaatgtgcaaatgagcgtgaatttcttagtctcgttgctaaagaagaattggcagaacgtaaggtgtttgtacttgaagagcaccatggggaagactcaacgtgtcttttaagacacgatcgtctcacttttggagctttcggttcattcttgtaagagaatacttctgaaatttttggatagtagtcatcctcaggtgtcctatattgttgagacgaattctttttgcaagcgatattagctctgttctttgttct

SEQ ID NO: 1396 - DNA, 868 bp, Raphanus sativus
  misc_feature (820)..(820): n is a, c, g, or t
aaggctttcctctgcttcacctttcaggttcagagattcgtcaactgagagaaactcaagatgagtaagcttcagagcgaggctcttagagaagccatcacgaccatcaagggcaaatccgaggagaagaagcgtaactttactgagactattgagcttcagattggtctgaagaactatgacccacaaaaggacaagcgtttcagtggatccgtcaagctccctcacattcctcgtcctaagatgaaggtctgcatgcttggagatgctcagcatgttgaggaggctgagaagatgggactagactctatggatgttgaggctttgaaaaagctcaacaagaacaagaagcttgttaagaagcttgccaagaagtaccatgctttcttggcttctgagtccgtcatcaagcagattccccgtcttcttggtcctggtcttaacaaagcaggaaagttcccaacactggtgagtcaccaagagtccttggaagggaaggtgaacgagaccaaggctacggtgaagttccagctgaagaaggttctgtgtatgggtgttgctgttggtaacctttccatggaagagaagcagctcttccagaatgttcagatgagcatcaacttccttgtctcgctcttgaagaagaattggcaaaacgtgaggtgtttgtacttgaagagcaccatgggaccaccacagagaatcttttgagttctcgactcttgtcatcttggaacttttgctttgtggtttttgtttgcttcagagatcttgagttatggttttgtttgatattagcagaactgaggtgttagtttgntttttgttaagacattataatatgcaatgttggattttacaatatcga

SEQ ID NO: 1397 - DNA, 1198 bp, Setaria italica
cccgcatccgacggttggcgccttgacacgcggcatccatcgggagctcgctctagggttttcgttcgtctcgctcccaccgctcatataactcccggcgccgccacttccctccgcttctcttcctctcgctcgctccgtcgcccgccgcgcgccagaccctaacaagggagctgagtgaccggttgcagccatgagtaagttgcaatctgaggttctcaaggaggccatctcccagatcgttggggattccaaggagaagaataggaagttcaccgagacagttgagcttcagaattggtctgaagaacttatgacccgcagaaggacaagcgtttcagtggctccgttaagctgccccacatcccccgcccccaagatgaaggtgtgcatgcttggtgatgcccagcacgttgaggaggctgagaagattggacttgactacatggatgttgaggctctgaagaagatgaacaagaacaagaagcttgttaagaagcttgccaagaagtaccatgctttcttagcatcagaggccatcatcaagcagattccccgtctccttggtcctggtctcaacaaggcaggcaagttccctacactggttacccaccaggagtctcttgaatccaaggtgaacgagacgaaagctacagtcaagttccagctgaagaaggttctttgcatgggtgttgctgttggtaacctgtcgatggaggagaagcagatccagcagaacatccagatgagcgtcaacttccttgtgtcccttctgaagaagaattggcagaatgtgaggtgcctgtacatcaagagcactatggggaagccgtacagggtgttctaagtcttgccgtgatccttgtgaagttgataaaaaaatactaggacgtcgaactgggcttgtcttaaacttagatatgtacccatcagttttgtgcctgtcaatgagaatgtcgaagtatctggtccaatctagtgtttcctttaatagaacatgtggaggaatgccttttgggattatgcagtcgcagcttgtgttatggttcttttgccacccctttgtctcttattagctgctctgcagtcttgatatcattggctattggcataccgagtgctttcgtatgcatggttttatctgaaaacaggccatcagttctgaaattgtcggagttgtggattaattggcttcgtt

SEQ ID NO: 1398 - DNA, 903 bp, Secale cereale
cgtcccacccgcccggccggcgactgagaagttaggcagagcgaagccctgagggaggcaatcacaaacattatcaatgactgccgtgagaagaaccgcaagtttgttgaaaccattgagctgcagattggtctgaagaactatgacccgcaaaaggacaagcgtttcagtggttctgttaagcttcctcacatccctcgcccaaagatgagggtttgcatgcttggtgatgcccagcacgttgaagaggcaggaaaaatgggcctagactgcatggatgtggaatccctcaagaagatgaacaaaaacaagaagctggtcaagaagcttgcaaagaagtatcatgctttccttgcatctgaggctatcattaagcagattccccgacttcttggacctggtcttaacaaggcaggaaagtttccaactttggtgtctcaccaggaatcgctcgagtccaaggttaatgagaccaaggccacagtcaagttccagttgaagaaggttctttgcatgggtgtggccgttggccacctgggtatggaggagaagcagatcttccagaacgtgcagatgagcgtgaacttcctcgtctctctgttgaagaagaattggcaaaacgtgagatgcttgtacctgaagagcacgatgggaaaggtgtaccggttgttctagactctagtcttctaggatttccaggagattgacaacttgggaacttttgttgctttctcaattattatcaaattttcgtgcgtgccagtgacagttaaacagttgcaactattgtcttgtactgagatggtttgttctattgtctggaatttcatgacattttatccttttgcccctttgccttactgattgatgcttgctgtcaatcagtttaacactagattcagc

SEQ ID NO: 1399 - DNA, 748 bp, Antirrhinum majus
  misc_feature (22)..(22): n is a, c, g, or t
  misc_feature (672)..(672): n is a, c, g, or t
aggtgaagacttgagcggcgcngttcttagctctcactttcccagaaagtgaattgggaagactagaagaacttgaaccatgagtaagcttcagagtgaagccttgagggaagcaatcacggttattgcagcggatgccaaggagaagaagcgcaacttcacccagactattgagctgcagattggactaaagaattatgatccccaaaaggacaagcgtttcagtgggtccgtgaagttgccccatatcccaagaccgaagatgaagatctgcatgcttggcgatgctcaacatgttgaagaggcagcgaaaattggcctggaatccatggatgttgaggctcttaagaagttgaacaagaacaagaaattggtgaagaagcttgcaaagaaatatcatgctttcttagcttcagaagcagttatcaaacagattcctcgtctcctaggacctggtcttaacaaggcaggtaagttcctactctcgtctctcatcaggaatcactcgagtcgaaggtgaatgagactaaggcgacagtcaagtttcagttgaaaaaagtgctttgcatgggagttgctgttgggaaccttgacatggaggagaagcaaatctttcaaaatgtgcaaatgagcgtcaactttctcgtatctcttctgaaaaagaactggcanaatgtgaggtgcttattcttgaagagtacaatggggaagccacaacgcatcttctaagaagctattctgatttttc

SEQ ID NO: 1400 - DNA, 1050 bp, Setaria italica
ttgcctccctcagagcgtcgctctgcaacttactcatggcgccgcctccccctacctcgaggaacgctgctcgcaccagcaccaccggcgccatgagtaagttgcagagcgacgctctgagggaggcaattgcctcagttaccaatgactcccgtgaaaagcagcgcaagtttgtcgaaaccattgagctacagattggactgaagaactatgaccctcaaaaggacaagcgtttcagtggttctgttaagctgcctcacatccctcgccctaagatgaaggtttgcatgcttggtgatgctcagcacgttgaggaggcagggagaataggtctggacagtatggatgtggaagccctcaagaagatgaacaaaaatagttaagaagctcgcaaagaaataccatgctttccttgcatctgaggccatcattaagcaaattcctcgtcttcttggacctggtcttaacaaggcaggaaagttccctactttggtgtctcatcaggaatcccttgaatccaaggttaatgagactaaggctacagttaagttccagctgaagaaggtgctttgcatgggtgttgctgttggcaactgcggcatggatgagaagcaaatcttccagaatgtgcaaatgagcgtcaacttccttgtgtcactcttgaagaagaattggcagaatgtgagatgcctgtacctgaagagcactatgggaaaggtgtaccggttgttctaaatctttctcttaggcttgtagaatttccaggagactttactgggggactttgctattttctctaccaccaattttttgtgcaactattgaggattaaggtgttaaatccccattgtcttgtgcgagatgttttcgttcttgatatcgaacctatggtaatatcttatttcaacatttttgtcgctgcctaagctcaattcctgtggtctattgcccctttttttcacctcggctgtatgcccgtatagttcttcgctgatgtttctaagttccattggaatgctgcattatatcatttggtttgaccattgttgc

SEQ ID NO: 1401 - DNA, 1820 bp, Amborella trichopoda
ataaatgcaggcttcgagagaaggagagagaggcttggcctctctttttgagcgttccaaaacgaagaaaatatatatatatatatatatctattttttttatctaaggccttgtgatgatgggtaaatcctgcccatgatggattgcgttaatcatgaagaacacaaagtttccatgatccgcgaaaacgaaaaagcacgaaacattcatatggcaagacgaccatcgattcttaaacaacctatattttatacatttaacaattatacacttcgtacttgtccctttgttctctctctaaaacaatttctctctcctctccagtcccttcgcaattaaaaccctattttgctctctctggccaataaaaccgtactttatcttctctcaacgctgatctatatcgcagatacaggaaggagaaacttaccgattgcatgtacaggaccttttgttaaagccagaaagggaattccagaggtgccgtgatgagtaagctgcagagtgatacattgagggaggtgattagcaaggtggtaggtgatgccaaaagaaagccacgtaagttcaccgagaccattgaacttcaaattgggttgaagaactatgatccccaaaaggacaagcgcttcagtggatcagtcaagctaccccatattcctcgccctaagatgaaactatgcatgctcggagatgctcaacatgttgaagaggctgagaagatgggattggattatatggatgttgaagggttgaagaagatgaacaagaataagaagctggtgaagaaactcgccaagaaataccacgcctttcttgcatcagaagcagtcatcaagcagatcccaaggcttttgggtcctggtcttaacaaggcagggaagtttcctaccctggtttctcaccaggaatcactggaggcaaaggtgaatgagacaaaggccattgtcaaattccaacttaagaaggttctctgcatgggggttgctgttggcaattgtgctatggaggagaagcaggtctttcagaatgtccaaatgagtgttaacttcttggtttcactgttaaagaagaattggcagaatgtgaggtgcttgtacctgaagagtaccatgggtagggctcacccactcttctaaattgggttttgttagataatcaggagaaaagacaattttgtatttcagcgaggtagtgtactatttctgtccctatctagcagaaagagtgaatctctctttttaatgttttctggttacatactgctgtctattcagatcctagaataacgtggctcagggtttatctattattttaaagaatttacacatgggaggtctcagcatattggtttactcttcattggggtttctagcttcaatgaccatccataatgaatgggttaaggttggttggttaagtccctggttaccaaactactgttatcttatactagccttgttattttagttagttcttgatcaacgagctgtttatcataaatggatggcttatagagagtgtttgggaacgcgtggaaacagtgtttcagggcttagtgcctccttttcccaaggcagtcaaggctccaaaatggaagggtgtttggggactatcaaaacactttctcgacttaatgtaaaaaccccaagaagagggctttttatcatatccccaagaagaggactttttatcatatcctccgaaatatttcaaaatgaacgtatctaattttcttgttcattacatgtgtgctcatttttttttatttttttatatgcccacattacaacctaattaggtccgaaaaaggctctat

SEQ ID NO: 1402 - DNA, 894 bp, Arnica chamissonis
tctaccgaaggcagtgagaggtgtaaggaaggaaaacctaacggaaaatgagtaagcttcaaagcgaagcccttagggaagccattactcaaattaccaccgatgctagagaaaagaaacggaattttactgagaccattgagcttcagatcgggctcaagaactacgaccctcaaaaggacaaacgttttagtggtactgtaaagttgcctcacattcctcgacccaagttgaaagtttgcatgcttggagatgcccagcatgtcgaagaggctcaaaagattggtcttgaatacatggatgttgaaggactcaagaagctcaacaagaacaagaagctggtgaagaagcttgccaagaaacaccaagcgtttttggcttctgaatccgttatcaagcaaattcctcgtttgttgggccctggtctaaacaaggcaggaaagtttccgacacttgtttctcaccaagaatcccttgaggctaaggtgaatgaaaccaaggcaacggttaagtttcaactgaaaaaggtgttgtgcatgggagttgctgttggtaactgcagcatggaggagaaacagattttccaaaatgtgcagatgagcgttaacttcctcgtttcattgctgaagaaaaactggcagaatgtgagatgtttgtacttgaagacaacaatgggaaagccagttcgcatcttctaggcgttccatcggttctttctttcaaatctgttgcgagctcagtactttgaagcattttcttttaataggtggtgtcggttttgatttatcggatgtttgtttttgtatcagatgatgctatgatcgttatgtttaatggttatagcgctgctgtctctgtattctttaaggataatatctgtttaaagccggtttt

SEQ ID NO: 1403 - DNA, 901 bp, Arnica chamissonis
gtcttaccagaggatcatttgatttatacttatgtttttgtagtacttgattattagcagaattgaagttaacgagaggaaaacttgccgaaaatgagcaagcttcaaagtgaagcccttagagaggcaattactcagatcactactgatgccaaggaaaagaaacgcaactttactgaaaccgttgagctccaaattggtttgaagaactacgacccacaaaaagacaagcgtttcagtggtaccgtcaaattgcctcacattcctcgtcccaagcttaaagtgtgcatgcttggagatgctcaacatgttgaagaggctcaaaaaattggtctcgagtatatggatgttgagggtctgaagaagctgaacaagaacaagaagttggtgaaaaaacttgctaagaaacatcaagctttcttggcttctgagtcagtcatcaagcagatcccgcgtttattgggccctggtctaaacaaagctggtaagttccccactcttgttagccaccaggaatctcttgaggccaaagttaacgagacaaaagcaacagtcaaattccaactgaagaaggtcctctgcatgggagttgctgttggtaactgcagcatggaagaaaagcaaatttttcagaatgttcaaatgagtgtcaattttttggtttctttgcttaagaagaattggcaaaacgtgcggtgcttgtacttgaagacaacaatgggaaagccagttcgcatcttttaaaaagttcatttgttatgttgtttaatgccgaggtcagtactggaaaacatattcccataatcctttttggctttttacatgcttgtttggttctctgctttagacattacatatttgttttggttttgttaacctctttggtagaaaagtttgaaaa

SEQ ID NO: 1404 - DNA, 871 bp, Brassica napus
gcgagaaactcaagatgagtaagcttcagagcgaggctcttagagaagccatcacaaccatcaagggcaaatctgaggacaagaagcgtaactttgtggagacggttgagcttcagattggtctgaagaactatgacccgcaaaaggacaagcgtttcagtggatctgtcaagctcccgcacattcctcgccctaagatgaaggtctgtatgcttggagatgctcagcacgttgaggaggctgagaagatggggctagactctatggatgttgaggctttgaagaagctcaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtccttggaagggaaggtgaacgagaccaaagcgactgtgaagttccagttgaagaaggttctgtgtatgggtgttgctgttggtaacctttccatggaagagaagcagctctttcagaatgttcagatgagcatcaacttccttgtctcgctcttgaagaagaattggcaaaacgtgaggtgtttgtacttgaagagcaccatgggaccaccacaaaggatcttttgagttctctactatttcatcttcgaacttttgcgttgtggtttttgtttgtttcagagatcttgagttatggttttgtttggtattagcagaactgaagtgttagtttgctttttgtcaagacattataatatgcattgttggattctaccatatcgactctccagttcaattttatctttatacaaattaaaaaaaaaacagtacgt

SEQ ID NO: 1405 - DNA, 870 bp, Cirsium arvense
aaggaaggaaaaatctatcaatcatgagtaagcttcagagtgaagccctccgtgaagccattacccagattactaccgatgctaaggaaaagaagaggaattttaccgagaccattgagctccagattggtctcaagaactacgacccacaaaaggataagcgtttcagtggtaccgtgaagttgcctcacatccctcgtcccaaattgaaagtttgcatgcttggagatgcccagcatgtggaagaggctcaaaagatcggccttgagtatatggatgttgaaggtctcaaaaagctcaacaagaacaaaaagctggtgaagaagcttgctaagaagcaccaggcttttttggcttctgaatctgtcatcaagcagatccctcgtttgttgggccctggtctaaacaaggctggaaaatttcctacccttgttacccaccaggaatcccttgaggctaaggtgaatgagacaaaggcaaccgttaagtttcagctgaaaaaggttctctgcatgggagttgctgtcggaaactgcagcatggaggagaagcagatcttccaaaacgtgcaaatgagcgtcaattttctcgtttcgttactgaagaagaattggcaaaatgtgaggtgtctgtacttgaagacaacaatgggaaagccggttcgcatcttttaaccggttcgcatcttttaggagttatcgttgtttctcagatttgttctgtttgaggtctagtacttggaagcatatgcctatatcggggtgcttatcgtttttgacttgttggatgttgggtttttatttttgttttagatactgctgttgccttgaacgattaaaaaaaaagaaaaaagaaaagtaaccgactgcg

SEQ ID NO: 1406 - DNA, 928 bp, Epimedium sagittatum
gggggtgaagctcggcggttgtagaagagctttggaaaacaaggaggatgagtaagcttcagagtgacgtgttaagagaatgtatcacaaaggtagttgaaaggtccagcactaagaagcgaaagttcacggagactattgagcttcagattggtctgaagaattatgatccccagaaggataagcgtttcagtggttccgtcaagttgccacatatccctcgtcccaagatgaaagtgtgcatgcttggagatgctcagcatgttgaagaggcagtgaagataggtttggagtatatggacgtggaaggtctgaaaaagctcaacaagaacaagaaactagtgaagaagcttgccaaaaagtaccatgcttttcttgcatctgaagctgtgattaaacagattcctcgtcttcttggtcccggtcttaacaaggcaggtaagttcccaacccttgtgactcatcaggaagccttggagtccaaagttaatgagaccaaggctatggtaaagttccaacttaagaaggttctttgcatgggagttgctgtgggtaacttgggaatggatgagaagcagatcttccagaatgtgcaactcagtgtcaatttccttgtgtctctgttgaagaagaactggcagaatgtaaggtgcttatatttgaagagttcgatggggaggccggaaagaatcttttgagccatctatattttgttactaaaactttcgcagtactagccttgaaacagtctgtttatttctttagtttcttatctatcttgggcggaatgctattttaaatttggaacaacctgagttttttagttgagttttagagacgtgagaaggaatctctcttattctggttaattttttttggagttgacgatgcaatctttcagatcgtttgcaagttctttagatgttca

SEQ ID NO: 1407 - DNA, 1099 bp, Eucalyptus grandis
gaaaccaagattgacagtgaaaccctagtcgcgggtttcgctctctcgagtcttcggaggcaaatcttttgggcggtctctggaaaggacgagaaaatgagtaagcttcaaagtgaggcattgagagaagctatcacggggatcaagaatgattgcaatgagaaaaaacgtaattttactgagacaatcgagcttcagattggattgaagaactacgatccccagaaagataagcgtttcagtggttctgtgaagttaccacacattcctcgccctaagatgaaagtctgcatgctcggtgatgctcaacacgtggaagaagcagagaagattggcctggattatatggacgtcgaagggttgaagaagttgaacaaaaacaagaagttggttaagagactagcaaagaagtaccatgcttttctagcatctgaagctgtgattaagcagattccccgtcttctgggccctggtttgaacaaggcaggaaagtttcccaccctcgtcactcatcaggaatcccttgatgccaaagttaatgagatgaaggctatggtaaagttccaactcaagaaggtgctctgcatgggtgttgctgtcggcaacctttctatggaggacaagcagatcttccagaatgttcaacttagtgtgaacttcctggtttcgttgttgaagaaaaattggcaaaatgtcaagtgcctctacttgaagagctccatggggaagccgtaccgagtcttctgaggcgtcctttgtatccgtagggagttactagaaaagagaagttgcgtggccccaaccattgagaagttacgttggtgttccttcttgtcagctgtttttgtcaaaagttttgagagttaacgacaatctttagttgaaatgtttcattttgttgtggattttttctgtcacgatggtttaatgacgatcctggttggactggtgatacatgtgaaatcagaattctacaacgcctcatttcgagttatttcttggtaggggaggtctctttggattgttacatagctagtcatactatctattgggagattttactttttcaacttccttatttttgcagcattcgaaattt

SEQ ID NO: 1408 - DNA, 998 bp, Carpinus betulus
gggtttatcagccataccagtcttcccttgctatatatatactctcatctggccgccacaaaccttggatagcgtttctcttcagcagaagaaaatcttttagtgggtctgtggagtgaaagcagtttcaaagatgagtaagctttcaagtgataccttaaaagagtctatctccacaattatggctggatctaaggataagaaacgtaatttcactgagaccattgaactccagattggactgaaaaactatgatcctcagaaggataagcgtttcagtggttctgttaagttaccgcacatccctcgtcccaagatgaaagtgtgcatgcttggagatgctcaacatgttgaagaggcagagaagattggtttggattatatggatgttgaagcattgaaaaagcttaacaaaaacaagaaattggttaagaaactagctaagaaataccacgcctttttagcatcagaagctgtcatcaagcagatcccccgtcttttgggccctggcctcaacaaggcaggcaagttcccaactcttgttactcatcaagaatccatcgagtctaaagttaatgagactaaggctatggtaaagttccaactgaagaaggtgctttgcatgggagttgctgtgggcaatggtgctatggaggagaagcagatcttccaaaatgttcagatgagtgttaatttcctcgtttcattgttgaagaagaattggcagaatgtgaggagcttgtcattgaaaactacaatggggaagccagtccgcgtatactgagatcttttggaaagggaattttgtagtgagctcatgggagctatagtacttataagttctttctttgaatgtcaagttttcttctttgttgggctgtttttccttctgctcttctttgaatatgtagatgccatggtggtagacattgtttgttggagaggtgaacctaattttttcactttcacttgcgctataacatattgttgaatgtttt

SEQ ID NO: 1409 - DNA, 818 bp, Eutrema halophilum
tccaggatcagatctttgagacaagctcaaaatgagtaagcttcagagtgaggccgttagagaagccattactgttatcagagcgaaatccgatgaaaagaaacgcaactttgtggagactcttgagctccagatcggtctgaagaattatgacccacaaaaggacaagcgtttcagtggatctgtcaagttgccacacataccccgtcctaagatgaagatctgcatgctcggagatgcccagcatgtcgaggaggctgacaaaatggggctagactatatggatgtggagtctctaaaaaagcttaacaaaaacaagaagctcgtcaaaaagcttgcgaagaaataccatgctttcttggcctctgaatctgttattaagcagattcctcgtcttcttggtcctggtctcaacaaagcaggaaagttcccaacgcttgtgagccaccaagaatcgttagagtccaaggtaaatgaaacaaaggccacagtcaaatttcagctgaagaaggttctctgcatgggagttgcagttggtaacctttccatggaagagaagcagatctttcagaacgtccagatgagtgttaacttcctcgtctctctattgaagaagaactggcaaaatgtgaggtgtttgtacctgaagagcaccatgggaccaccacaaagaatcttctgagctctcggagctgctttaatggtggctataagccctttgtttttgtttcagacatctttgaaagagtgtaagaattgtgttgctcttctttagattttgtttgaatgattaaaagaaactgcagtgattttggtta

SEQ ID NO: 1410 - DNA, 816 bp, Eutrema parvulum
taagcttcagagtgaggctcttagagaagccatcacaactgttaagggcaaatctgaggagaagaaacgtaactttgtggagacagttgagcttcagattggtctgaagaactatgaccctcaaaaggataagcgtttcagtggatctgtcaagctcccgcatattcctcgcccaaaaatgaagatttgtatgcttggagatgctcaacatgttgaggaggccgagaagatgggactagactatatggatgttgagggtttgaaaaagctcaacaaaaacaagaagcttgttaagaagcttgcgaagaagtaccatgctttcttggcttctgaatctgtcattaagcagattcctcgtcttcttggtcctggtcttaacaaggcaggaaagttcccaacacttgtgagtcaccaagagtccttggaagccaaggtgaacgagacaaaagcgacagtgaagttccagttgaagaaagttctatgtatgggtgttgctgttggtaacctttccatggaagagaagcagctctttcagaatgtgcagatgagcgtcaacttcctcgtctcactcttgaagaagaattggcaaaacgtaaggtgtttgtacttgaagagcaccatgggaccaccacaaaggatcttctgagctctctgctctttcatcttcccattttacttcgtgtttttttgtttcagagatacttgtgcttcttgagatatggtttggaatgatattattagcagaattcaagtgctagtttgctttttggtagacgatatatgcaatgtcctacaatatttacaattcaattttat

SEQ ID NO: 1411 - DNA, 1074 bp, Trigonella foenum-graecum
tctgtagcagcaagccaccgattcaatcaaaatgagtaagcttcaaagtgaggcagtgagagaagcgatctcaggaatcatgggtgattccaaggagaaaaaccgtaagtttgttgagaccattgaacttcaaattggtctcaagaactatgaccctcaaaaggataagcggttcagtgggtcagttaagttgccacatattcctcgtcctaagatgaagatttgtatgctcggagacgcccaacatgttgaagaggcagagaagataggtttggaatcgatggatgttgaagctttaaagaagctaaacaaaaataaaaaattggtgaagaagctcgccaagaagtaccatgctttcttagcttctgaggcagtcattaagcagattcctcgacttttgggtcctggtctcaacaaggcaggaaagttcccaacacttgtctctcaccaagaatctcttgaggggaaggttaatgagacaaaggctatggtgaaatttcagcttaagaaggtactctgcatgggagtggccgtgggtaatgttagcatggatgaaaagcaaatctttcaaaacgttcaactcagtgtcaacttccttgtctccttgttgaagaagaattggcagaacgtacgctgcctgtatttgaagagctccatggggaaatcgtaccgtgtcttttaagggaacttatttccatttttcaatattcagtgaacttgtcatcaccttcaatacatttgtcctaatagcttgatagaaatttcatcttattacagttttcctggatcatttatggataagttttgttttatgtttcaaatatttcataattttagtcgtgctattattggtgctactcctatctgattggcgttgaacttgtttatgaaatccaatgaagtgaacattgcaaaatttcggagaaatgcaagagataaccacgcatacggagaaaataaccctatttaaagttgctttttaattactttttatactatcaattgaaccccatttacggtgtctcgtgacacttgccgtcaaaattatgctatatcaattttattgttattaac

SEQ ID NO: 1412 - DNA, 904 bp, Brassica oleracea
ttcctctgcttcacctctcaggttcagagattcgttcaactgcgagaaactcaagatgagtaagcttcagagtgaggctcttagggaagccatcacaaccatcaagggcaaatctgaggacaagaagcgtaactttgtggagacggttgagcttcagattggtctgaagaactacgacccgcaaaaggacaagcgtttcagtggatctgtcaagctcccgcacattcctcgccctaagatgaaggtctgtatgcttggagatgctcagcacgttgaggaggctgagaagatggggctagactctatggatgttgaggctttgaagaagctcaacaagaacaagaagcttgttaagaagcttgcgaagaagtaccatgctttcttggcttctgagtcagtcatcaagcagattccccgtcttcttggtcctggtctaaacaaagctggaaagttcccaactctagtgagtcaccaagagtccttggaagggaaggtgaacgagaccaaagcgactgtgaagttccagttgaagaaggttctgtgtatgggtgttgctgttggtaacctttccatggaagagaagcagctctttcagaatgttcagatgagcatcaacttccttgtctcgctcttgaagaagaattggcaaaacgtgaggtgtttgtacttgaagagcaccatgggaccaccacaaaggatcttttgagttctctactatttcatcttcgaacttttgcgttgtggtttttgtttgtttcagagatcttgagttatggttttgtttggtattagcagaactgaagtgttagtttgctttttgtcaagacattataatatgcattgttggattctaccatatcgactctccagttcaattttatctttatcaattatcgccgtgaag

SEQ ID NO: 1413 - DNA, 1060 bp, Brachypodium distachyon
ggggcatcccatttaaaagaggtctctagggtttccactccgtcgcgccgccttccctcccctgcctcgtcgcggaacagtgctcccaccgccggcgccatgagtaagttgcagagcgaagccctgagggaggcaatcacaagtattaccactaactctcgtgacaagcagcgcaagttcattgaaaccattgagctgcagattggactgaagaactatgacccccaaaaggataaacgtttcagtggttctgttaagctacctcacatccctcgcccaaagatgagggtttgcatgcttggtgatgcccagcacgttgaagaggcagggaaattgggcctagactgtatggatgtggaatccctcaagaagatgaacaaaaacaagaagctagtcaagaagcttgcaaagaaatatcatgctttcctcgcatctgaggccatcattaagcagattcctcgacttcttggacctggtcttaataaggcagggaaattcccaactttggtgtctcatcaggagtccctcgaatccaaggttaacgagaccaaggctactgtgaagttccagctgaaaaaggttctttgcatgggtgtggccgttggccactgtggtatggatgagaagcaaatcttccagaatgtgcaaatgagtgtgaatttccttgtctctctattgaagaagaactggcaaaatgtgagatgcttgtacctcaagagcacaatgggcaagatgcaccggttgttctaagccatcatctgtttaggtctctagaaattcgaggagtttgactacttgggagcttttttatattcagagatccaattttcgtgcatcaagtgagaattatgcagtgcgaattattctgtcttgtactgagatgtgtttatctgttctgtgggactcacgacacttagctattgagctcgctctaagacatcatggctatactcttttgtgcttctcacttaagtattagatctgtctctgaggttaatctgatttcttttgggtatgcccgtttgaatttgtgcttctgggtagccacataatttaaacc

SEQ ID NO: 1414 - DNA, 1086 bp, Brachypodium distachyon
gtttaggttcctcggggcatcccatttaaaagaggtctctagggtttccactccgtcgcgccgccttccctcccctgcctcgtcgcggaacagtgctcccaccgccggcgccatgagtaagttgcagagcgaagccctgagggaggcaatcacaagtattaccactaactctcgtgacaagcagcgcaagttcattgaaaccattgagctgcagattggactgaagaactatgacccccaaaaggataaacgtttcagtggttctgttaagctacctcacatccctcgcccaaagatgagggtttgcatgcttggtgatgcccagcacgttgaagaggcagggaaattgggcctagactgtatggatgtggaatccctcaagaagatgaacaaaaacaagaagctagtcaagaagcttgcaaagaaatatcatgctttcctcgcatctgaggccatcattaagcagattcctcgacttcttggacctggtcttaataaggcagggaaattcccaactttggtgtctcatcaggagtccctcgaatccaaggttaacgagaccaaggctactgtgaagttccagctgaaaaaggttctttgcatgggtgtggccgttggccactgtggtatggatgagaagcaaatcttccagaatgtgcaaatgagtgtgaatttccttgtctctctattgaagaagaactggcaaaatgtgagatgcttgtacctcaagagcacaatgggcaagatgcaccggttgttctaagccatcatctgtttaggtctctagaaattcgaggagtttgactacttgggagcttttttatattcagagatccaattttcgtgcatcaagtgagaattatgcagtgcgaattattctgtcttgtactgagatgtgtttatctgttctgtgggactcacgacacttagctattgagctcgctctaagacatcatggctatactcttttgtgcttctcacttaagtattagatctgtctctgaggttaatctgatttcttttgggtatgcccgtttgaatttgtgcttctgggtagccacataatttaaaccgagtcccgtcgga

SEQ ID NO: 1415 - DNA, 892 bp, Brassica napus
aagggtttcctctgcttcacctctcaggttcagagattcgttcaactgcgagaaactcaagatgagtaagcttcagagcgaggctcttagagaagccatcacaaccatcaagggcaaatctgaggacaagaagcgtaactttgtggagacggttgagcttcagattggtctgaagaactatgacccgcaaaaggacaagcgtttcagtggatctgtcaagctcccgcacattcctcgccctaagatgaaggtctgtatgcttggagatgctcagcacgttgaggaggctgagaagatggggctagactctatggatgttgaggctttgaagaagctcaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtccttggaagggaaggtgaacgagaccaaagcgactgtgaagttccagttgaagaaggttctgtgtatgggtgttgctgttggtaacctttccatggaagagaagcagctctttcagaatgttcagatgagcatcaacttccttgtctcgctcttgaagaagaattggcaaaacgtgaggtgtttgtacttgaagagcaccatgggaccaccacaaaggatcttttgagttctctactatttcatcttcgaacttttgcgttgtggtttttgtttgtttcagagatcttgagttatggttttgtttggtattagcagaactgaagtgttagtttgctttttgtcaagacattataatatgcattgttggattctaccatatcgactctccagttcaattttatcttta

SEQ ID NO: 1416 - DNA, 870 bp, Centaurea maculosa
  misc_feature (29)..(29): n is a, c, g, or t
  misc_feature (47)..(48): n is a, c, g, or t
ggggattggcactttaaaccctaacgcanggttcttcttcttcttcnncagaagtgcaagttagcgaaaggaatagtttgcgaacatgagtaagctgcaaagtgaagcccttagggaggctattactcagatcactactgatgccaaggaaaagaagcggaacttcactgagaccattgagctccagatcggtttgaagaattacgacccccaaaaggacaagcgtttcagtggtaccgtgaaattgcctcacattccccgtcccaaattgaaagtttgtatgcttggagatgcgcagcatgttgaagaggctcaaaagattggccttgaatatatggatgttgaggctctgaagaagttgaacaaaaacaagaagttggtgaagaaacttgcaaagaaacaccaagctttcttggcttctgagtctgtcatcaagcagattcctcgtttgttgggacctggtctaaacaaggcaggtaagttccctactcttgttacccaccaagaatcccttgaggctaaggtaaacgagaccaaagcaactgtgaagttccaactgaagaaggtgctctgcatgggagttgctgttggaaactgcagcatggaggacaaacagatattccagaacgtgcaaatgagcgtcaacttccttgtttcgttgctgaagaagaattggcaaaacgtgaggtgcttatacttgaagacaacaatgggaaagccggttcgcatcttttgaagagtttatttatgttttcattttgtaatgttgaggttgctactttaagaggttgttttctatcaaaaggaaatactccattttgttttggttgctactatatttttagatggctcacttcagacatttctata

SEQ ID NO: 1417 - DNA, 967 bp, Castanea mollissima
caaatttatatctctcttctgccatcgctcactccctgtaccgcctcccaaaacccttctctacagaagcagttgaaaaaggtgtatagcgatgagtaagcttcagagcgatacgttgagggaggtgatctcacaggtggtgaacaatgcgaaggagaagaagcgcaacttcacggagaccattgagctccaaatcgggttgaagaactatgaccctcagaaggacaagcgtttcagtggctccgtcaagctccctcacatccctcgccctaagatgaagatttgtatgcttggtgatgctcagcacgttgaagaggcagagaaggtgggattggagtatatggatgtggaagggctgaagaagctcaacaagaataagaaactggtgaagaagctcgccaagaagtaccatgcctttttagcatctgagtctgtgattaagctaattcctcgtctcttgggtcctggtcttaacaaggcaggtaagtttccaacactggtgactcatcaagaatccttggagtcaaaggttaatgaaacaaaagcaatggtgaagtttcaactcaagaaggttctttgtatgggggttgctgttggaaattgcagtatggaggaaaagcagatattccagaatgtgcaaatgagtgtcaacttccttgtttcattgttgaagaaaaattggcaaaacgtgaggtgcttgaatctgaagagtaccatggggagtgccgtacgcctctattaattccattttgctgtttgtgagagttatttaggagaagtagcatgagtgaaatgttttttgagcattatgtacgcaagacagtccttggggaattttcctgaggtcctttttgttttccttgttttggattctttagcttcaaagtttagttaatgatgatatttttgtttaaatttgatgttattggttgagttaaaaaagtttcttatgtttgttttggaatgg

SEQ ID NO: 1418 - DNA, 870 bp, Cucumis sativus
ggactgaagggtatactgtctttgcgaaggcgaagattcgaaaatgagtaagcttcagagtgatgcattgagagaagctatctcatctatcttcactgatagcaatgagaaaaagaggaagtttactgagaccattgagcttcagatcgggctgaagaactatgatcctcaaaaggacaagcgtttcagtggttctgtgaagttgccacacattccccgtcccaagatgaagatatgcatgcttggggatgcctcacacattgaagaggctgagaagattggtctagaatatatggatgtggaaggcttgaagaagcttaataagaacaagaaattggtgaagaaacttgccaaaaaataccatgcctttttggcatcagaatctataatcaagcagattcctcgtcttctaggccctggtctcaacaaagcaggaaagttcccaacattggtgacacatcaagagacgcttgaatctaaagttaatgagaccaaggcgatggtcaagtttcaactgaagaaggttctttgtatgggagttgctgttggaaacgtttccatggatgagaagcaagtcttccaaaatgtccaaatgagcgtcaatttcctagtttctttgttgaaaaagaactggcagaatgttaggtgcctgtacctgaagagcacaatggggaagtcgtatcgagttttctaagctttgttagcaatgtagtcagtcttgtgtgttcaatctttttattatcaacgttatttctcgaagagcagttttgtgaaatgagcgtttttgaatgattcttgaacaaagaaacaggaatgttttcttctcttttaaagtgacaattgataatgaagtttttaattcccacccaa

SEQ ID NO: 1419 - DNA, 1044 bp, Taraxacum officinale
ggggggaaggtttccctcatatatatcagctgcttctgctgcgtaactacatcggcactttcaaccctactcgcagggttcttacgggagaagtgaagcttgacgaaaagaaaagcttttgaatatgagtaaacttcaaagcgaagccctcagagaggcgatcactcaaattaccaccgatgccaaagaaaagtcaaggaagttcactgagaccattgagcttcaaattggtttgaagaattacgatccacaaaaggacaaacgtttcagtggtaccgtgaaattacctcacattccccgccctaaactcaaggtctgcatgcttggagatgcccagcatgttgaagaggctcaaaagattggcctcgaatacatggatgttgaaggtctaaagaaactgaacaagaacaagaagttggtgaagaagcttgcaaagaaacatcaagctttcttggcttctgaatctgtcatcaagcagattccccgtttgttgggacctggtttgaacaaagccggtaagtttcctactcttgtttcccaccaagaatcccttgaggcaaaggtgaatgagaccaaagcaactgtcaagttccaactgaaaaaggtgctttgtatgggagttgctgttggaaactgcagcatggaagagaagcagatcttccagaatgttcaaatgagtgttaacttcttggtttctttgttgaagaagaattggcaaaatgtgaggtgcttatacttgaaaacaacaatgggaaagccagtgcgtatcttttaagaagtttgcttgttcttgtgttttgattttgggttaatgttaaggtcggcacttgagaaaacatgtatttcccttcaacaggaaatagttatttttgtctttttacatgtttgtttcgtaatttataatattagacaccctgttttagttattctgttgatgatttttatatggtttattctgtcttctatatattcaagtgtcaattgtgacatctaaaaactgctgttttgatcggtattcctctattaacaaaaaatttattgttc

SEQ ID NO: 1420 - DNA, 1116 bp, Eucalyptus grandis
atgaatctgaaggcccacgaaaggaccgagcttattgacagtgaaaccctagtcgcgggtttcgctctctcgagtcttcggaggcaaatcttttgggcggtctctggaaaggacgagaaaatgagtaagcttcaaagtgaggcattgagagaagctatcacggggatcaagaatgattgcaatgagaaaaaacgtaattttactgagacaatcgagcttcagattggattgaagaactacgatccccagaaagataagcgtttcagtggttctgtgaagttaccacacattcctcgccctaagatgaaagtctgcatgctcggtgatgctcaacacgtggaagaagcagagaagattggcctggattatatggatgtcgaagggttgaagaagttgaacaaaaacaagaagttggttaagagactagcaaagaagtaccatgcttttctagcatctgaagctgtgattaagcagattccccgtcttctgggccctggtttgaacaaggcaggaaagtttcccaccctcgtcactcatcaggaatcccttgatgccaaagttaatgagatgaaggctatggtaaagttccaactcaagaaggtgctctgcatgggtgttgctgtcggcaacctttctatggaggacaagcagatcttccagaatgttcaacttagtgtgaacttcctggtttcgttgttgaagaaaaattggcaaaatgtcaagtgcctctacttgaagagctccatggggaagccgtaccgagtcttctgaggcgtcctttgtatccgtagggagttactagaaaagagaagttgcgtggccccaaccattgagaagttacgttggtgttccttcttgtcagctgtttttgtcaaaagttttgagagttaacgacaatctttagttgaaatgtttcattttgttgtggattttttctgtcacgatggtttaatgacgatggactggtgatacatgtgaaatcagaattctacaacgcctcatttcgagttatttcttggtaggggaggtctctttggattgttacatagctagtcatactatcaattgggagattttactttttcaacttccttatttttgcagcattcgaaattt

SEQ ID NO: 1421 - DNA, 783 bp, Actinidia deliciosa
cggccgctctagaatactctcgagggcaccgaggggaaacgttgttatttgtcccacaacgaaaatatagcttctctctcgctgccgcgaagtcatcgcccatcgcaaaccctaatctagggttttcatctcagtgcacataagtctgaaggaaggaaaaagtttcagccatgagtaagcttcagagtgaggccttgagggaagcaatctctcaaatttctaatgatgccaaggagaaaaagcgtaacttcactgaaaccattgagctccagattgggttgaaaaactatgatccccagaaggacaagcgatttagtggttccgtgaagttgcctcacatccctcgtcccaagatgaaagtttgcatgcttggtgatgctcagcacgtggaagaggctgagaagataggtttggagtatatggacgtggaagggctgaagaaactcaacaaaaacaagaaactggttaagaaactggctaagaaataccatgccttcttagcgtcagaagctgtcatcaagcagattcctcgtctattaggccctggtctcaacaaagcagggaagtttcctacccttgtcactcaccaggaatctctcgagtctaaagtcaatgagactaaagcgacagttaagttccaactaaagaaggttctctgcatgggagttgctgttggcaactgtagtatggaggagaagcagattttccagaatgtgcaaatgagcgttaattttctggtttcattgttaaagaagaactggcaaaatgtgaggtgcttgtacc

SEQ ID NO: 1422 - DNA, 931 bp, Medicago truncatula
tctgccgctagggttttgtttctctgctcctaccattttgctttgtagcagaagccaccgattcaaccaaaatgagtaagcttcaaagtgaggcagtgagagaagcaatctcaggaatcatggctgattccaaagagaagaatcgcaagtttgttgagaccattgaacttcaaattggtctcaagaactacgacccgcaaaaagataagcgtttcagtggctccgtcaagttgcctcatatccctcgtcctaagatgaagctttgtatgctcggagatgcccaacacgttgaagaggcagagaagataggtttggaatcaatggatgttgaagccttgaagaagctcaacaaaaataagaagttggtgaaaaagctagccaagaagtaccatgctttcttagcttctgaggcagtcattaagcagattcctcgtcttttgggtcctggtctcaacaaggcagggaagttcccaacacttgtctctcaccaagaatctctcgagggaaaggtcaatgagacaaaagctatggtgaaatttcagcttaagaaggtgctctgtatgggagtagctgtgggtaatgttagcatggatgaaaagcaaatctttcaaaatgttcaactcagtgttaacttccttgtctccttgttgaaaaagaactggcagaatgttcggtgcttgtatctgaagagttcaatgggaaaatcttaccgtgtcttttaagggaacttatttcctatcttttttcaatatttaagtcagtcatctccttcaatacatttgtccgaatagcttgatagaaacttcgtcttgttacaattttgctggattatttattgttaaattgttgtttttatgtttgaatatttgataatgttagtcgtgctactttttgtgcttctcatttcctgatgattgttattttttgtgct

SEQ ID NO: 1423 - DNA, 1040 bp, Medicago truncatula
ccggcccattccaaatccatcactaccttcatgctataaactccctcctctgccgctagggttttgtttctctgctcctaccattttgctttgtagcagaagccaccgattcaaccaaaatgagtaagcttcaaagtgaggcagtgagagaagcaatctcaggaatcatggctgattccaaagagaagaatcgcaagtttgttgagaccattgaacttcaaattggtctcaagaactacgacccgcaaaaagataagcgtttcagtggctccgtcaagttgcctcatatccctcgtcctaagatgaagctttgtatgctcggagatgcccaacacgttgaagaggcagagaagataggtttggaatcaatggatgttgaagccttgaagaagctcaacaaaaataagaagttggtgaaaaagctagccaagaagtaccatgctttcttagcttctgaggcagtcattaagcagattcctcgtcttttgggtcctggtctcaacaaggcagggaagttcccaacacttgtctctcaccaagaatctctcgagggaaaggtcaatgagacaaaagctatggtgaaatttcagcttaagaaggtgctctgtatgggagtagctgtgggtaatgttagcatggatgaaaagcaaatctttcaaaatgttcaactcagtgttaacttccttgtctccttgttgaaaaagaactggcagaatgttcggtgcttgtatctgaagagttcaatgggaaaatcttaccgtgtcttttaagggaacttatttcctatcttttttcaatatttaagtcagtcatctccttcaatacatttgtccgaatagcttgatagaaacttcgtcttgttacaattttgctggattatttattgttaaattgttgtttttatgtttgaatatttgataatgttagtcgtgctactttttgtgcttctcatttcctgatgattgttattttttgtgctactcatcttgttacaatgaaatgaacaaatctttcagcgaatcatgggagatgaactgaag

SEQ ID NO: 1424 - DNA, 726 bp, Medicago truncatula
gtgcagacagaattcttccattctgctttgagccatgagtaagcttcagagtgatgccttaagagaagccatcactgtgattaagaatgattcaagtgagaagaaaaggaagttcaccgaaaccattgagcttcagattgggttgaaaaactatgatcctcaaaaggacaagcgtttcagtggttcagttaagttgccacacattcctcgtcctaagatgaagatttgcatgcttggagatgctcagcatgtgggagaggcagaaaagattggtttggagtacatggacgtggaaggcctgaagaagcttaacaaaaacaaaaagttggttaagaagctcgcgaagaagtaccatgctttcttggcatcagaagctgttatcaagcagatcccccgtctcttggggcctggcttgaacaaggcaggtaagtttcctacccttgtttcccaccaggagtcacttgagtctaaggttaacgagaccaaggccactatcaaattccagttgaagaaggttctttgcatgggagttgccgtaggtaatatggatatggaggagaaacaaatcttccaaaacgtgcaaatgagtgtcaactttctagtgtccttgctaaagaagaattggcaaaatgtgagatgcttgtacttgaagagtaccatgggaaagactcaacgcatcttttaagaatattgtattacaatctttgcagtttcaagcgttttgac

SEQ ID NO: 1425 - DNA, 955 bp, Cucumis melo
tttcgttttctttcttctcggactgaagggtatactgtctttgcgaaggcgaagattcgaaaatgagtaagcttcagagtgatgcactgagagaagctatctcatctattttcactgatagcaatgagaaaaagagaaagtttactgagaccattgagcttcagatcggactgaagaactatgatcctcagaaggacaagcgtttcagtggttctgtgaagttgccacatattccccgtcccaagatgaagatatgcatgcttggggatgcctcacacattgaagaggctgagaagattggtctagaatatatggatgtggaaggcttgaaaaagctaaataagaacaagaaattggtgaagaaacttgccaaaaaataccatgcctttttggcatcagaatctataatcaagcagattcctcgtcttctaggccccggtctcaacaaagcaggaaagttcccaacattggtgacacaccaagaaacgcttgaatctaaagttaatgagaccaaggcgatggtcaagtttcaactgaagaaggtcctttgtatgggagtcgctgttggaaacgtttccatggatgagaagcaagtctttcaaaatgttcaaatgagcgtcaatttcttggtttctttgttgaaaaagaactggcagaatgttaggtgcctgtacctgaaaagcacaatggggaagtcatatcgggttttctaagcactgttagcaatgtagtcagtcttgtgtgttcgatcttttattgtcgacgttatttctcgaagagcagttttgtgaaatgagcgtttttgaatgattcttgaacaaagaaacaggaatgttttcttctcttttaaagtgacaattgataatgaagtttttaattcccctccccaacctcacctattatgaacttgtgtttgcatttactttgatcgtattgtagtttttattaaaaaaaa

SEQ ID NO: 1426 - DNA, 1001 bp, Quercus alba
acgagtgcgtgagggttttgatttataagatccaaatgcgtcaaatttatacttctcttctgccatcgctcactctctgtaccgcctcccaaaacccttctcttcagaggcatttgaaaaaggtgtatagcgatgagtaagctccagagcgatacattgagggaggtgatatcgcaggtggtgaacaatgcgaaggagaagaagcgcaacttcacggagaccattgagctccaaatcgggttgaagaactacgaccctcagaaagacaagcgtttcagtggctccgtcaagctccctcacattcctcgccctaagatgaagatttgtatgcttggtgatgctcagcacgttgaagaggcagagaaggtgggattggagtatatggatgtggaagggctgaagaagctcaacaagaacaagaaactggtgaagaagcttgccaagaagtaccatgcctttttagcatctgagtctgtgattaagctaattcctcgtcttttgggtcctggtcttaacaaggcaggtaagtttccaacactggtgactcatcaagaatccttggagtcaaaggttaatgaaacaaaagcaatggtgaagtttcaactcaagaaggttctttgtatgggggttgctgttggaaattgcagtatggaggaaaagcaaatcttccagaatgtgcaaatgagtgtcaacttccttgtttcattgttgaagaaaaattggcaaaatgtgaggtgcttgaatctgaagagtaccatggggagcgctgtacgcctttattaagtccatttttgctgtttgtgagagttatgtaggagaagcagcatgagtgaattgtcgtttgagcattatgttcgcaagacattccttggggaattttcctgaggtcctttttgttttcttttgttttggattctttagcttcaaagtttagttaatgatgatatttttgtttaaatttgatgttattggttgagcaaagaaagcttcttatgtttgtt

SEQ ID NO: 1427 - DNA, 943 bp, Solanum tuberosum
gctcttacggcgctcacaaaccctaattagggttttctcatacagaagtgaagttttgaaggagaaaggagaagtatttgagccatgagtaagcttcagagtgaggcccttagagaagccatctctataattaagaatgattcggctgagaaaaagaggaagttctccgagactattgagctccagattgggcttaagaactatgatccccaaaaggacaagcgtttcagtggatctgtgaggttgcctcacattccacgccctaagatgaagatttgcatgctcggagatgctcaacacgtgggggaggcagagaagatcggtttggagtacatggatgttgagagcctcaagaagcttaacaagaacaagaagttggttaagaagcttgcaaagaaataccatgctttcttggcttcagaatctgtcatcaagcagattcctcgtctcttgggtcctggtctgaacaaggcaggtaagtttccaacccttgtctcccaccaagagtcactcgagtctaaagttaatgagaccaaggctaccatcaagttccagttgaagaaggtgctttgcatgggtgttgccgtcggtaattgtgatatggaggagaaacaaatcttccagaatgtgcaaatgagcgtgaacttcttagtgtctcttctaaagaagaattggcagaacgtacggtgcttgtacttgaagagcaccatggggaagactcaacgtgtcttttaggaaggacaagtctgttattggagcttttcgtgcattcttcttgtaagagagatagatacactaatgaaaattttggatagtagtcatccgtgattatgttttgaatgttacatcactacaaggatcgatcatattgctgagacattttcttcttttcaagagctctgttctttgttctctttgtttattgatgatgatttcatttgaa

SEQ ID NO: 1428 - DNA, 898 bp, Solanum tuberosum
gaatttgcagacagaattcttcccattctgctttgagccatgagtaagcttcagagtgatgccttaagagaagccatcactgtgattaagaatgattcaagtgagaagaaaaggaagttcaccgaaaccattgagcttcagattgggttgaaaaactatgatcctcaaaaggacaagcgtttcagtggttcagttaagttgccacacattcctcgccctaagatgaagatttgcatgcttggagatgctcagcatgtgggagaggcagaaaagattggtttggagtacatggacgtggaaggcctgaagaagcttaacaaaaacaaaaagttggttaagaagctcgcaaagaagtaccatgctttcttggcatcagaagctgttatcaagcagatcccccgtctcttggggcctggcttgaacaaggcaggcaagtttcctacccttgtttcccaccaggaatcactcgagtctaaggttaacgagaccaaggccactatcaaattccagttgaagaaggttctttgcatgggagttgccgtaggtaatatggatatggaggagaaacaaatcttccaaaacgtgcaaatgagtgtcaactttctagtgtccttgctaaagaagaattggcaaaatgtgagatgcttgtacttgaagagtaccatgggaaagactcaacgcatcttctaaggatattgtattacaatcttggcagtttcaggcgttttgacttgtacgcgttatagatactattgaattttttgtttagttgtgctcctggctggatactgagttgaaaacttgatatcagttttgttatgattttacttttattttctccttttcaatgttaacaccaccagcaccactattcctgttgattttcttgaatactgtc

SEQ ID NO: 1429 - DNA, 887 bp, Carthamus tinctorius
ggcgggggtctgtaaccctacttgcagggttcttcttcttccacagaagtgcaggttagcgaaaggagtagtttccgaacatgagtaagctacaaagtgaggccctccgagaggcgattacgcagattactactgatgccaaggaaaagaaacgtaacttcacagagaccattgagctccagatcggtttgaagaattacgacccccaaaaggacaagcgtttcagtggtactgtgaagttgcctcacattccccgtcccaaattgaaagtttgtatgcttggagatgcgcagcatgttgaagaggctcaaaagattggccttgaatatatggatgttgaggctctgaagaagttgaacaaaaacaagaaattggtgaagaaacttgcgaagaaacatcaagctttcttggcgtctgagtctgtcatcaagcagattcctcgtttgctgggacctggtctgaacaaggcaggtaagttcccaactcttgttacccaccaagaatccctcgaggctaaggtgaatgagaccaaggcaactgtgaagttccaactgaagaaggtgctctgcatgggagttgccgttgggaactgcagcatggaggacaaacagatattccagaacgtgcaaatgagcgtaaactttcttgtttctttgctgaagaagaattggcaaaacgtgaggtgcttatacttgaagacaacaatgggaaagccggttcgcatcttttgaagagtgtgcttatgttttggtttttggttgatcttgaggttgctactttaagaggttgtttctcatcaagaggaaatactccattttgttttcgttgctactatatttttagacggctcagttttcagacatctattataattgttctttttatgt

SEQ ID NO: 1430 - DNA, 974 bp, Solanum phureja
aagcccattgagaactttgctttaaccctcaacttctttgccacccctccgccgctcactcaatttgcagacagaattcttcccattctgctttgagccatgagtaagcttcagagtgatgccttaagagaagccatcacggtgattaagaatgattcaagtgagaagaaaaggaagttcactgaaaccattgagcttcagattgggttgaaaaactatgatcctcaaaaggacaagcgtttcagtggttcagttaagttgccacacattcctcgccctaagatgaagatttgcatgcttggagatgctcagcatgtgggagaggcagaaaagattggtttggagtacatggacgtggaaggcctgaagaagcttaacaaaaacaaaaagttggttaagaagctcgcaaagaagtaccatgctttcttggcatcagaagctgttatcaagcagatcccccgtctcttggggcctggcttgaacaaggcaggcaagtttcctacccttgtttcccaccaggaatcactcgagtctaaggttaatgagaccaaggccactatcaaattccagttgaagaaggttctttgcatgggagttgccgtaggtaatatggatatggaggagaaacaaatcttccagaacgtgcagatgagtgtcaactttctagtatccttgctaaagaagaattggcaaaatgtgagatgcttgtacttgaagagtaccatgggaaagactcaacgcatcttttaagaatattgtattacaatcttggcagtttcaggcattttgacttgtacgcgttatagatactattggattttgttgtttagttgtgctcctggatactgagttgaaaacttgatatcagttttgttatgattttacttttattttctcctatttctgttgattttcttgaatactgtcaactttcatatctaaaggaacactcaaattttgtggtttaactgcta

SEQ ID NO: 1431 - DNA, 990 bp, Solanum phureja
atatatcactatactaagccacccttcgtcactcttacggcgctcacaaaccctaattagggttttctcatacagaagtgaagttttgaaggagaaaggagaagtatttgagccatgagtaagcttcagagtgaggcccttagagaagccatctctataattaagaatgattcggctgagaaaaagaggaagttctccgagactattgagctccagattgggcttaagaactatgatccccaaaaggacaagcgtttcagtggatctgtgaggttgcctcacattccacgccctaagatgaaaatttgcatgctcggagatgctcaacacgtgggggaggcagagaagatcggtttggagtacatggatgttgagagcctcaagaagcttaacaagaacaagaagttggttaagaagcttgcaaagaaataccatgctttcttggcttcagaatctgtcatcaagcagattcctcgtctcttgggtcctggtctgaacaaggcaggtaagtttccaacccttgtctcccaccaagagtcactcgagtctaaagttaatgagaccaaggctaccatcaagttccagttgaagaaggtgctttgcatgggtgttgccgtcggtaattgtgatatggaggagaaacaaatcttccagaatgtgcaaatgagcgtgaacttcttagtgtctcttctaaagaagaattggcagaacgtacggtgcttgtacttgaagagcaccatggggaagactcaacgtgtcttttaggaaggacaagtctgttattggagcttttcgtgcattcttcttgtaagagagatagatacactaatgaaaattttggatagtagtcatccgtgattatgttttgaatgttacatcactacaaggatcgatcatattgctgagacattttcttcttttcaagatctctgttctttgttctctttgtttattgatgatgatttcatttgaatgatatgcagtatttct

SEQ ID NO: 1432 - DNA, 1094 bp, Fragaria vesca
gcagcccaaactagacacagctttgattaggttttagcagtcatcacctctcaatctccagctccttatataaacttgcttggccgccagaaccctaacggcgcctcctgcttctcttctctacggtgagaaatcgctggtggaggatcggacacgtcttaagtttcgatcatgagtaagcttcagagtgatactctcagggaggctatctctgtcatcatggctgcttccaaggagaagaatcggaagttcacagaaactattgagcttcagatcgggttgaagaattatgatccccaaaaggacaagcgtttcagtggttctgttaagctgccacacattcctcgtccaaagatgaaggtctgcatgcttggagatgctcagcatgttgaagaggctcagaagatcggtttggagtacatggatgtagaagcactgaagaagttaaacaaaaacaagaaattggttaagaaactggctaagaagtaccatgcttttttagcatcagaagctgttatcaagcagattccccgtcttttgggtcctggtctcaacaaggcaggaaagttcccaacccttgtttctcaccaagaatccctggagtctaaaatttctgagacaaaagcgacaattaagttccagttgaagaaggttctctgtatgggagttgctgtagggaatgtctcaatggaggagaagcaaattttccaaaatgtgcaactgagtgtgaacttccttgtttcactattgaaaaagaattggcaaaacgtaaagtgcttgaacctcaagaccacaatggggaagccatatcgtgtttattagagtcttcacttagttttggagatttgtagctacagtttgtaagaagcctgctccttatagggactgctccttgtaggaagcgtgtttattttgatggtccagtttcttatatgcctgttttactttttgctcaatgcttgtcaacattgttatgttagactttctattattattattgtgggagggtaaactgattttcaattttgtgtcgcatattatgttgaccaatgatatttctatgcacctgcatgttttgaaagatttaaccattc

SEQ ID NO: 1433 - DNA, 845 bp, Thellungiella halophila
atcggccatcacggtctattcgtccaggatcagatctttgagacaagctcaaaatgagtaagcttcagagtgaggccgttagagaagccattactgttatcagagcgaaatccgatgaaaagaaacgcaactttgtggagactcttgagctccagatcggtctgaagaattatgacccacaaaaggacaagcgtttcagtggatctgtcaagttgccacacataccccgtcctaagatgaagatctgcatgctcggagatgcccagcatgtcgaggaggctgacaaaatggggctagactatatggatgtggagtctctaaaaaagcttaacaaaaacaagaagctcgtcaaaaagcttgcgaagaaataccatgctttcttggcctctgaatctgttattaagcagattcctcgtcttcttggtcctggtctcaacaaagcaggaaagttcccaacgcttgtgagccaccaagaatcgttagagtccaaggtaaatgaaacaaaggccacagtcaaatttcagctgaagaaggttctctgcatgggagttgcagttggtaacctttccatggaagagaagcagatctttcagaacgtccagatgagtgttaacttcctcgtctctctattgaagaagaactggcaaaatgtgaggtgtttgtacctgaagagcaccatgggaccaccacaaagaatcttctgagctctcggagctgctttaatggtggctataagccctttgtttttgtttcagacatctttgaaagagtgtaagaattgtgttgctcttctttagattttgtttgaatgattaaaagaaactgcagtgattttggttaaaaaa

SEQ ID NO: 1434 - DNA, 1010 bp, Solanum lycopersicum
atcttttagcaagacccaacaagcccattgagaacttagctttaaccctcaacttctttgccaccactccgccgctcactcaatttgcagagacgattcttcccattctactttgagccatgagtaagcttcagagtgatgccttaagagaagccatcaccgtgattaagaatgattcaagtgagaagaaaaggaagttcaccgaaaccattgagcttcagattggtttgaaaaactatgatcctcaaaaggacaagcgtttcagtggttcagttaagttgccacacattcctcgccccaagatgaagatttgcatgcttggagatgctcagcacgtgggagaggcagaaaagattggtttggagtacatggatgtggaaggtctgaagaagcttaataaaaacaagaagttggttaagaagctcgcaaagaagtaccatgctttcttggcatcagaagctgttatcaagcagatcccccgtctcttggggcctggtttgaacaaggcaggtaagtttcctacccttgtttcccaccaggaatcactcgagtctaaggtaaacgagaccaaggcgactatcaaattccagttgaagaaggttctttgcatgggagttgccgtaggtaatatggatatggaggagaaacaaatcttccagaacgtgcagatgagtgtcaactttctcgtgtccttgctaaagaagaattggcaaaatgtgagatgcttgtacttgaagagtaccatgggaaagactcaacgcatcttctaaggacattgtattacaatctttgcagtttcaggcgttttgacttgtacgcgttatagatactattgcattttttgtttagttgtgctccttggatactgagttgaaaactttatatcagttttgttatgattttactttttcttttctcctttctgttgattttcttgaatattgtcaactttcatatctaaaggaaaactcaaattttgtggtttaactgctattaaacctctttgcttt

SEQ ID NO: 1435 - DNA, 1017 bp, Solanum lycopersicum
atatatcttttagcaagacccaacaagcccattgagaacttagctttaaccctcaacttctttgccaccactccgccgctcactcaatttgcagagacgattcttcccattctactttgagccatgagtaagcttcagagtgatgccttaagagaagccatcaccgtgattaagaatgattcaagtgagaagaaaaggaagttcaccgaaaccattgagcttcagattgggttgaaaaactatgatcctcaaaaggacaagcgtttcagtggttcagttaagttgccacacattcctcgccccaagatgaagatttgcatgcttggagatgctcagcacgtgggagaggcagaaaagattggtttggagtacatggacgtggaaggcctgaagaagcttaacaaaaacaagaagttggttaagaagctcgcaaagaagtaccatgctttcttggcatcagaagctgttatcaagcagatcccccgtctcttggggcctggtttgaacaaggcaggtaagtttcctacccttgtttcccaccaggaatcactcgagtctaaggtaaacgagaccaaggccactatcaaattccagttgaagaaggttctttgcatgggagttgccgtaggtaatatggatatggaggagaaacaaatcttccagaacgtgcagatgagtgtcaactttctcgtgtccttgctaaagaagaattggcaaaatgtgagatgcttgtacttgaagagtaccatgggaaagactcaacgcatcttctaaggacattgtattacaatctttgcagtttcaggcgttttgacttgtacgcgttatagatactattgaattttttgtttagttgtgctccttggatactgagttgaaaactttatatcagttttgttatgattttactttttattttctcctttctgttgattttcttgaatattgtcaactttcatatctaaaggaaaactcaaattttgtggtttaactgctattaaacctctttgcttttca

SEQ ID NO: 1436 - DNA, 983 bp, Solanum lycopersicum
atatatcactatactgagccacccttcgtctctcttacggcgctcacaaaccctaattagggtttcctcatacagaattgaagttttgaaggagaaaggagaagtatttgagccatgagtaagcttcagagcgaggcccttagagaagccatctctgtaattaagaatgattcggctgagaaaaagaggaagttctctgagactattgagctccagattgggcttaagaactatgatccccaaaaggacaaacgtttcagtggatctgtgaggttgcctcacattccacgtcctaagatgaagatttgcatgcttggagatgctcagcacgtgggggaggcagagaagatcggtttggagtacatggatgtcgagagcctcaagaagcttaataagaacaagaagttagttaagaagcttgcaaagaaataccatgctttcttggcttcagaatccgtcatcaagcagattcctcgtctcttgggtcctggtctgaacaaggcaggtaagtttccaacccttgtttcccaccaagagtcactcgagtctaaggttaatgaaaccaaggctaccatcaagttccagttgaagaaggtgctttgcatgggtgttgctgttggtaattgtgatatggaagagaaacaaatcttccagaatgtgcaaatgagcgtgaacttcttagtttctcttctaaagaagaattggcagaacgtaaggtgcttgtacttgaagagcaccatggggaagactcaacgtgtcttttaagacgacaagtctcgttattggagcctttcgtgcattcttcttgtaagagatagatattaatgaaaattttggatagtattcatccttgattatgtttttgaatgttatatcactataaggatcgatcatattgttgagacatttcaagagctctgttctttcttctcttagatgatgatttcatttgaatgatatgcagtatttctgttcttatcccc

SEQ ID NO: 1437 - DNA, 983 bp, Solanum lycopersicum
atatatcactatactgagccacccttcgtctctcttacggcgctcacaaaccctaattagggtttcctcatacagaattgaagttttgaaggagaaaggagaagtatttgagccatgagtaagcttcagagcgaggcccttagagaagccatctctgtaattaagaatgattcggctgagaaaaagaggaagttctctgagactattgagctccagattgggcttaagaactatgatccccaaaaggacaaacgtttcagtggatctgtgaggttgcctcacattccacgtcctaagatgaagatttgcatgcttggagatgctcagcacgtgggggaggcagagaagatcggtttggagtacatggatgtcgagagcctcaagaagcttaataagaacaagaagttagttaagaagcttgcaaagaaataccatgctttcttggcttcagaatccgtcatcaagcagattcctcgtctcttgggtcctggtctgaacaaggcaggtaagtttccaacccttgtttcccaccaagagtcactcgagtctaaggttaatgaaaccaaggctaccatcaagttccagttgaagaaggtgctttgcatgggtgttgctgttggtaattgtgatatggaagagaaacaaatcttccagaatgtgcaaatgagcgtgaacttcttagtttctcttctaaagaagaattggcagaacgtaaggtgcttgtacttgaagagcaccatggggaagactcaacgtgtcttttaagacgacaagtctcgttattggagcctttcgtgcattcttcttgtaagagatagatattaatgaaaattttggatagtactcatccttgattatgtttttgaatgttatatcactataaggatcgatcatattgctgagacatttcaagagctctgttctttcttctcttagatgatgatttcatttgaatgatatgcagtatttctgttcttatcccc

SEQ ID NO: 1438 - DNA, 980 bp, Solanum lycopersicum
tcatcatcggcttacaaaccctaaatcgagggttttctcttacaggtgagtttgaaggaggagagatttttgagccatgagtaagcttcagagtgaggccctcagagaagccatctctgtgattaagaatgattcagcggagaagaaaaggaagttcagcgagaccattgagctccagattggattgaagaactatgatccccaaaaggacaagcgtttcagtggatctgttaagttaccacacattcctcgccctaagatgaagatctgtatgcttggagatgctcagcatgtcggagaggcagaaaagattggtttggagtacatggatgttgaaggcttgaagaagctcaacaagaacaagaaactggtcaagaaacttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagttccaattgaaaaaggtgctctgcatgggtgttgctgttggaaacatggatatggaggagaagcagatcttccagaatgtgcaaatgagtgtcaactttcttgtttcattgctgaagaagaattggcaaaatgttaggtgcttgtacttgaagagcaccatgggaaaaacacaacgtatcttttaagaagatttctgtttctgttgttggaaatttttcaggctttctggctgtgagctgtagacactttgaaaattttgggtagttgtgatttttgtcatcttgttttgaatatctataaaacttttagggctatgtctgctttctcttcgttaatgatgttttcactgatcccagtaacaatccgagatgccaattgcagtacattactttattctgtagtttttgacactgaaacataaaactgtgttggttttta

SEQ ID NO: 1439 - DNA, 2385 bp, Solanum lycopersicum
atcatcggcttacaaaccctaaatcgagggttttctcttacaggtgagtttgaaggaggagagatttttgagccatgagtaagcttcagagtgaggccctcagagaagccatctctgtgattaagaatgattcagcggagaagaaaaggaagttcagcgagaccattgagctccagattggattgaagaactatgatccccaaaaggacaagcgtttcagtggatctgttaagttaccacacattcctcgccctaagatgaagatctgtatgcttggagatgctcagcatgtcggagaggcagaaaagattggtttggagtacatggatgttgaaggcttgaagaagctcaacaagaacaagaaactggtcaagaaacttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagttccaattgaaaaaggtgctctgcatgggtgttgctgttggaaacatggatatggaggagaagcagatcttccagaatgtgcaaatgagtgtcaactttcttgtttcattgctaaagaagaattggcaaaatgttaggtgcttgtacttgaagagcaccatgggaaaaacacaacgtatcttttaagaagatttctgtttctgttgttggaaatttttcaggctttctggttgtgagctgtagacactttgaaaattttgggtagttgtgatttttgttatcttgttttgaatatctataaaacttttagggctatgtttgctttctcttcgttaatgatgttttcactgatcccagtaacaatccgagatgccaattgcagtacattactttattctgtagtttttgacactgaaacataaaactgtgttggtttttataacaatctcacagtacatcataaaaagcttctttggtgtaatattctctaagagacttgaaaaaagaatatattcaagcctacaaattatttacaatgtctttagtaaaaagggcaactataagttgcaattttatttttttaattgactctttctaattagccttcgtggttagcttataaagaaattggtgtagttaccttgagaagtaagcttattattaaaccaaaactaaaggtgataaaacaatactcgtttcaagtttattattcacgaggcatcaccactctaaagaattaacagactgaaagattgatgtatgagagagatttagatcgatgatgcctgcgttgtagtccgagtcttgtagtgttccatttctaagttgaccgtagaaagtatttcgcactaatgattttggagagtgataaatatctcgtaatattaatttagattcacatgaactagtttggagagcgataaatattttgtaaaattaatttagattcatgtaaattagctcgaacaataatagtttttgttttgatcatatttcgaaaaagagtacaaaatgagtagggaagggcaaataggtaaagactcccattgtaattccaaaaagggtaaagaagaacccatgggctgcatcttaattcggcaatccccaaaacataactcactctatatatttgttgaaggtgacattttgagattgcctaacacattgctctcatttggagtctttctaatcctctctgctcgtccttgattactccgccttccttctccagtgaacatgtcaactgtcggacttgctgcaacctctatagtaaaaactgctcctcacacccaaagaaagagtgtcttcattaagaccccagtgtctctggggtttgtaaggagcatttctaagggctttggattgaagtctagctctggctttagagtagcagcatcagcagtttacaaggtcaagttggtttgtccagatggtgttgagcatgaactcgaggcatcttcagatacttacatactcgatgcagctgaaaatgctggagtcgaactcccttattcttgcagggcaggtgcatgctcaacatgtgctgggaagattgtatcaggatctgttgatcaatccgatggatcttttctggatgataatcaaatagaggagggctatgtgctcacatgtgtttcttacccaacctcagattgtgtgattcatactcaccaggaatctgatctttactagttatttatatatcaaattatgtgtatgctcttgttttaggttgaagcagttggaaaattgttctgtaattgagaatggtcaggtgtagaattcaatcaggaaccttttgtgtttgaatgatgttcgtttaatgaatggttcactttgtgaaaat

SEQ ID NO: 1440 - DNA, 932 bp, Tragopogon dubius
tatcagctgcttttggtgcgtaactacatcggcacttccaaaccctactacgagggttcttccgggagaattgaagcttaacgaaaggaaaagtctccgaatatgagtaaacttcaaagtgaagccctcagggaggcaattacccaaatcactacagatgcaaaggaaaagaagcgtaacttcacagaaaccattgaactccagatcggtttgaagaactacgacccacaaaaggacaaacgtttcagtggcaccgtgaaattgcctcacattcctcgacccaagctaaaagtatgcatgcttggtgatgcccagcacgttgaagaggctcaaaagattggtcttgagtacatggatgttgaagctttaaaaaagctgaacaaaaacaagaagatggttaagaaacttgccaagaaacatcaagctttcttagcttctgagtctgtcatcaagcagataccacgtttgttgggacctggtctaaacaaggccggtaagtttcccaccctagttacccaccaggaatctcttgagggaaaggtaaatgagacaaaggccacagtgaagtttcaattgaagaaggttctttgcatgggagttgctgtggggaactgcagtatggaagagaagcaaatctttcagaatgtgcaaatgagtgtcaactttcttgtgtctttgctcaagaagaattggcagaatgtgaggtgcctatacttgaagactacaatggggaagccagttcgtatcttttaaggagtttatttgttattctgttttgattttgggttaatgttaagtgagaaaagaagtgttttccttgaacaggaaatagctgtttttgacttgttacatgtttctttggtactttattattactttagacatgatatggatatttttcttgttctatttattagtgttttagaaataac

SEQ ID NO: 1441 - DNA, 869 bp, Tragopogon dubius
cggggggtttttcctctcgaacttcatcggcagtgctgctagggttctcaccaaagacgtgaagtttcaggaacggaaacttaacagccatgagtaagcttcagagtgaagctcttcgtgaagccattactcagatcacaaccgatgctaaggaaaagaagagaaacttcaccgagaccattgaactccagattggtctcaagaactacgacccccaaaaggacaagcgtttcagtggtacagtgaagttgcctcacattcctcgccccaagttgaaagtttgcatgcttggagatgcccaacatgttgaagaggctcaaaagataggccttgaatacatggatgttgaaggactcaagaagctaaacaagaacaagaagctagtgaagaagcttgccaagaaacatcaagctttcttggcttctgaatctgtcatcaagcagattcctcgtttgttaggccctggtctaaacaaagcaggaaaattcccaacacttgttacccaccaggaatccctagaaggtaaagtgaatgagaccaaggcaactgtgaagtttcagttgaagaaggttttgtgtatgggagttgctgttggaaactgcagcatggaggagaagcagattttccaaaatgttcaaatgagtgttaacttcttggtttcattgctcaagaagaactggcagaatgtgaggtgtctttacttgaagacaacaatggggaagcctgtgcgaatcttttaggtgtttgttttttgaaaattgggtgttgatcgtttttggtttgatgaatgtttaattttaaattgtattgctataaacattatgtttactggtagctttaaaccctttttaatcttttatctatttggg

SEQ ID NO: 1442 - DNA, 999 bp, Triphysaria pusilla
atttaaaagttttcacttcactgaaaccctagtcgtggtcttcctttcagccatcgaagcagaaacgagttcgggaagataagtgctcttgaatcatgagtaaacttcagagtgatgccctgagggaagccattactcagattgtctctgattgcaaggagaagaagaggaactttgttgagacagtcgagctccagataggactcaagaactatgatcctcagaaagataagcgtttcagtggttctgttaagcttccacacattccgagacccaaaatgaagatctgcatgcttggtgatgctcagcatgttgaagaggcaacaaagattggccttgagtccatggatgtggaggctctgaagaagctgaataaaaacaagaagctagtgaaaaaacttgctaagaagtatcatgctttcttagcctcagaatctgttatcaaacagattccccgtctcttgggtcccggtcttaacaaagcaggcaagttccccaccctcgtgtcacaccaagagtcactagaggcgaaggtcaatgagaccaaggctaccattaagtttcagttgaagaaggtgctttgcatgggtgttgctgttgggaaccttgacatggaggagaagcaaatcttccaaaacgtgcagatgagcatcaacttccttgtttcacttctcaagaagaattggcagaatgtgaggtgcttgtacttgaagagtaccatgggaaagacacaacgtatcttctaattagttttcaaacttgtagttcgattttgtgatggatagatatgcgtgagaggtgaagtcaagaacaatttgatatttcccagaaatgggtttgttttttattttctattatttttataattctcagattggtggcgttatcatattcaagcagaaattatttatgtcgattcatatatgacctagcatcttgctgttgctacttggtacttgccaagtctgtctatcaatggatattaaaatgattttcagc

SEQ ID NO: 1443 - DNA, 838 bp, Fraxinus spp
gagatattgaacaatgagtaagcttcagagcgaggccctgagagaagcaatttctgtaattgttaccgattctaaggagaaaaacgtaatttcacggagacgattgagcttcaaattgggctgaaaaattatgatccccagaaggataagcgattcagtggctcggtgaagttgcctcacattcctcgccccaaaaatgaagatttgcatgcttggtgatgctcagcatgttgaggaggcagaaaaaataggattggagtccatggatgtggaggctctcaagaagttgaaacaaaaaacaagaagttggttaaagaaacttgacaaaagaaatatcaatgctttcttagcctcagaagctgttatcaagcagattccgcgtctattaggacctggtcttaacaaggcaggaaagttccccaccttgtgtcacaccaggaatctcttgaatccaaggtcaatgagacgaaggccacagtgaaatttcaattgaagaaggttctttgcatgggagttgctgttggaaatttgggtatggaggagaagcagatctttcaaaacgtgcaaatgagtgtcaactttctagtttcactgctgaagaagaattggcagaatgtcagatgcttgtacttgaagagtacaatggggaagcctcagcgcatcttttaagatgtatgtttcttcacagctagttcgggaagtatttacgagcttaaacaattaaatgtatttatcatgaacattttttcctcactctcgtctgttcgaagcttgctgctattaatcaactgtttctgttggaaacaatctttttctctgaaatacatgcttagaaatc

SEQ ID NO: 1444 - DNA, 1100 bp, Amborella trichopoda
aatgcacgctacgcgtttatgagggggacttagggttttgcataacatctgtactctcagttgaagaggcgccggtcctgagagagagagacagggagagcctagcttgagagagaaatttagagaggcgccacaatgagtaagttgcagagtgatactttgagggaagtcatcggcaaggtgatgggtgatgcaaagaagaagaaccgtaaattcacagaaacaattgagcttcaaatcgggttgaagaactatgatccacagaaagataagcgtttcagtggctcagttaaattaccccatgttcctaggccgaagatgaaagtctgcatgcttggagatgctcagcatgttgaagaggcagagaagatgggattagactatatggatgttgaggggctaaagaagcttaataaaaacaagaagctggtgaagaaactcgcgaagaaatatcatgcttttctcgcatctgaagcagtcatcaagcaaattccaaggcttcttggacctggtctcaacaaggcggggaagttcccaactctggtttctcaccaagagtcattggaatccaaggtgaatgaaacaaaggccattgtcaaatttcaactaaagaaggtcctctgcatgggagttgctgtaggaaattgcgccatggaggagaagcaagtgttccaaaatgttcaaatgagtgttaactttttggtgtctctcttgaagaagaactggcaaaatgtcaggtctttgtatctcaagagtactatggggaaggctcatccgctattttaagtgggttttttttttggagcttcgttttttggattcattcagagtcaaaaggaaaggaaacattacatgtttgttgaagtcgttaccatgttctctcttttcatcttcttagtaacaatgagattggacttgcttgctccgaagctttaacatttttgattctagggtttattgccatgttggacaatgaggactccctattttgttttgtttttcttgttttatatgatagtttcaaatctctcattctctctctcactctcaatttttttgatttcagtgatttaaaaaatatcggtttggcatgaaattac

SEQ ID NO: 1445 - DNA, 793 bp, Ambrosia trifida
gggttcttaccgaagaagtgaagctaacgagaacagacatatcccagaatgagtaagctacagagtgaagctttgagagaggcaattacacagatcacaactgatgctaaagaaaagaaacgtaattttactgaaactattgagctacaaattggtttgaagaattatgatccacaaaaggataagcgtttcagtggtacagtgaagttgcctcacattcctcgccctaagttgaaagtttgcatgcttggtgatgcccaacatgttgaagaggcccaaaaaattggacttgagtatatggatgttgagagtttgaagaagctgaacaagaataagaagttggtgaagaaacttgctaaaaaacaccaagctttcttggcttctgagtctgtcatcaagcagattccccgtttgttgggtcctggtctaaacaaagctggtaagtttcccacacttgttagccatcaggaatcccttgaggcgaaagtcaatgagaccaaagcgacagtcaagtttcaactaaagaaggtgctctgcatgggagtcgctgttggaaactgcagcatggaggagaagcaaattttccaaaacgttcaaatgagtgtcaatttcttagtttctttgctaaagaagaattggcaaaatgtgcgatgcttatacttgaagacaacaatggggaagccggttcgcatcttttaaggaagagtttatttgtttgtatgtttttctttgggttaatgttaaggtcagtgttggaaagtatatttctcatgaacacaagaacagttttttt

SEQ ID NO: 1446 - DNA, 850 bp, Ambrosia trifida
agggttctcactaaaggttgaagttaacaagaggaaaagttactgaaaatgagtaagcttcaaagtgaagcccttagagaggcaattactcagatcactactgatgcgagggaaaagaaacgtaactttactgaaaccattgagcttcaaattggtttgaagaattacgatccacaaaaggacaagcgtttcagtggtaccgtgaaattgcctcacattcctcgccccaagcttaaagtttgcatgcttggagatgctcaacatgttgaagaggctcaaaaaattggccttgaatacatggatgtcgagagtctgaagaagttgaacaagaacaagaagttggtgaagaaacttgctaagaaacatcaagctttcttggcttctgagtcagtcatcaagcaggttccccgtttgttgggccccggtcttaacaaagcaggtaagttccctactcttgtttcccaccaagaatctctagaggcaaaggtcaacgagacgaaagcaacagtcaagtttcaacttaagaaggtgctctgcatgggagttgccgtcggaaactgcagcatggaagaaaagcaaatcttccagaatgttcaaatgagtgtcaacttcttggtttctttacttaagaagaattggcaaaatgtgcggtgcttgtacttgaagacgacaatgggaaagccggttcgcatcttttaaagagtttatttgttatgttttcatttcatttcgggttaatgttgaggtcagtactggaaaacatatttcccatgaacagggaatggtcctttttggctttttacatgtttgtttggtactatagctttggactccttcggttatatcattg

SEQ ID NO: 1447 - DNA, 820 bp, Ambrosia trifida
cgtctctgtcgccactatcaaaccctaatctcagggttcttaccgaagaagtgaagctaacgagaacagacataacccagaatgagtaagctacagagtgaagctctgagagaggcaattactcagatcacaactgatgctaaagaaaagaaacgtaatttcactgaaacaattgagctacaaattggtttgaagaattatgatccacaaaaggataagcgtttcagtggcacagttaaattgcctcatattcctcgccctaagttgaaagtttgcatgcttggtgatgcccaacatgttgaagaggctcaaaaaattggacttgagtatatggatgttgagagtctgaagaagctgaacaagaacaagaagctggtgaagaaacttgctaaaaaacaccaagctttcttggcttccgagtctgtcatcaagcagattccccgtttgttgggtcctggtctgaacaaagctggtaagttccccacacttgttagtcatcaggaatctctagaggcgaaagtcaatgagaccaaagcaacagtcaagttccaactgaagaaggtgctctgcatgggagtggctgttggaaactgcagcatggaggagaagcaaattttccaaaacgttcaaatgagtgtcaatttcttggtttctttgctaaagaagaattggcaaaatgtgcgatgcttatacttgaagacaacaatggggaagccggttcggatcttttaaggaagagtttatttgtttgtatgtttttcttttgggataatgttaaggtcagtgttggaaagtatatttctcatgaacacaagaacag

SEQ ID NO: 1448 - DNA, 973 bp, Ambrosia trifida
ggtttatacagaagacgtgaaactaaggaaaacctaacaaaaatgagtaagcttcagagtgaggccctgcgtgaagccattactcaaattaccaccgctgccaatgaaaagaagcgtaatttcactgagacaattgagctccagattgggctcaagaactacgacccacaaaaggataagcgtttcagtggcaccgtgaaattgcctcacattcctcgtcctaagttgaaggtttgcatgcttggggatgctcaacatgtagaagaggcccaaaagatcggtcttgaatacatggatgttgaaagtctcaagaagctcaacaagaacaagaagctagtgaagaagcttgccaagaaacaccaggcttttttggcttctgaatctgttattaagcagattcctcgtttgttgggccctggtctaaacaaggctggtaaattcccgacacttgtatcccaccaggaatccctcgaggctaaggtgaatgaaacgaaggcaactgtcaagtttcaactgaagaaagtgttgtgcatgggagttgctgttgggaactgcagcatggaggaaaaacagatttttcaaaacgtgcagatgagcgttaattttcttgtttcattgttgaagaaaaactggcagaatgtgcgatgtttgtacttgaagactacaatgggaaagcctattcgcatcttttaggtgtttatccttgtttttgctggaggccagttcttggaagcatttcccttcaatgggtgctattgtttttgacttgtcggatgtttgttttctttttgtgttagatgctgttatgaacattctgtttaatggttacagaccttttttctttttcatcaaatccaattcatctataaactcttcaaacaccagagtaaatccgaatccaactactacaaataaccagtagcaaaactgtgtacaacactagcatttttcacacgacggttgcttcatttga

SEQ ID NO: 1449 - DNA, 833 bp, Ambrosia trifida
tgccctggtgttaggaagaagagctaactgaaaatgagtaaacttcagagcgaagcccttagggaagccattactcagatcaccaccaatgctacagaaaagaaacgtaacttcaccgagaccattgagcttcagatcgggctcaagaactacgacccacaaaaggacaagcgttttagcggtactgttaagttgcctcacattcctcgtcccaagttgaaggtttgcatgcttggagatgcccagcatgtggaagaggctcaaaagattggtcttgaatacatggatgttgaaggacttaagaaacttaacaagaacaagaagctggtgaagaagctagccaagaaacaccaggcttttttggcttccgaatccgttatcaagcaaattcctcgtttgttgggccctggtctaaacaaggcaggaaagttcccaacactcgttagtcaccaggaatctctcgaggctaaggtgaatgaaaccaaagcaacggttaagtttcaactgaaaaaggtgctgtgcatgggagttgctgttggcaactgcagcatggaggagaaacagattttccaaaacgtgcagatgagcgttaatttcctcgtttcattgttgaagaagaactggcaaaatgttagatgtttgtacttgaagacaacgatgggaaagccgattcgcatcttttagatattttgtttgtttttttgttttcgaacttgtgaggtcagttcttggaagcatttccttttaataggcggtgttggttttgtctcttattcgtgtcttagttgatacgataaacgttatgtttaatggttaccgcgattttatctgtg

SEQ ID NO: 1450 - DNA, 920 bp, Ambrosia trifida
agagtaacgcggagacaataagtctgttttttgttgcagaactactacggtcacttccaaaccctattcttaggtttcttactaaaggttgaagataacaagaggaaaagttaactgaaaatgagtaagcttcaaagtgaagcccttagagaggcaattactcagatcactactgctgcaactgaaaagaaacgtaactttactgaaaccattgagcttcaaattggtttgaagaactacgacccacaaaaggacaaacgtttcagtggtaccgtgaaattgcctcacattcctcgccccaagcttaaagtttgcatgcttggagatgctcaacatgttgaagaggctcaaaaaatcggccttgaatacatggatgttgagagtttgaagaagttgaacaagaacaagaagttggtgaagaaactcgctaagaaacatcaagcttttttggcttctgagtctgtcattaagcagattccccgattgttgggccccggtcttaacaaagcaggtaagttccctactcttgtttcccaccaagaatctctagaggcgaaggtcaacgagacaaaagcgacggtcaaatttcaacttaagaaggtgctctgcatgggagttgccgttggaaactgcagcatggaagaaaagcaaatctttcagaatgttcaaatgagtgtcaacttcttagtttctttgcttaagaagaattggcaaaacgtgcgatgcttgtacttgaagacaacaatgggaaagccgattcgcatcttttaaagagtttatttgttatgttttcgttttggattaatgttgaggtcagtactggaaaacatatttcctatgaacagggaatagtccttttttggctttttacatgtttgtttggtactatagtttggaccctgctgctgcttatatcattg

SEQ ID NO: 1451 - DNA, 850 bp, Arnica chamissonis
catacagaagaaggtgaactctagcgaaggaaaacctaaaaaaaatgagtaagcttcagagtgaagccctacgtgaagcgattactcaaattaccaccgatgccaaggagaagaaacgtaatttcactgagactattgagctccagattgggctcaagaactacgacccacaaaaggacaaacgtttcagtggcactgtgaaattgcctcacattcctcgtcctaaactgaaagtttgcatgcttggggatgctcagcatgtagaagaggctcaaaagattggtcttgaatacatggatgtagaaggactcaagaagctgaacaaaaacaaaaagctggtgaagaagcttgccaagaaacaccaggcttttctggcttctgaatctgttatcaagcagattcctcgtttgttgggccctggtttaaacaaggctggtaaattcccgacacttgttagtcaccaggaatcccttgaggctaaggtgaatgaaacgaaggcaactgtcaagtttcaactgaaaaaagtgttgtgcatgggagtggctgtcgggaactgcagcatggaggaaaaacagatttttcagaacgtgcagatgagtgttaattttcttgtttcgctgttgaagaaaaactggcagaatgttcgttgtttgtacttgaagacgacaatgggaaagccggttcgcatcttttaggtgtttatctctgattttgattgaggtccgttcttggaagcattttcatttgataggtgctgttgtttttgacttgttgaattttgtcttccttttgtattagatgctgctatgaacattatgtttaatggttacgaacttttttaattaaactt

SEQ ID NO: 1452 - DNA, 910 bp, Brassica napus
gattcgttcaaccgagagaaactcaagatgagtaagcttcagagtgaggctcttagagaagccatcacaaccatcaagggcaaatctgaggacaagaagcgtaactttgtggagacgattgagcttcagattggtctgaagaactacgacccgcaaaaggacaagcgtttcagtggatctgtcaagctcccgcacattcctcgccctaagatgaaggtctgcatgcttggagatgctcagcacgttgaggaggctgagaagatgggtctagactctatggatgttgaggctttgaagaagcttaataagaacaagaagcttgttaagaagcttgcaaagaagtaccatgctttcttggcttctgagtcagtcatcaagcagattccccgtcttcttggtcctggtcttaacaaagctggaaagttcccaactctagtgagtcaccaggagtccttggaagggaaggtgaatgagacaaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggaccaccacaaaggatcttttgagttctctgctctttcatcttcgaacttttgctttgtggtttttgtttgtttcagagaacttaagttatggttttgtttggtattagcagaactgaagtgttagtttgctttttgttaagacattataatatgcactgttggattctacaatgtcgactctccagttcaattttatctttatcaattattcgtaaaacaactctattcgtaactagtagactagccaacgaca

SEQ ID NO: 1453 - DNA, 1079 bp, Cirsium arvense
acgcggggaaacgcagggttcttcttcttcttcacacagaagtgcaagttagcgaaaggaatagtttgtgaacatgagtaagctgcaaagtgaagcccttagggaggctattactcagattactaccgatgccaaggaaaagaaacgtaacttcactgagaccattgagctccagatcggtttgaagaactacgacccccaaaaagacaaacgtttcagtggtaccgtgaaattgccacacattccccgtcccaaattgaaagtttgtatgcttggagatgcccagcatgttgaagaggctcaaaagattggccttgaatatatggatgttgagggtttgaaaaagttgaacaagaacaagaagttggtgaagaaacttgctaagaaacaccaagctttcttggcttctgagtctgtcatcaagcagattcctcgtttgttgggacctggtctaaacaaggcaggtaagttccctactcttgttacccaccaagaatcccttgaggctaaggtaaatgagaccaaagcaactgtaaagttccaactgaagaaggtgctctgcatgggagttgctgttggaaactgcagcatggaggacaaacagatattccagaacgtgcaaatgagcgtcaacttccttgtttcgttgctgaagaagaattggcaaaacgtgaggtgcttatacttgaagacaacaatgggaaagccggttcgcatcttttgaagagtttatttatgttttcattttgtaatgttgaggttgctactttaagaggttgttttctatcaaaaggaaatactccattttgttttggttgctactatatttttagatggctcacttcagacatttctataaattgttctttttatgtattagttctttagatttgtctcttcaattttactgtgaacaagaacttcatgatatgagatttctgagttttctgcaaaaaagaaaaagtaccgactgcgactctagatgcataaatagatacatgttacaaggttcttgatctataggcaccttgaatgcaaaacatgttaaaagaaactcccacacctactcgttttcttat

SEQ ID NO: 1454 - DNA, 904 bp, Cirsium arvense
cggcactgccacttcctcctactcctagggttctcttcgaagaagtgaagtttaaggaaggaaaacttatcaaccatgagtaagcttcagagtgaagctctccgagaagccattacccagattactactgatgccaaggaaaagaagagaaattttactgagactattgagctccagattgggctcaagaactacgacccacaaaaggataagcgtttcagtggtacagtgaagttgcctcacattcctcgtcccaaattgaaagtttgcatgcttggagatgcccagcatgtggaagaggctcaaaagataggcctagaatacatggatgtggaagggctcaagaagctcaacaagaacaagaagctggtgaagaagcttgctaagaagcaccaagcttttttggcttctgaatctgtcatcaagcagatcccccgtttgttgggccctggtctaaacaaggctggaaaattccctacgcttgttactcaccaagaatctctcgaggctaaggtgaatgagaccaaagcaactgtgaaatttcaactgaaaaaggtgctgtgcatgggagttgctgtcggaaactgcagcatggaggataagcagattttccaaaacgtgcaaatgagcgtcaactttcttgtttctttattgaagaagaattggcaaaatgtgaggtgtttgtacttgaagacaacaatgggaaagccagttcgcatcttttaggtgttttctttctttgtttctcagagttgttcggtttgaggtcagtacttggtgaaagcatttagtgggtgcttatcgtttttgacttgtcgaatgttgggttttttaatactgtattagatgatgattatgctgctaccatgaacaagtattattcgttttaaaatgcaccaatcga

SEQ ID NO: 1455 - DNA, 774 bp, Flaveria ramosissima
cagttgtttctggtgaaactgtcggcactttgaaaccctaatcttagggttctcaccggagaattgaaggtaaggagaacggaagtttccgataatgagcaagcttcaaagtgatgccctcagagaggcaattactcagatcaccactgatgccaaagaaaagaaacgtaatttcactgagaccattgagcttcaaattggtttgaagaattacgacccacaaaaggacaaacgttttagtggtacagtgaagttgcctcacattcctcggcccaagttgaaagtttgcatgcttggagatgcccaacatgttgaagaggctcaaaaaattggcctagaatatatggatgttgagagtctgaagaagcttaacaagaacaaaaagttagtgaagaaactcgctaaaaaacaccaagctttcctggcttctgagtctgtcatcaagcagattcctcgtttgttgggccctggtcttaacaaagctggtaagtttccgacacttgtgacccaccaagagtcccttgaggcgaaggtgaacgagactaaagcaacagtgaagtttcaactaaagaaggtgttgtgcatgggagttgctgttggaaactgcagcatggaggaaaagcaaatttttcaaaacgttcaaatgagtgtcaattttcttgtttctttgctcaagaaaaattggcaaaacgtccggtgcttatacttgaagacaacaatggggaagcctgttcgcatcttttaaggtgtttatttgttatgttttgatgaaca

SEQ ID NO: 1456 - DNA, 856 bp, Flaveria ramosissima
ctgctgttagggttcctaccgtagaagtgaagcttaaggaaggagaacggaacgaaaatgagtaagcttcagagtgatgccctacgtgaagccattactcaaattaccactgatgctaaggaaaagaaacgtaacttcactgagaccatcgagctccagattgggctcaagaactatgacccacaaaaggacaagcgtttcagtggaactgtgaaattgcctcacattcctcgtcctaaattgaaagtttgcatgctcggggatgctcagcatgtagaagaggctcaaaagatcggtcttgaatacatggatgtagaaggactcaagaagctcaacaagaacaagaagctggtgaagaagcttgctaagaaacaccaggcttttttggcttctgaatctgttattaagcagattccccgtttgttgggccctggtctaaacaaggcaggtaaatttccaacacttgttactcaccaagaatctctcgaggctaaggtgaatgaaacaaaggcaaccgtcaagtttcaactgaaaaaggtgttgtgcatgggtgttgctgtcgggaactgcagcatggaggaaaaacagatttttcaaaatgtgcagatgagcgttaattttcttgtttctttgttgaagaaaaactggcagaatgtgcgatgtttgtacttgaagactacaatgggaaagccggttcgtatcttttaggtgttcattgtttttgcttgaggtcagttcttggaagcatttccctttaatgggtgctattgtttttgacttgttggatgttggttttcttattgtattagactgctatgaacattatgtttaatggttactaaaccttttattatac

SEQ ID NO: 1457 - DNA, 975 bp, Flaveria ramosissima
cctcgaacttcattcggcgttgctgttagggttctaccgaagaagagaggtttaagggaggaaaacctaacgaaaaatgagtaagcttcagagtgatgcccttagggaagctattacccaaattaccaccgatgctaaagaaaagaaacggaatttcactgagaccattgagcttcagattggtctcaagaactacgacccacaaaaggacaaacgtttcagcggaactgtgaagttgcctcacattcctcgacccaaattgaaagtttgcatgcttggagatgcccagcatgtagaagaggctcaaaagattggtcttgaatacatggatgttgaaggactcaagaagctcaacaagaacaagaagctggtgaagaagctcgccaagaaacaccaggcttttttggcttctgaatccgtcatcaagcaaattcctcgtttgttgggccctggtcttaacaaggcaggaaagttcccgacacttgttactcaccaggaatcccttgaggctaaggtgaatgaaactaaggcgacagtcaagttccaactgaaaaaggtgttgtgcatgggagttgctgttggtaactgcagcatggaggaaaaacagattttccaaaatgtgcagatgagcgttaatttcctcgtttcattgctgaagaaaaactggcagaatgtgagatgtttgtacttgaagacaacaatgggaaagccagttcgtatcttttaggtattcagtctgtttttctcttacaaatttgttgtgaagtggtgtccgttttgacttatcaggtctctgttatgtgttatcttctcgttttagatgataccatgaacgctatgtttactggttacaagtattttaacaatgtttttgtcatctcaaggagagtgtttgttttagaaaaaaaaaaaaaaaaagaaatactgtgtgtgtacacatctacttgtagactagcgacgaagcacaggaggtag

SEQ ID NO: 1458 - DNA, 776 bp, Flaveria ramosissima
tatttgggttctcaccggagaagtgaaggtaaggagaacagaagtttccgaaaatgagcaagcttcaaagtgatgccctcagagaggcaattactcagatcaccactgatgccaaagaaaagaaacgtaatttcactgagaccattgagcttcaaattggtttgaagaattacgacccacaaaaggacaaacgttttagtggtacagtgaagttgcctcacattcctcggcccaagttgaaagtttgcatgcttggagatgcccaacatgttgaagaggctcaaaaaattggcctagaatatatggatgttgagagtctgaagaagcttaacaagaacaaaaagttggtgaagaaactcgctaaaaaacaccaagctttcttggcttctgagtctgtcatcaagcagattcctcgtttgttgggccctggtcttaacaaagctggtaagtttccgacacttgtgacccaccaagagtcccttgaggcgaaggtgaacgagaccaaagcaacagtgaagtttcaactaaagaaggtgctgtgcatgggagttgctgttggaaactgcagcatggaggaaaaacaaattttccaaaacgttcaaatgagtgtcaattttcttgtttctttgctcaagaaaaattggcaaaatgtccggtgcttatacttgaagacaacaatggggaagcctgttcgcatcttttaaggcgtttatttgttatgttttgatgaacacgttgatagctttttttggctcgtcacatgtttgttttgtaac

SEQ ID NO: 1459 - DNA, 806 bp, Flaveria ramosissima
agaattgaagctgacgagaggagaagtctctgaaaatgagtaagcttcaaagtgatgcccttagagaggcgattactcagatcaccactgatgctaaggaaaagaagcgtaacttcaccgaaaccattgagcttcaaattggtttgaagaattacgatccacaaaaagacaaacgtttcagtggtaccgtgaagttgcctcacatacctcgccccaagcttaaagtttgcatgcttggagatgctcaacatgttgaggaggcacaaaaaattggtcttgaatatatggatgttgaggggttgaagaaactgaacaagaacaagaagttggtgaagaaacttgctaagaaacatcaagcttttttggcttctgagtctgtcatcaagcagattccccgtttgttgggccccggtctaaacaaagcaggcaagttcccaactctcgttacccaccaagaatcactcgaggctaaagtcaatgagactaaagcaacagtcaagttccaactgaagaaggtgctctgcatgggagttgctgttggaaactgcagcatggaagaaaagcaaatcttccaaaacgtccaaatgagtgtcaacttcttagtttctttgcttaagaagaattggcaaaatgtgcggtgcttgtacttgaagacaacaatgggaaagccggtgcgcatattttaagttcatctgttatgtttttattttggtttaatgttgaggttagtacccaaaaacaaatttcccatgaactgggagtaatcttttttggctctttacatgtttgtttggcacaatattttt

SEQ ID NO: 1460 - DNA, 983 bp, Flaveria ramosissima
tactcacactttgatagcagataatgacgattctgttgtaattcgatgcgtattgttatttaacaagcttgtggttatcacttatcaatcatatgaacttagatcttgtttcgatgattttttgatgcgtaggattcattgatgtgaaatttttgttttttgtgtttgattatttgcagaattgaagctgacgagaggagaagtctctgaaaatgagcaagcttcaaagtgatgcccttagagaggcgattactcagatcaccactgatgctaaggaaaagaagcgtaacttcactgaaaccattgagcttcaaattggtttgaagaattacgatccacaaaaagacaaacgtttcagtggtactgtgaagttgcctcatatccctcgccccaagcttaaagtttgcatgcttggagatgctcaacatgttgaagaggcacaaaaaattggtcttgaatatatggatgttgaggggttgaagaagctgaacaagaacaagaagttggtgaagaaacttgctaagaaacatcaagctttcttggcttccgagtctgtcatcaagcagattcctcgtttgttggggcccggtctaaacaaagcaggcaagttcccaactcttgttacccaccaagaatcactcgaggctaaagtcaacgagactaaagcaacagtcaagttccaactgaagaaggtgctctgcatgggagttgctgttggaaactgcagcatggaagaaaagcaaatcttccaaaacgttcaaatgagtgtcaacttcttagtttctttgcttaagaagaattggcaaaatgtgcggtgcttgtacttgaagacaacaatgggaaagccggtccgcatcttttaagttcatttgttatgtttttattttggtttaatgttgaggttagtacccaaaaacaaatttcccatgaactgggagtaatcttttttggctcttcacatgtttgtttggcacaatattttt

SEQ ID NO: 1461 - DNA, 834 bp, Flaveria ramosissima
cctaacgtagaagtgaagcttaacgaaggagagcgtaacgaaaatgagtaagcttcagagtgatgccctacgtgaagccattactcaaattaccactgatgctaaggaaaagaaacgtaacttcactgagaccatcgagctccagattgggctcaagaactatgacccccaaaaggacaagcgtttcagtggaaccgttaaattgcctcacattcctcgtcctaaattgaaagtttgcatgcttggggatgctcagcacgtagaagaggctcaaaagatcggtcttgaatacatggatgtagaaggactcaagaagctcaacaagaacaagaagctggtgaagaagcttgctaagaaacaccaggcttttttggcttctgaatctgttatcaagcagattccccgtttgttgggccctggtctaaacaaggcaggtaaatttccaacacttgttactcaccaagaatctctcgaggctaaggtgaatgaaacaaaggcaaccgtcaagtttcaactgaaaaaagtgttgtgcatgggagttgctgttgggaactgcagcatggaggaaaaacagatctttcaaaacgtgcagatgagcgttaattttctcgtttcattgttgaagaaaaactggcagaatgtgcgatgtttgtacttgaagactacaatgggaaagccagttcgcatcttttaggtgtttatctttctttttgcctgaggtcagttcttggaagcacttccctataatgggtgccattgtttttgttttgttggatgtttgttttcttattgtattagatgctgttatgaacattatgtttaatggttacaaac

SEQ ID NO: 1462 - DNA, 842 bp, Flaveria ramosissima
ggtgctgctgttagggttcccaacgtagaagtgaagcttaacgaaggagagcgtaacgaaaatgagtaagcttcagagtgatgccctacgtgaagccattactcaaattactaccgatgctaaggaaaagaaacgtaactttactgagaccatcgagctccagattggactcaagaactatgacccacaaaaggacaagcgtttcagtggcaccgtgaaattgcctcacattcctcgtcctaaattgaaagtttgcatgctcggggatgctcagcatgttgaagaggctcaaaagatcggtcttgaatacatggatgtagaaggactcaagaagctcaacaagaacaagaagctggtgaagaagcttgctaagaaacaccaggcttttttggcttctgaatctgttatcaagcagattccccgtttgttgggccctggtctaaacaaggcaggtaaatttccaacacttgttactcaccaggaatctcttgaggctaaggtgaatgaaacaaaggcaaccgtcaagtttcaactgaaaaaagtgctgtgcatgggagtggctgtcgggaactgcagcatggaggaaaaacagatttttcaaaacgtgcagatgagcgttaattttcttgtttcgttgttgaagaaaaactggcagaatgtgcgatgtttgtacttgaagacaacaatgggaaagccggttcgcatcttttaggtgttcatcattttttttgcttgaggtcagttcttggaagcatttccatttaatgggtgctattgtttttgacttgttgaatgtttgttttcttattgtattagatgctgctatgaacattatgtttaat

SEQ ID NO: 1463 - DNA, 788 bp, Flaveria ramosissima
tcggcgttgctgttagggttctaccgaagaagagaggtttaaggaaggaaaatctaacaaaaaatgagtaagcttcagagtgatgcccttagggaagctattacccaaattaccaccgatgctaaagaaaagaaacgtaatttcactgagaccattgagcttcaaattggtcttaagaactacgacccacaaaaggacaaacgttttagcggaactgtgaagttacctcatattcctcgacccaaattgaaagtttgcatgcttggagatgcccagcatgtggaagaggctcaaaagattggtcttgaatacatggatgttgaaggactcaagaagctcaacaagaacaagaagctggtgaagaagcttgccaagaaacaccaggcttttttggcttctgaatccgttatcaagcaaattcctcgtttgttgggcccaggtttaaacaaggcaggaaagttcccaacacttgttacccaccaggaatccctcgaggctaaggtgaatgaaactaaggcgacagtcaagtttcaactgaaaaaggtgttgtgcatgggagttgctgttggtaactgcagcatggaggaaaaacagatcttccaaaatgtgcagatgagcgttaatttcctcgtttcattgctgaagaaaaactggcagaatgtgagatgtttgtacttgaagacaacaatgggaaagccagttcgcatcttttaggtatcaagtctgtttttctttcaaatttgttgcgaggtggtgactgttttgacttatcagatatctgttatgtg

SEQ ID NO: 1464 - DNA, 777 bp, Flaveria ramosissima
tcggcgttgctgttagggttctaccgaagaagcgaggtttaagggaggaaaacctaacgaaaaatgagtaagcttcagagtgatgcacttagggaagctattacccaaattaccaccgatgctaaagaaaagaaacgtaatttcactgagaccattgagcttcagatcggtctgaagaactatgatccacaaaaggacaaacgttttagcggaactgtgaagttgcctcacattcctcgtcccaaattgaaagtttgcatgcttggagatgcccagcatgtagaagaggctcaaaagattggtcttgaatacatggatgtcgaaggactcaagaagctcaacaagaacaaaaagctggtgaagaagcttgccaagaaacaccaggcttttttggcttctgaatccgtcatcaagcaaattcctcgtttgttgggcccaggtttaaacaaggcaggaaagtttccgacacttgttactcaccaggaatcccttgaggctaaggtgaatgaaaccaaggcaacagttaagtttcaactgaaaaaggtgttgtgcatgggagttgcggttggtaactgcagcatggaggaaaaacagattttccaaaacgtgcagatgagcgttaatttcctcgtttcattgctgaagaaaaactggcagaatgtgagatgtttgtacttgaagacaacaatgggaaagccagttcgcatcttttaggtattcagtctgttttttcttacaaatttgttgtgaggtggtgtcggttttgacttatatatt

SEQ ID NO: 1465 - DNA, 953 bp, Helianthus annuus
gatagccatttctgtgcgtgactctgtcgccactttgaaaccctaatctcagggttctttactggagaagttaagctaaccagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagtggtacagtgaagttgcctcacattcctcgccccaaattgaaagtttgcatgcttggagatgcccaacatgttgaagaggcccaaaaaataggacttgagtatatggatgttgagggactgaagaagctgaacaagaacaagaagttggtgaagaagcttgctaaaaaacaccaagctttcttggcttctgagtctgtcatcaagcaaattcctcgtttgttgggtcctggtctaaacaaagctggtaagttcccgacacttgttagtcatcaggaatccctcgaggcgaaagtcaatgagaccaaagcaacagtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgagatgcttatacttgaagacaacaatggggaagccagttcgcatcttttaaggaagagtttatttgtttgtatgttttaattttgggttaatgttaaagtcagtgctggaaagtatatttctcatgaacacaggaataggtttttctttggcttgttacatgtttgtttttgtagcactataaaatctatttactttgaggttaaaaaaatactcttatccgggaaaaaacaaacaggaaatctaatagcaaa

SEQ ID NO: 1466 - DNA, 836 bp, Helianthus annuus
taacaaaaaatgagtaagcttcagagtgaagcccttagggaagccattacccaaattaccaccgatgccaaagaaaagaagcgtaacttcaccgagaccattgagcttcagatcggtctcaagaactacgacccacaaaaggacaagcgtttcagcggtaccgtaaaattgcctcacattcctcgcccaaagttgaaggtttgcatgcttggagatgctcagcatgttgaagaggctcaaaagattggtcttgaatacatggatgttgaaggactcaaaaagctcaacaagaacaagaagctggtgaagaagcttgccaagaaacaccaggcttttttggcttctgaatccgtcatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgttggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgctatgaacattcttgtgttttgttatttattaaagataatacatgctttaaaagagtt

SEQ ID NO: 1467 - DNA, 840 bp, Helianthus annuus
taacaaaaaatgagtaagcttcagagtgaagcccttagggaagccattacccaaatcaccacagatgccaaagaaaagaagcgtaacttcaccgagactatcgagcttcagatcggtctcaagaactacgacccacaaaaggacaagcgtttcagcggtactgtaaagttgcctcacattcctcgtcccaaattgaaggtttgcatgcttggagatgcccagcacgtggaagaggctcaaaagattggtcttgaatacatggatgttgaaggactcaaaaagctcaacaagaacaagaagctggtgaagaagcttgccaagaaacaccaggcttttttggcttctgaatccgttatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgttggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgttatgaacattcttgtgttttgttatttattaaagataatacatgctttaaaagagtttttc

SEQ ID NO: 1468 - DNA, 901 bp, Helianthus annuus
ttactaagttgaataatactataactcagccgctgtcttcctccctgcttgcagttagggtttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgtcctaagttgaaagtttgcatgctcggggatgctcagcatgtagaagaggcccaaaagatcggtcttgaatacatggatgttgaaggacttaagaagctcaacaagaacaaaaagttggtgaagaagcttgccaagaaacaccaagcgtttttggcttctgaatctgttatcaagcagatccctcgtttgttgggccctggtctaaacaaggccggtaaattcccgacacttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccagttcgcatcttttaggtgttttatcgttgtttttggttgagccagtttcaggaagcatttccatttaatgggtgctattgtttttgacttgttggatgtttgttttcttattgtattagatgctgctatgaacattatggttaatggttacagaccattt

SEQ ID NO: 1469 - DNA, 938 bp, Helianthus annuus
ttcacagaacatttagggtttcagcctcatatattacaatcagctgtttttggtgcgtaactcttatcggcactttgaaaccctaactctcagagaattgaaggtatcgagaggaagagtttccgaaaatgagtaagcttcaaagtgaagcccttagagaggcaattactcagatcactacagatgcaaaggaaaagaaacgtaacttcactgaaaccattgagctacaaattggtttgaagaattacgatccacaaaaggacaaacgtttcagtggaaccgtgaagttgccccacattcctcgccccaagcttaaagtttgcatgcttggagatgctcaacacgttgaagaggctcaaaaaattggtcttgaatatatggatgttgagggtttaaaaaagctgaacaagaacaagaaattggtgaagaaacttgctaagaagcatcaagctttcttggcttctgagtctgttatcaagcagattcctcgtttgttgggccccggtcttaacaaagcaggtaagttccctactcttgtttcccaccaagaatctctcgaggcaaaagtcaacgagacgaaagcgacagtcaaattccaacttaagaaggtgctttgcatgggagttgctgttggaaactgcagcatggaagagaagcaaatcttccaaaatgttcaaatgagtgtcaatttcttggtttctttacttaaaaagaattggcaaaacgtgcggtgcttgtacttgaagacaacaatgggaaagccggttcgcatcttttaaggagtggctttggttatgttttttattttgggttaatgttgaggtcagtactggaaaatgtatttcccatgaatggggaataatcctttttggctttttacatgtttgtttggtactgtatttttggaccctcttcttatatcattgttttgattttgc

SEQ ID NO: 1470 - DNA, 824 bp, Helianthus annuus
caaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgtcccaaattgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgttttatctttgtttttggttgagccagtttcaggaagcatttccatttaatgggtgctattgtttttgacttgttggatgtttgttttcttattgtattagatgctgctatgaacattatggttaatggtta

SEQ ID NO: 1471 - DNA, 825 bp, Helianthus annuus
accgaagaagtgaagtttcagtaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccgcaaaaggacaagcgtttcagtggcaccgtgaaattgcctcacattcctcgtcctaagttgaaagtttgcatgctcggggatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacacttgtttcccaccaggaatccctcgaggctaaggtgaatgaaaccaaggcaactgtcaagtttcaactgaaaaaggtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgtttatcgttgtttttggttgagccagtttcaggaagcatttccatttaatgggtgctattgtttttgacttgttggatgtttgtttttctattgtattagatgttgctatgaacattttggttaatggtta

SEQ ID NO: 1472 - DNA, 842 bp, Helianthus annuus
gctgcagttagggttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaaacgtttcagtggcaccgtgaaattgcctcacattcctcgtcccaaattgaaagtttgcatgcttggagatgctcagcatgtggaagaggcccaaaagattggtcttgaatacatggatgttgaaggtctcaagaagctcaacaagaacaaaaagctcgtgaagaagcttgccaagaagcaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagtgttaattttcttgtttcgttgttgaagaaaaactggcagaatgtccgatgtttgtacttgaagacgacaatgggaaagccggttcgcatcttttaggtgtttatctttgtttttggttgagccagttgttggaagcatttccctttaatgggtgctattgttttcgacttgttggatgtttgttttcttattgtattagatgctgctatgaacattatggttaatggtta

SEQ ID NO: 1473 - DNA, 911 bp, Helianthus annuus
cgataagccatttttggtgcgtgactctgtcgccactttcaaaccctaatctcagggttctttacaggagaagttaagctaacgagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagtggtacagtgaagttgcctcacattcctcgccccaaattgaaagtttgcatgcttggagatgctcaacatgtggaagaggcccaaaaaataggacttgagtatatggatgttgagggactgaagaagctgaacaagaacaagaagttggtgaagaagcttgctaaaaaacaccaggctttcttggcttctgagtctgtcatcaagcaaattcctcgtttgttgggtcctggtctaaacaaagctggtaagttcccgacacttgttagtcatcaggaatccctcgaggcgaaagtcaatgagaccaaagcaacagtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgcgatgcttatacttgaagacaaccatggggaagccagttcgcatcttttaaggaagagcttatttgtttgtatgttttaattttgggttaatgttaaagtcagtgttggaaagtatatttctcatgaacacaggaataggtttttctttggcttgttacatgtttgtttttgtagcactataaaatctatttactttgaggttaaaaa

SEQ ID NO: 1474 - DNA, 875 bp, Arabidopsis lyrata
caggatcagatcttagctaaattgagacaagctcaaaatgagtaagcttcagagtgaggccgtgagagaagccatcactattatcacagggaaatccgatgcaaagaaacgtaactttgtggagactgttgagctccagatcggtctgaagaactatgatcctcagaaggacaagcgtttcagtggatctgtcaagttaccacatatcccccgtcctaaaatgaagatctgcatgctcggagatgcccagcatgttgaagaggctgagaaaatgggactggaaaatatggatgttgagtctctaaaaaagcttaacaaaaacaagaaactcgtcaagaagcttgcgaagaaataccatgctttcttggcctctgaatctgtcattaagcagattccacgtcttcttggtcctggtctcaacaaggcaggaaagttcccaactcttgtgagccaccaggaatccttagagtcaaaggtgaatgaaacaaaggcaacagtgaaattccagctgaagaaggttctgtgcatgggagttgcagttggtaacctttccatggaagagaagcagatctttcagaatgttcagatgagtgtcaacttcctcgtctcgctattgaagaagaactggcaaaatgtcaggtgtttgtacctcaagagcacaatgggaccaccacaaagaatcttctgagctctcgccaacttgaatcgtgcctataagacacttcttcttgccctttgtttttgtttcagacacatctgtgaaacagtgtaagagttgtgctactctcctctttagcttttggtttggataatttaaattttaaaagaactgcaatgagatttgggttgatagcttttgtagcttatattatctt

SEQ ID NO: 1475 - DNA, 950 bp, Arabidopsis lyrata
atttttcctcttccttgatataaaatcttcagccgcctctgtaacacaattagggcttccgctttcttcacctttcaggatcagagattcgtgacctgagaagaaactcaatatgagtaagcttcaaagtgaggctcttagagaagccattacgacaatcaagggcaaatccgaggagaaaaaacgtaactttgttgagacagtggaacttcagattggtctgaagaactatgacccacaaaaggataagcgtttcagtggatctgtgaagctaccgcatattcctcgcccgaaaatgaagatctgtatgcttggagatgctcagcatgttgaggaggcagagaaaatgggacttagtaacatggatgttgaggctttgaaaaagcttaacaagaacaagaagcttgttaagaagcttgctaagtcttaccatgctttcttggcttctgaatctgtcattaagcagattcctcgtcttcttggtcctggtcttaacaaggcaggaaagttcccaactcttgtgagtcaccaagagtctttggaagcaaaggtgaatgagaccaaagcgacagtgaagttccagttgaagaaagttctgtgtatgggtgttgctgttggtaacctttcaatggaagagaagcagcttttccagaatgtgcagatgagcgttaacttcctcgtctcgctcttgaagaagaattggcaaaacgtaaggtgtttgtacttgaagagcaccatgggaccaccacaaagaatcttttgagctctctcttcttctccttcttccatctcagaattttgcattctgtttttgtttcagagatctgtgcttgttgggatatggtttggatttatattagcagttgtttttggttgacaatatatgatgcactatctattcagttcaattatcgtttacctatattatctcctaaaacatgcatttgatt

SEQ ID NO: 1476 - DNA, 934 bp, Brassica juncea
gggtttcctctgcttcacctctcaggttcagagattcgttcaaccgagagaaactcaagatgagtaagcttcagagtgaggctcttagagaagccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatgggactagactctatggatgttgaggctttgaaaaagctcaacaagaacaagaagcttgttaagaagcttgcaaagaagtaccatgctttcttggcttctgaatcagtcatcaagcagattccccgtcttcttggtcctggtcttaacaaagctggaaagttcccaacactagtgagtcaccaagagtcgttggaagggaaggtgaacgagacaaaagcgacagtgaagttccagttgaagaaggttttgtgtatgggtgttgctgttggtaacctgtccatggaagagaagcagctctttcagaatgttcagatgagcatcaacttccttgtctcgctcttgaagaagaattggcaaaacgtgaggtgtttgtacttgaagagcaccatgggaccaccacaaaggatcttctgagttctctactcctataaacatttgctttgtggtttttgtttgtttcagacatcttgagttatggttttgtttgatattagcagaacggaggtgttagtttgctttttgttagacaatataatatgcaatgttcgtttctctacattatcgactctccaattcaatttatctatcagttctcgacaaaaataacggtacatacaatatttatctgtaactctatc

SEQ ID NO: 1477 - DNA, 2137 bp, Brassica rapa
atgaggcgtattggatttcacaacttaaatcaacaaagaacaaggagggtacttacttcttcttcttcttcttcttcttcaactgttcttcctcatcttgcaccatcatgtcaagaaaccattctctcaccccaagatccaaaacccaaaacagatcttccaagcagtttcagcttcttgcgagaaacaaagccatgcatttcttgcccgaggaatcaagttacagattcagtgaacagagttaagctccgagatgggagattccttgcttataaagagagaggtgttccaaagaacgaagctaaatacaagatcattcttattcatgggtttggaagctccaaagagatgaacttctctgcttcaaaagagttgatagaagagctaggcgtatattttctactctacgaccgagctggatatggagattctgatccaaacccggaacgttcgttgcaaagcgaagcacttgacatagaagaacttgctcataatttgcagataggacccaagttttacttaattggagtttccatgggatcatatcccacgtggagttgtcttaaacacatacctcacaggctagctggagtggcgtttgtagctccagtggtaaactatggatggcggtcgctttctaagaagcttataaagaaagactacaggagggggattataaaatggtgttttcgactatcaaaatatgcacctgggcttttacattggtggatcagtcagaaactcttcccatcaactacttcagtccttgaaagcaatcaactctatttcaacaccagtgatattgaagtactcaagagaactaccggttttcctatgcttactaaggataaactacgggaaaggagtgtatttgatactctaaaagacgatttcttggcgggcttcgggcaatgggactttgatccatctgatgtaagaatgagtggagagaactctgttcatatatggcatggaaaggaagacaaggtggttccgtttcaacttcatagatgcatcttgaagaagctgccttggatcaagtatcatgagatacctcatggaggacatttgatcgtacactatgatgtagtaagacccattgctctggcacgtaccttccgcatacttcaatgggtgctgaaactatgcaaagcactttatattgatcatgaagaggatcatgtccgatatatatgccgcctcaaacgcagagtaagggtttcctctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttgaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtcgttggaagggaaggtgaatgagaccaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatcaattatcgaaaacatcatttgagatttcc

SEQ ID NO: 1478 - DNA, 1010 bp, Brassica rapa
gctttcatataaattcttgaagccgcctcaaacgcagagtaagggtttcctctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttgaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtcgttggaagggaaggtgaatgagaccaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatcaattatcgaaaacatctacccgcacggacgtgcgggtgaaaaatctagttatcatttatactactattcatgtatc

SEQ ID NO: 1479 - DNA, 916 bp, Brassica napus
gaagccgcctcaaacgcagagtaagggtttcctctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttgaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaagagtcgttggaagggaaggtgaatgagaccaaagcgactgtgaagttccagttgaagaaggttctgtgtatgggtgttgctgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatc

SEQ ID NO: 1480 - DNA, 840 bp, Centaurea maculosa
ggcggggactcgcagggttcttcttacacagaagtgcaggctagcgaaaggaatagtttccgaacatgagtaagctacaaagtgaagccctccgagaggcaattactcagatcaccactgatgccaaggaaaagaaacgtaacttcaccgagaccattgagctccagatcggtttgaagaattacgacccccaaaaggacaagcgtttcagtggtaccgtgaaattgcctcacattccccgtcccaaattgaaagtttgtatgcttggagatgcccagcatgttgaagaggctcaaaagattggtcttgaatatatggatgttgagggtctgaagaagttgaacaagaacaagaagttggtgaagaaactggcaaagaagcaccaagctttcttggcttctgagtctgtcatcaagcagattcctcgtttgttgggacccggtctaaacaaagcaggtaagttccctactcttgttacccaccaagaatccctcgaggctaaggtgaacgagaccaaggcaaccgtgaagttccaactgaagaaggtgctctgcatgggagttgctgttggtaactgcagcatggaggacaaacagatattccagaacgtgcaaatgagcgttaactttcttgtttctttgctgaagaagaattggcaaaacgtgaggtgcttatacttgaagacaacaatgggaaagccagtgcggatcttttgaagagtttatttatgttttcagtttgggttgtttttgaggttgttgctactgtaagaggttgttttctatcaacaggaaatactccattttgttttggttgctgctatatatttagacagctctt

SEQ ID NO: 1481 - DNA, 914 bp, Centaurea maculosa
  misc_feature (394)..(394): n is a, c, g, or t
  misc_feature (496)..(496): n is a, c, g, or t
  misc_feature (628)..(628): n is a, c, g, or t
  misc_feature (631)..(631): n is a, c, g, or t
  misc_feature (634)..(634): n is a, c, g, or t
  misc_feature (646)..(646): n is a, c, g, or t
  misc_feature (674)..(674): n is a, c, g, or t
  misc_feature (725)..(725): n is a, c, g, or t
  misc_feature (745)..(745): n is a, c, g, or t
  misc_feature (763)..(763): n is a, c, g, or t
ttttcttctccattagggtttctcttcttcgaagaagtgaagtttaaggaaggaaaatctatcaatcatgagtaaacttcagagtgaagccctccgtgaagccattacccagatcactactgatgctaaggaaaagaagcggaattttaccgagaccattgagctccagattgggctcaagaactacgacccacaaaaggataagcgtttcagtggaaccgtgaagttgcctcacattcctcgcccgaaattgaaagtttgcatgcttggagatgcccagcatgtggaagaggctcaaaagataggccttgaatatatggatgtggaaggtctcaagaagctaaacaagaacaagaaactggtgaagaagcttgctaagaagcaccaggctttnttggcttctgaatctgtcatcaagcagatccctcgtttgttgggccctggtcttaacaaggctggaaaattccctacccttgttacccaccaggaatccctngaggctaaggtgaatgagaccaaggcaaccgttaagtttcagctgaagaaggtgctctgcatgggagttgctgttggaaactgcagcatggaggataagcagatctttcaaaacgtgcaaatgagcgtcaanttnctngtttcgttactnaagaagaattggcaaaatgtgaggtgtntgtacttgaagacaacaatgggaaagccggttcgcatcttttagccggttngcatcttttaggagttatcnttgtttatcagatttgtnctgtttgaggtccagtacttggaagcatttgcctatatcggggtgcttatcgtttttgacttgttggatgctgggtttttattcttgtattagatactgccgttgcattgaacgattattacttctaaaatctacccatcgatatttctac

SEQ ID NO: 1482 - DNA, 887 bp, Cichorium intybus
ggcgggggttttcctgaacttcatcggcagtgctgctagggttctcacagaagaagtgaagtttaaggcagcaaaacttaacaaccatgagtaagcttcaaagtgaagccctccgagaagccattactcaaatcaccaccgatgccaaagaaaagaaacgtaacttcactgaaaccattgaactccaaattggtctcaagaactacgacccacaaaaggacaaacgtttcagtggaacagtgaagttgcctcacattcctcgccccaaattgaaagtttgtatgcttggagatgcccaacatgtagaagaggctcaaaaaatcggccttgaatacatggatgttgaaggactcaagaagctcaacaagaacaagaagcttgtgaaaaagcttgcaaaaaagcatcaagcttttttggcttccgaatctgtcatcaagcagattccccgtttgttgggccccggtttaaacaaagcaggaaaattcccaacacttgtttctcaccaggaatcacttgaagctaaagtgaatgaaacaaaagcaactgtgaagtttcaattgaaaaaagtgttgtgtatgggagttgctgttggaaactgtagcatggaggaaaaacagattttccaaaatgttcaaatgagtgtcaactttttggtttcgttgttgaagaagaattggcaaaacgtgaggtgtttgtatttgaagacgacaatgggaaagccggtgcgtattttttagatgtttactttgttttttatttttattttaaagagttgttatgtttgagggtgatacttggaagcatttggtgctttatcgtttttggcttgttggatgtttaatttataatttgtattggattttctagaaattatgttttaatgggct

SEQ ID NO: 1483 - DNA, 898 bp, Cynara scolymus
  misc_feature (807)..(807): n is a, c, g, or t
cggggctttttctcaacttcatcggcactgccacttcctactcttagggttcttttcgaagaagtgaagtttaaggaaggaaaacctaacagccatgagtaagcttcagagtgaagctctccgagaagccattacccagattactaccgatgctaaggaaaagaagcggaattttactgagactattgagctccagattgggctcaagaactacgacccacaaaaggataagcgtttcagtggtaccgtgaagttgcctcacattcctcgtccgaaattgaaagtttgcatgcttggagatgcccagcatgtggaagaggctcaaaagataggccttgaatatatggatgtggaagggctcaagaagctcaacaagaacaagaagctggtgaagaagcttgctaagaagcaccaggcttttttggcttctgaatctgtgatcaagcagatccctcgtttgttgggccctggtctaaacaaggcaggaaaattccctacgcttgttactcaccaggaatccctcgaggctaaggtgaacgagaccaaggcaactgtgaagtttcaactgaaaaaggtgctgtgcatgggagttgctgttggaaactgcagcatggaggataagcagattttccagaacgtgcaaatgagcgtcaatttccttgtttcgttactgaagaagaattggcaaaatgtgaggtgtttgtacttgaagacgacaatgggaaagccagttcgcatcttttaggtgttttctttgtttttatctgagtttgtcggtttgaggtcagtacttggaagcatttgccnttaatgggtgcttatcgtttttgacttgtcgaatgttgggtttttattactgtattagatgctgctttcgccatgaacgatcattacttcc

SEQ ID NO: 1484 - DNA, 884 bp, Taraxacum officinale
tcggccgggggggacttcatcggcactgctgctagggttctcaccaaagaactgaaggttacggcagcaaaactcagcaaccatgagtaagcttcagagtgaagcccttagagaagcaattactcagattaccaccgatgcgaaggagaagaagcgcaacttcacagaaaccatcgagctccaaattggactcaagaactacgacccccaaaaggacaaacgtttcagtggtacagtgaagttgcctcacatcccaaggcccaaattgaaggtttgcatgcttggagatgcccaacatgttgaagaggcccaaaagatcggccttgagtacatggatgttgaaggcctcaagaagctcaacaagaacaagaagcttgtaaagaagcttgcaaaaaagcaccaagcttttttggcttctgagtctgtgatcaagcagattcctcgtttgttaggccctggtctaaacaaagcaggaaagtttccaacacttgtgagtcaccaagaatcccttgaagccaaggtgaatgagacaaaagcaacagtgaagtttcaattgaagaaggtgttgtgtatgggagttgctgttggaaactgcagcatggaagagaagcagatcttccagaatgttcaaatgagtgttaactttttggtttctttgctcaagaagaattggcaaaatgtgaggtgtttgtatttgaagacaacaatgggaaagcctgtgcgtattttctaggtgtttttttttttgaaaattgttctgagacagtgatagggaggttttctgtacttgggagcatttgttggttatcgtttttgggtttgttggatgattaatttttaattgtattggattttgatgtgagcgttatgtttaatatgtttac

SEQ ID NO: 1485 - DNA, 864 bp, Gerbera hybrid cultivar
gcctgcaattagggttcttacaagagaagtgaaggttaaggaaaggacgatttttcagccatgagcaagcttcaaagcgaggccctccgtgaggctatcactcagatcacaactgatgccaaggaaaagaaacgtaatttcactgagaccattgagctccagattggcctgaagaactatgacccacaaaaagataagcgtttcagtgggaccgtgaagttacctcacattccccgtcctaagttgaaggtttgcatgcttggagatgcccagcatgttgaagaggctcaaaagatagggctcgagtatatggatgttgaaggtctgaagaaactcaacaaaaacaagaaattggtgaagaagcttgccaagaaacaccaagcttttttggcttctgaatccgtcatcaagcagattcctcgtttgttgggccctggtctcaacaaggccggaaagttccctacacttgttacccaccaggaatcacttgaggctaaggttaatgaaaccaaggcaactgtgaagttccagctgaaaaaggtgctctgcatgggagttgccgttggaaactgcagcatggaagataagcagatctttcagaatgtgcaaatgagcgttaatttcctggtttcgttgctcaagaagaattggcaaaatgtgaggtgcttatacttgaagacaacaatgggaaagccggttcgcatcttttaaggtgttcttattttatcaactgttttgagtttgtggtgttttgagttcggtacttgaagaatattgtccctcctttttcgatcgttagaagtgtcttttttgttttggtactacatcgaacgtcacaaaatattatagcattggtatttgctt

SEQ ID NO: 1486 - DNA, 927 bp, Lactuca sativa
gcggggatatcagctgtttttgatgcctaactacatcggcactttcaaccctactatcagggttcttccgagaggagcgaagcttaacgaaaagtcaagtttccgaatatgagtaaacttcaaagtgaagccttgagagaggctattactcaaatcactactgatgctaaagaaaagaaacggaatttcactgagaccattgagctccaaattgggttgaagaattatgatccacaaaaggacaaacgtttcagtggcactgtgaaattgcctcacattccaagacctaagctcaaggtctgcatgcttggagatgcccagcatgttgaagaggctcaaaagattgggcttgaatacatggatgtcgagggtctgaagaaactgaacaaaaacaagaagttggtgaagaagcttgcaaagaaacatcaagctttcttggcttctgaatctgtcatcaagcagattcctcgtttgttgggccctggtctaaacaaggctggtaagtttccaactcttgtttcacaccaggaatcccttgaggcaaaggtcaatgaaaccaaagcaactgtcaagttccaactgaagaaggttctttgtatgggagttgctgttggaaactgcagcatggaagaaaagcagatctttcagaatgtgcaaatgagtgtcaacttcttggtttctttgctcaagaagaattggcaaaacgtgaggtgcttatacttgaaaacaacaatgggaaagcctgttcgcatcttttaaggagtttttatttgttcttgtgttttgattttgggttaatgttaaacaaggtcagtcagcacttgagaaaaaaatgtatttcccttcaacaggaaatagttatttttggtttgttacatgtttgtttggtaatgttctttataatattagactttcttctttagacat

SEQ ID NO: 1487 - DNA, 894 bp, Lactuca sativa
cttggcgggggttcctttgacttcttcggcactgctgctaccctgatagggttctaacagaagaagtgaagtttaaggcagcaacagttaacaaccatgagtaagcttcagagtgaagccctaagagaagccattactcaaatcaccacagatgcaaaagagaagaagcgtaatttcactgaaaccattgaactccaaattggactcaagaactacgacccacaaaaggacaaacgtttcagtggaacagtgaaattgcctcacattcctaggcctaaattgaaagtttgcatgcttggagatgcccaacatgttgaagaggcacaaaagattggacttgaatacatggatgttgaagggctcaagaagctgaacaagaacaagaagcttgtgaaaaagcttgcaaaaaagcaccaagcttttttggcttctgaatctgtcattaagcagattcctcgtttgttaggccctggtcttaacaaagcaggaaaattcccaacacttgtttctcatcaagaatcccttgaagcaaaagtgaatgaaacaaaagcaactgtgaaatttcaattgaagaaggttttgtgtatgggagttgctgttggaaactgcagcatggaagagaagcagattttccagaatgttcaaatgagtgttaactttcttgtttcattgttgaagaagaattggcaaaatgtgaggtgtttgtatttgaagacaacaatgggaaagccagtgcgtattttttaggttgtttttttttgggatttgtttttgtttggagacaaagattagtgtattgagtacttggaagcaatttttgctttatgtttttttggttttgttggatgtttatttttgaatgtattggattttggtaatgaggattatgttttt

SEQ ID NO: 1488 - DNA, 802 bp, Lactuca sativa
ctgctgctactctgatagggttctcgcagaagaagtgaagtttaaggcctcaaaactcaacaaccatgagtaagcttcagagtgaagccctaagagaagccataactcaaatcaccacagatgcaaaagaaaagaaacgtaacttcacagaaaccattgaactccaaatcggactcaagaactacgacccacaaaaggacaaacgtttcagtggaacagtcaaattgcctcacattccaagacctaaattgaaagtctgcatgcttggagatgcgcaacatgttgaagaggctcaaaagatagggcttgaatacatggatgttgaagggctcaagaagctcaataagaacaagaagcttgtgaaaaagcttgcaaaaaagcaccaagcttttttggcttctgaatctgttattaagcagattcctcgtttgttaggacctggtcttaacaaagcaggaaaattcccaacacttgtttctcatcaagaatcacttgaaggaaaagtgaatgaaacaaaagcaactgtgaagtttcaattgaagaaggttttgtgtatgggagttgctgttggaaactgcagcatggaagagaagcagatttttcagaatgttcaaatgagtgttaactttcttgtttcattgttgaagaagaattggcaaaatgtgaggtgtttgtatttgaagacaacaatgggaaagccagtgcgtattttttaggttgttttttttttttcggatttgttttgtttggagacaaagatagtgagttgagaacttggaagcatttgttgcttaatgttttt

SEQ ID NO: 1489 - DNA, 930 bp, Lactuca sativa
aaccctactatcagggttctttcgggagacgtgaagcttaacgaaaggaaaagtttccgaatatgagtaaacttcaaagtgaagccttgagagaggctattactcaaatcactactgatgctaaggaaaagaaacggaatttcactgagaccattgaactccaaattggtctgaagaattatgatccacaaaaggacaaacgtttcagtggcactgtgaaattacctcacattccaagacctaagctcaaggtctgcatgcttggagatgcccagcatgttgaagaggctcaaaagattgggcttgaatacatggatgttgagggtctaaagaaactgaacaagaacaagaagttggtgaagaagcttgcaaagaaacatcaagctttcttggcttctgaatctgtcattaagcagattcctcgtttgttgggacctggtctaaacaaggctggtaagttccctactcttgtttcccaccaggaatcccttgaggcaaaggtgaatgagaccaaagcaactgtcaagttccaactgaagaaggtgctttgtatgggagttgctgttggaaactgcagcatggaagaaaagcagatctttcagaatgtgcaaatgagtgttaacttcttggtttctttgctcaagaagaattggcaaaacgtgaggtgcttatacttgaaaacaacaatgggaaagccagtgcgcatcttttaaggagtttttaattggttcttgtgttttgattttgggttaatgttaaacaaggtcagcacttgagaaaaaaatgtatttcccttcaacaggaaatagttatttttggtttgttacatgtttgtttggtaattttctttataatattagacttccttctttagacattatattgataagtttttcttgttttattttgactcgaatggtatttaatatc

SEQ ID NO: 1490 - DNA, 841 bp, Lactuca sativa
ggggctgcgttgggttatatcgaagaagtgaagcttcgctaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcactgtgaaattgcctcacattcctcgtcccaaattgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgttaagtttcaactgaaaaaagtgttgtgcatgggagttgctgttggtaactgtagcatggaggaaaaacagatttttcagaacgttcagatgagcgttaactttcttgtttcgttgttgaagaaaaactggcagaatgtccgatgtttgtacttgaagacgacaatgggaaagccagttcgcatcttttaggtgtttaactttgtttttggttgtgccagttgttggaagcatttccctttaatgggtgctattgtttttgacttgttggatgtttgttttcttattgtattagattttgctatgaacattatggttaatggt

SEQ ID NO: 1491 - DNA, 734 bp, Parthenium argentatum
cctaccttcatcggcgctactgttagggttcctacacagaagagagatttaaggaaggaagacctaactaaaaatgagtaagcttcagagtgaagcccttcgggaagccattactcaaatcaccaccgatgctaaagaaaagaaacgtaattttaccgagaccattgagctacagatcgggctcaagaactacgacccacaaaaggataaacgttttagtggtaccgtaaagttgcctcacattcctcgccccaaattgaaagtttgtatgcttggagatgcccagcatgtggaagaggctcaaaagattggtcttgaatacatggatgttgaaggactcaagaagctcaacaagaacaagaaactagtgaaaaagctagccaagaaacaccaggcttttttggcttctgaatccgttatcaagcaaattcctcgtttgttgggtcctggtctaaataaggcaggaaagttcccaacacttgttactcaccaggattccctcgaggccaaggtgaatgaaaccaaagcaacggttaagtttcaactgaaaaaggtgctgtgcatgggagttgctgttggtaactgcagcatggaggagaaacagattttccaaaacgtgcagatgagcgttaatttccttgtatcgctgttgaagaagaactggcagaatgtgagatgtttgtacttgaagacaactatgggaaagccagttcgcatcttttaggtattgtgtt

SEQ ID NO: 1492 - DNA, 939 bp, Solanum tuberosum
cctaaatccagggttttctcttacaggtgagtttgacagagaaggagagctttttgagccatgagtaagcttcagagtgaggctctcagagaagccatcactgtgattaagaatgattcagcagagaagaaaaggaagttcagtgagaccattgagctccagattggactgaagaactatgatccccaaaaggacaagcgtttcagtggatctgttaagttaccacacattcctcgccctaagatgaagatctgtatgcttggagatgctcagcatgttggggaggcagagaagattggtttggagtacatggatgttgaaggcttgaagaagctcaacaagaacaagaaactggtcaagaagcttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagtttcaattgaaaaaggtgctctgcatgggtgttgctgttggaaacatggatatggaggagaagcagatcttccagaatgtgcaaatgagtgtcaactttcttgtttcattgctgaagaagaattggcaaaatgttaggtgcttgtacttgaagagcaccatgggaaaaacacaacgtatcttttaagaagattttctgtttctgttggaaattttcaggctttctggttgtgagctattgacacttgaaaattttgggtagttgtgatttttgttatcttgttttgaatatctataaaacttttaggggtatgtttgctttcaacttttattcgttaatgatgttatcactgatcccagtagcatccaagatgccaattgcagtgcattactttattctgtcgttttgacaacg

SEQ ID NO: 1493 - DNA, 876 bp, Raphanus sativus
ccgtctcatcatccaggatcagatcttttgagacaagctcaaaatgagtaagcttcagagtgaggctgttaaagaagccataactgtaatccgaggaaaatcagaagagaagaaacgcaactttgttgagactctcgagctccagattggtctgaaaaattatgaccctcaaaaggacaagcgtttcagtggttccgtcaagttaccccacattccccgtcccaagatgaagatctgcatgctcggagacgcccagcacgtcgaggaggctgagaaaatggggctagactctatggacgtggagtctctgaaaaaactgaacaagaacaagaagctcgtcaagaagcttgccaagaagtaccacgccttcttggcctctgaatccgtcatcaagcagatccctcgtcttctcggtcctggactcaacaaggcaggcaagttcccgacgcttgtgagccaccaggaatcgctggaggggaaggtgaatgaaactaaggctacagtgaagtttcagctgaagaaggttctgtgtatgggtgttgctgttggtaacctctccatggaggagaagcacatctttcagaatgtccagatgagtgtcaacttcctcgtctctctcttgaagaagaactggcaaaacgtgaggtgtttgtacctcaagagcacaatgggaccaccacaaagaatcttctgagctctcgcagctgcttctatggtggctattacacttgcccttttacttttatttcagacatatttgaaagtagcaagaattgtgttgctgtgactctggttgctggattttgtagcttatattatcaatgaggattcaacaaacaaataatgttctaaatgaaaacaagaatgtttttgcca

SEQ ID NO: 1494 - DNA, 897 bp, Raphanus sativus
cttccgtctcatcattaggatcagatcttttgagacaagctcaaaatgagtaagcttcagagtgaggctgttaaagaagccataactgtcatcagaggaaaatcagaagagaagaaacgcaacttcgttgagactctcgagctccagattggtctgaaaaattatgaccctcaaaaggacaaacgtttcagtggttccgtcaagttaccacacattccccgtcccaagatgaagatctgcatgctcggagacgcccagcacgtcgaggaggctgagaaaatggggctggactctatggacgtggagtctctgaaaaagctcaacaagaacaagaagctcgtcaagaagcttgccaagaagtaccacgccttcttggcctctgaatccgtcatcaagcagatccctcgtcttctcggtcctggactcaacaaggcaggcaagttcccgacgcttgtgagccaccaggaatcgctagaggggaaggtgaatgaaactaaggctacagtgaagtttcagctgaagaaggttctgtgtatgggtgttgctgttggtaacctctccatggaggagaagcacatttttcagaatgtccagatgagtgtcaacttcctcgtctctttgttgaagaagaactggcaaaacgtgaggtgtttgtacctcaagagcacaatgggaccaccacaaagaatcttctgagctcctcaagcagctgcttcaatggtggctattacacttgcccttttgtttttgtttcggacatatttgaaaggctgtaagaattgtgttggctttggttgatggattttgtagcttatattatcttgaattatttgttcatgaagattcagcaaacaaataatgttctaaatgaaaacaataatgtctttgccagtgcta

SEQ ID NO: 1495 - DNA, 890 bp, Carthamus tinctorius
  misc_feature (755)..(755): n is a, c, g, or t
  misc_feature (832)..(832): n is a, c, g, or t
ttcggcgggggttttcttctccagcttcatcccctagggtttctcttccaagaagtgaagtttaaggcaggaaaatctatcaatcatgagtaagcttcagagtgaagccctccgtgaagccattacccagatcactactgatgctaaggaaaagaagcgaaattttaccgagaccattgagctccagattgggctcaagaactacgacccacaaaaggataagcgtttcagtggtaccgtgaagttgcctcacatccctcgcccaaaattgaaagtttgcatgcttggagatgcccagcatgtggaagaggctcaaaagatcggccttgaatatatggatgttgaaggtctcaagaagctaaataagaacaagaagcttgttaagaagcttgctaagaagcaccaggcttttttggcttctgaatctgtcatcaagcagatccctcgtttgttgggccctggtctaaacaaggctggaaaattccctacccttgttactcaccaggaatccctcgaggctaaggtgaacgagaccaaggcaaccgtgaagtttcagctgaaaaaggttctctgcatgggagttgctgtcggaaactgcagcatggaggacaagcagatcttccaaaacgtgcaaatgagcgtcaatttccttgtttctttactgaagaagaattggcaaaatgtgaggtgtttgtacctgaagacaacaatgggaaagccggtccgcatcttttaggcgttatctttgtttctcngatttgttctgtttgaggtccagtacttggaagcatttgccttttatcggggtgcttatcgtttttgacttgttggnatgtgggtttttatttttgttttagatactgcaacgattattacatctgaaatctata

SEQ ID NO: 1496 - DNA, 867 bp, Solanum phureja
ctcatcatcggcttacaaaccctaaatcgagggttttctcttacaggtgagtttgacagagaaggagagctttttgagccatgagtaagcttcagagtgaggctctcagagaagccatcactgtgattaagaatgattcagcagagaagaaaaggaagttcagtgagaccattgagctccagattggactgaagaactatgatccccaaaaggacaagcgtttcagtggatccgttaagttaccacacattcctcgccctaagatgaagatctgtatgcttggagatgctcagcatgttggggaggcagagaagattggtttggagtacatggatgttgaaggcttgaagaagctcaacaagaacaagaaactggtcaagaagcttgcaaagaaataccatgctttcttggcttcagaatctgtcatcaagcagattccccgtttgttggggcctggtctgaacaaggcaggtaagtttcccacccttgtttcccaccaagagtctcttgaatccaaggttaatgagaccaaggccacaatcaagtttcaattgaaaaaggtgctctgcatgggtgttgctgttggaaacatggatatggaggagaagcagatcttccagaatgtgcaaatgagtgtcaactttcttgtttcattgctgaagaagaattggcaaaatgttaggtgcttgtacttgaagagcaccatgggaaaaacacaacgtatcttttaagaagattttctgtttctgttggaaattttcaggctttctggttgtgagctattgacactcttgaaaattttgggtagtgatttttgttatcttgttttgaatatctataaaactttttaggggtatgtttgctttc

SEQ ID NO: 1497 - DNA, 898 bp, Helianthus annuus
gcccttagagtggtcgcgaccgaggtacgcgggggtcgccactttgaaaccctaatctcagggttctttactggagaagttaagctaaccagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagtggtacagtgaagttgcctcacattcctcgccccaaattgaaagtttgcatgcttggagatgcccagcatgttgaagaggcccaaaaaataggacttgagtatatggatgttgagggactgaagaagctgaacaagaacaagaagttggtgaagaagcttgctaaaaaacaccaagctttcttggcttctgagtctgtcatcaagcaaattcctcgtttgttgggtcctggtctaaacaaagctggtaagttcccgacacttgttagtcatcaggaatccctcgaggcgaaagtcaatgagaccaaagcaacggtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgagatgcttatacttgaagacaaccatggggaagccagttcgcatcttttaaggaagagcttatttgtttgtatgttttaattttgggttaatgttaaagtcagtgttggaaagtatatttctcatgaacacaggaataggtttttctttggcttgttacatgtttgtttttgtagcactataaaatcta

SEQ ID NO: 1498 - DNA, 917 bp, Helianthus annuus
gggtttctgtttcacctcatatattacgataagccatttctgtgcgtgactctgtcgccattttgaaaccctaatctcagggttctttgctggagaagttaagctaacgagaagaaaagtttccgagaatgagtaagcttcaaagtgaagccctcagagaggcaattactcagatcactactgatgctaaagaaaagaagcgtaattttactgaaaccattgagcttcaaattggtttgaagaattatgatccgcaaaaggacaaacgtttcagcggtacagtgaagttgcctcacattcctcgacccaaattgaaagtttgcatgcttggagatgcccaacatgtggaagaggcccaaaaaataggactcgagtatatggatgttgagggactgaagaagctgaacaagaacaagaagttggtgaagaagcttgctaaaaaacaccaagctttcttggcttctgagtctgtcatcaagcaaattcctcgtttgttgggtcctggtctaaacaaagctggtaagttccccacacttgttagtcatcaggaatccctggaggcgaaagtcaatgagaccaaagcaacagtcaagtttcaactaaagaaggtgctctgcatgggagtggctgttggaaactgcagcatggaggaaaagcaaattttccaaaacgttcaaatgagtgtcaatttcttagtttctttgctaaagaagaattggcaaaatgtgagatgcttatacttgaagacaaccatggggaagccagttcgcatcttttaaggaagagcttatttgtttgtatgttttaattttgggttaatgttaaagtcagtgttggaaagtatatttctcatgaacacaggaataggtttttctttggcttgttacatgtttgtttttgtagcactataaaatcta

SEQ ID NO: 1499 - DNA, 900 bp, Helianthus annuus
cgcagagtacgcgggggaacttcatcggcgctgctgttagggttagggttctaccagaggaaggaacacgtaacaaaaaatgagtaagcttcagagtgaagcccttagggaagccattacccaaatcaccacagatgccaaagaaaagaagcgtaacttcaccgagactatcgagcttcagatcggtctcaagaactacgacccacaaaaggacaagcgtttcagcggtaccgtaaaattgcctcacattcctcgcccgaagttgaaggtttgcatgcttggagacgctcagcatgttgaagaggctcaaaagattggtcttgaatacatggatgttgaaggactcaaaaagctcaacaagaataagaagctagtgaagaagcttgccaagaaacaccaggcttttttggcttctgaatccgttatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgtaggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgctatgaacattcttgtgttttgttatttattaaagataatacatgctttaaa

SEQ ID NO: 1500 - DNA, 930 bp, Helianthus annuus
ctcgaacttcatcggcgctgctgttagagtaagaagagggttttcaggaagcaaaacctaacaaaaaatgagtaagcttcagagtgaagcccttagggaagccattacccaaatcaccacagatgccaaagaaaagaagcgtaacttcaccgagactatcgagcttcagatcggtctcaagaactacgacccacaaaaggacaagcgtttcagcggtactgtaaagctgcctcacattcctcgtcccaaattgaaggtttgcatgcttggagatgcccagcacgtggaagaggctcaaaagattggtcttgaatacatggatgttgaaggactcaaaaagctcaacaagaacaagaagctggtgaagaagcttgccaagaaacaccaggcttttttggcttctgaatccgttatcaagcaaattcctcgtttgttgggccctggtctaaacaaggcaggaaagttcccgacacttgttagtcaccaagaatctctcgaggctaaggtgaatgaaaccaaggcgacagttaagtttcaactgaaaaaggtgttgtgcatgggagttgctgttggtaactgcagcatggaggaaaaacagattttccaaaacgtgcagatgagcgttaatttccttgtttcattgttgaagaagaactggcagaatgtgagatgtttgtacttgaagacaacaatgggaaagccggttcgcatcttttaagtaccctgtctgtttttctttcaaagttgttgtgaggtcggtacttgaagcctttcgtgttagcaggctgtttcggttttgattatggctgttcgttatcgttttgaattagtagatgctatgaacattcttgtgttttgttatttattaaagataatacatgctttaaagagtggaaaattaaaaggtcaagaacttgaacagctcctgtc

SEQ ID NO: 1501 - DNA, 970 bp, Helianthus annuus
gcgggggggtcaggtgttcaacccagcccattagggtttcatcttattactaagttgaatatactataacactcagccgctgttttcctccctgctgcagttagggtttataccgaagaagtgaagtttcactaaggaaaacctaacaaaaatgagtaagcttcagagtgaagccctgcgtgaggccattactcaaattaccactgatgccaaagaaaagaagcgtaacttcaccgagactatcgagctccagattggactcaagaactacgacccacaaaaggacaagcgtttcagtggcaccgtgaaattgcctcacattcctcgtcctaagttgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgtttatctttgtttttggttgagccagtttcaggaagcatttccatttaatgggtgctattgtttttgacttgttggatgtttgttttcttattgtattagatgctgctataaacattatggttaatggttacagaccatttattcttatttctatatgtttcaac

SEQ ID NO: 1502 - DNA, 927 bp, Helianthus annuus
gcgggggggtcaggtgttcaacccagcccattagggtttcatcttattactaagttgaatatactataacactcagccgctgtcttcctccctgctgcagttagggtttataccgaagaagtgaagtttcaccaaggaaaacctaacaaaaatgagtaagcttcagagtgaagccctgcgtgaggccattactcaaattaccaccgatgccaaagaaaagaagcgtaacttcaccgagactatcgagcttcagattggactcaagaactacgacccgcaaaaggacaaacgtttcagtggtaccgtgaaattgcctcacattcctcgtcccaagttgaaagtttgcatgctcggggatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacacttgtttcccaccaggaatccctcgaggctaaggtgaatgaaaccaaggcaactgtcaagtttcaactgaaaaaggtgttgtgcatgggagttgccgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcttttaggtgtttaactttgtttttggttgttggaagcatttccctttaatgggtgctactgtttttgacttgttggatgtttgttttgttattgtattagatgctgctatgaacattatggttaatggtta

SEQ ID NO: 1503 - DNA, 927 bp, Helianthus annuus
aactcttatcggcactttgaaaccctaactctcagagaattgaaggtatcgagaggaagagtttccgaaaatgagtaagcttcaaagtgaagcccttagagaggcaattactcagatcactacggatgcaaaggaaaagaaacgtaactttactgaaaccattgagctacaaattggtttgaagaattacgatccacaaaaggacaaacgtttcagtggaaccgtgaagttgccccacattcctcgccccaagcttaaagtttgcatgcttggagatgctcaacacgttgaagaggctcaaaaaattggtcttgaatatatggatgttgagggtttaaaaaagctgaacaagaacaagaaattggtgaagaaacttgctaagaagcatcaagctttcttggcttctgagtctgttatcaagcagattcctcgtttgttgggccccggtcttaacaaagcaggtaagttccctactcttgtttcccaccaagaatctctcgaggcaaaagtcaacgagacgaaagcgacagtcaaattccaacttaagaaggtgctttgcatgggagttgctgttggaaactgcagcatggaagagaagcaaatcttccaaaatgttcaaatgagtgtcaatttcttggtttctttacttaaaaagaattggcaaaacgtgcggtgcttgtacttgaagacaacaatgggaaagccggttcgcatcttttaaggagtggctttggttatgttttttttattttgggttaatgttgaggtcagtactggaaaatgtatttcccatgaatggggaataatcctttttggctttttacatgtttgtttggtactgtatttttggaccctcttcttatatcattgttttgattttgccagtcgtttaggtaatggttaaggttaacctcataagttactttt

SEQ ID NO: 1504 - DNA, 960 bp, Helianthus annuus
ttttggtgcgtaactcttatcggcacttcgaaaccctaactctcagagaattgaaggtatcgagaggaaaagtttcaaaaatgagtaagcttcaaagcgaagcccttagagaggcaattactcagatcactacggatgcaaaggaaaagaaacgtaactttactgaaaccattgagctacaaattggtttgaagaattacgatccacaaaaggacaaacgtttcagtggaaccgtgaagttgccacacattcctcgccccaagcttaaagtttgcatgcttggagatgctcaacacgttgaagaggctcaaaaaattggtcttgaatatatggatgttgagggtttaaaaaagctgaacaagaacaagaaattggtgaagaaacttgctaagaagcatcaagctttcttggcttctgagtctgttatcaagcagattcctcgtttgttgggccccggtcttaacaaagcaggtaagttccctactcttgtttcccaccaagaatctctcgaggcaaaagtcaacgagacgaaagcgacagtcaaattccaacttaagaaggtgctttgcatgggagttgctgttggaaactgcagcatggaagagaagcaaatcttccaaaatgttcaaatgagtgtcaatttcttggtttctttacttaaaaagaattggcaaaacgtgcggtgcttgtacttgaagacaacaatgggaaagccggttcgcatcttttaagaagtggctttggttatgtttttattttgggttaatgttgaggtcagtactggaaaatgtatttcccatgaatgggaaataatcctttttggctttttactatgtttgtttggtactgtatttttggaccctcttcttatatcattgttttgattttgccagtcttttaggcattattattgaactaggtttaaataagttcgtcgcgttgcggcgaatttattttgtt

SEQ ID NO: 1505 - DNA, 835 bp, Helianthus annuus
ccgaagaagtgaagtttcagtaaggaaaacctaacaaaaatgagtaagcttcagagtgaagccctgcgcgaggccattactcaaattaccaccgatgccaaggaaaagaagcgtaacttcaccgagactatcgagctccagattggactcaagaactacgacccacaaaaggacaagcgtttcagtggcaccgtgaaattgcctcacattcctcgtcctaagttgaaagtttgcatgctcggggatgctcagcatgtggaagaggcccaaaagattggtcttgaatacatggacgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaggtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggtgcgcatcttttaggtgttttatcgttgtttttggttgagccagtttcaggaagcatttccatttaatgggtgctattgtttttgacttgttggatgtttgtttttctattgtattagacgttgctatgaacattttggttaatgattacagacctttt

SEQ ID NO: 1506 - DNA, 876 bp, Helianthus annuus
gctgcagttagggtttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgccctaagttgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcattgttgaagaaaaactggcagaatgtccgatgtttgtacttgaagacgacaatgggaaagccggttcgcatcttttaggtgttttatctttgtttttggttgagccagtttcaggaagcatttccatttaatgggtgctattgtttttgacttgttggatgtttgttttcttattgtattagatgctgctatgaacattatggttaatggttacagaccatttattcttatttctatatgtttca

SEQ ID NO: 1507 - DNA, 915 bp, Triphysaria pusilla
gagtcgaggtcttcctaccagaaacgagtttaggaagataataacactcgaaccatgagtaagcttcagagtgaggccctgagggaagcaattacccagattgtctcggattgcaaggagaagaagaggaactttgttgagacaattgagctccagattggactcaagaactatgatccccagaaagataagcgtttcagtggatctgttaagcttccccacatcccgaggcccaaaatgaagatctgcatgcttggtgatgcccagcatgtagaagaggctgcgaagattggccttgagtcgatggatgtcgaggctcttaagaagctgaacaaaaacaagaaattagtgaaaaagcttgctaagaattatcatgctttcttagcctcagaatctgttatcaagcagattccccgtctcttgggtccgggccttaacaaggcaggcaagttccccactctcgtgtctcaccaagagtcactagaggctaaggtcaatgaaaccaaagctacaattaagttccaattgaagaaggtgctttgcatgggtgttgctgttgggaatctcgacatggaggagaagcagatcttccaaaatgtgcaaatgagcatcaatttccttgtttctcttctcaagaagaattggcagaatgtgaggtgcttgtacttgaagagtaccatgggaaagacgcagcgtattttctaagtcgtcaaacgagttgttcgatttttgtttgatgaatagatacattagaggcctgatgggaagaacaattggatatttcttagaaattgggttgttttttatttcatattgttgtgatagtgctcgtatcgactatgacctactgtttttgtttaatttctatgcaacttactttttgtttaaagttttatgtgatctgggttatttctg

SEQ ID NO: 1508 - DNA, 979 bp, Juglans hindsii x Juglans regia
  misc_feature (38)..(38): n is a, c, g, or t
  misc_feature (48)..(48): n is a, c, g, or t
  misc_feature (50)..(50): n is a, c, g, or t
  misc_feature (52)..(52): n is a, c, g, or t
  misc_feature (128)..(128): n is a, c, g, or t
  misc_feature (166)..(166): n is a, c, g, or t
  misc_feature (344)..(344): n is a, c, g, or t
  misc_feature (449)..(449): n is a, c, g, or t
ggggaggtagagttcctctttcttttggacctctggtnctatctccancngnaaccgcaacagtaggaaaagctgttagtgggtctgtgaaagtaggccttcaaaattcgaacatgagtaagcttcanagtgatgccgtacgagaggccatctctactctctttantggatccagagagaagaagcgtaatttcactgagactgttgagctccagattgggctaaaaaattatgatccccaaaaggataagcgattcagtggttctgttaagttgccacatattcctcgtccaaagatgaaagtttgcatgcttggagatgcacaacatgttgaagaggcaganaagattggcttagattatatggatgttgaagcattgaaaaagcttaacaaaaacaagaaattggttaagaagcttgccaagaaataccatgcctttctagcatcngaagctgtcattaagcagattccccgacttttgggccctggactcaataaggcagggaagttcccaactcttgttacgcatcaagaaacgatcgagtctaaagtaaatgagacgaaagctatggttaagtttcaattgaagaaggtgctttgcatgggagtggctgttgggaatgttgccatggaggagaagcaggtcttccaaaatgttcaaatgagtgttaatttccttgtttccttgttgaagaagaactggcaaaatgtgaggagcttgtctcttaagacaaccatggggagaccggtgcgcatatactgaggagttattggccaagggagttctgtaatactttcaagtttattttttttcccttccaattgtcacattttcttgctgtttagaggctgttttaccttttgttggttaaatgcgtagatgtcacacttcgttggagaagtgaggcctattttttcgttttcacttgcgccatgatgcgttgttgaatatcaagtccaaacgttttggcacttccg

SEQ ID NO: 1509 - DNA, 1031 bp, Medicago truncatula
tatgcgcattgctctcatttctttcgtgcggcttcatcctcttcctccctccactctaaggtataagatccaattgctgcaagactctgattcaagatgagtaagcttcagagtgaagctgtgagagaagctattacaggaatcatggctgattccaaggaaaaaaaccgaaaatttgttgagactattgaactccagattggtcttaagaactacgacccacaaaaggataaacgtttcagtggttctgtcaaattgcctcacattcctcgacctaagatgaagatttgcatgcttggagatgctcagcatgttgaggaggctgagaaaataggattggaatcgatggatgttgaagctttgaagaagctaaacaaaaacaagaaactggtgaagaaattggcaaagaagtaccatgcctttttagcttctgaagctgttattaagcagattccccgtcttttgggtcctggtctcaacaaggcaggaaagttccctacacttgtttcccaccaagaatctctcgaggctaaggttaatgagactaaggctatggtcaagttccagcttaagaaagtgctgtgcatgggagtagctgttggcaatgtcagtatggatgagaaacaaatcttccaaaatgtacaactgagtgttaacttcctcgtgtccttgttgaaaaagaattggcaaaatgttaggtgcttgtatctgaaaagttcgatgggcaaatcttaccgtgtcttttaaacggtctttacatccaatgtttttgaaattgagcttaatattttggttactgtaatagctgagacagcaggtttcccttttctacagttttgtttgatgagattttgttgtcagtattgtgttcttgaagattatgtcagaagtgctaattttattccgcatggtttatttcttcagctttttgccctcttctttcatgtatattttttatgcaaagttgctcccatagtctttgtagaataattttattgttatgcatttcatcagatatctcgtctatgtct

SEQ ID NO: 1510 - DNA, 885 bp, Brassica napus
ctgcttcacctctcaggttcagagattcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttaaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaggagtcgttggaagggaaggtgaatgagaccaaagcgactgtgaagtttcagttgaagaaggttctgtgtatgggtgttgccgttggtaacctttccatggaggagaagcagctcttccagaatgttcagatgagcatcaacttccttgtctccctcttgaagaagaattggcaaaacgtgaggtgtttgtacttgaagagcaccatgggcccaccacaaaggatcttttgagttctatactctttcatcttcaaacttttgcgttgtggtttttgtttgtttcagagaacttaagttatggttttgtttggtattagcagaactgaagtgttagtttgctttttgtcaagacattataatatgcactgtttgattctacaatgtcgactctccagttcaattttatctttatcaa

SEQ ID NO: 1511 - DNA, 798 bp, Brassica napus
tcgttcaaccgagagaaactcaagatgagtaagcttcagagtgaggctcttagagaggccatcacaaccatcaagggcaaatctgaggacaagaagcgtaactttgtggagacgattgagcttcagattggtctgaagaactacgacccgcaaaaggacaagcgtttcagtggatctgtcaagctcccacacattcctcgccctaagatgaaggtctgcatgcttggagatgctcagcacgttgaggaggctgagaagatggggctagactctatggatgttgaggctttaaagaagcttaacaagaacaagaagcttgttaagaagcttgcgaagaagtaccatgctttcttggcttctgagtcagtcatcaagcagattccccgtcttcttggtcctggtcttaacaaagctggaaagttcccaacgctagtgagtcaccaggagtcgttggaaggaaggtgaatgagaccaaagcgactgtgaagtttcagttgaagaaggttctgtgtatgggtgttgccgttggtaacctttccatggaggagaagcagctcttccagaatgttcagatgagcatcaacttccttgtctccctcctgaagaagaattggcaaaacgtgaggtgtttgtacttgaagagcaccatgggcccaccacaaaggatcttttgagttctctactctttcatcttcaaacttttgcgttgtggtttttgtttgtttcagagaacttaagttatggttttgtttggtattagcagaactgaagtgttagtttgctttttgtcaagacatt

SEQ ID NO: 1512 - DNA, 871 bp, Arachis hypogaea
agctcttgattccacaaaaccctagcttcaaccatgagtaagcttcagagtgatgcgctgagagaagccatcacaggaattgtggctgattcgaaagagaagaataggaagtttgttgagaccattgagctccaaattggactcaaaaactctgatccacaaaaggacaagcgtttcagtggttctgtaaagttgccacacatcccaaggcccaagatgaaaatctgcatgcttggagatgctcagcatgttgaagaggctgaagaaaatagattggattggatggatgttgaagcattagaaaaagcttaaacaaaaataagaaattggtgaagaaacttgccaagaaatatcatgctttcttggcttctgaagcagtcattaagcagattcctcgtctcttgggtcctggtctcaacaaggcaggaaagtttcccacacttgttacccaccaagaatctctcgagtcaaaagttaatgagacaaaggctatggtcaagtttcagcttaagaaggtgctctgcatgggagtagccgttggcaatgttagtatggaagaaaagcaaatctttcaaaacgtacaactgagtgttaacttccttgtttccctgttgaaaagaactggcagaacgttaggtgcttgtatctgaagagtaccatgggaaaatcttaccgtgtgttttgagagacttgttttttatctttgaaattaaaattctgtgaaattatgatcaagattttgagtatctcactagcatgacagatattttcatattattaaagttttgtcggatgtatttttttgtttattaatatttcgttcatggtttggcctctaaagtctaaagtggttaccggcattggatcctat

SEQ ID NO: 1513 - DNA, 3147 bp, Prunus persica
ttatttcttgtcgaatgggtaacgaagcccttcaaatgagtctcccgctagtgctcttgacgatccttacattctcagctctttcagcaacagcttcagcgagcgatcgcagctacaatgtaggagatcatgttcccttgttcgtcaacaaagttggccccttgaacaaccccagtgagacctatcaatactatgatttgccattctgctgcccagatccagtaatccaaaagaaagaatccattggggaagttttgaatggtgatcgtttggccaacaccttatatcagttgaatttcaggcaggacaaaaatggggagagcttgtgccagaaaaagcttaaagttgctgaagttgcgaaatttagggatgctattgttaatgatttttacttccagatgtattatgatgatcttccagtgtgggggttcattgggaaagttgaagatgagagttggactattagtgacaaggggaccaagtattatctattcaaacatgtgctgtttgatgttttttacaatgggaaccaaataatagaaatacgtgcttttagtgatccaaatcatgttgctgatataacagaagatgttgatattgacgttgagttcacttattcggttaaatggaatgcaacatctattcagttccagaacaggatggacagatactcaaaggcctcattactgccagtccgcctgaaaattcattggttctcatttattaactccattgtcatcattgtgcttttgatgggattgcttaccttgctaataatgcgacgcctcaagaatgacctgagaaagtgctctaatgatgaagaagaagacaaggaggttggttggaaatacattcacggtgatgttttcagatatccatccaacatgcccctgttttgtgctgtcttgggtgtgggtacccaactgctcatcatggtctgcatcttattttttctgtcattttttggagtcctctatccctacaatcgtggagctctgttcacttctcttgtctttatatgtactcttacctcaattgtcgctggatacactgctgctgctttccacactcaattttctgtaattggatgggagaggagtgttcttctaacagcgattctctacctgggcccattgtttgtgacatcgtctatccttaatacagttgctatatcttatggggcaacagctgcaataccttttggcaccctcctagcaattcttcttatatatgcatttcttgccattccattgcttgccttaggtggggtgattggatattgtttaaggtctgaatttcaagcaccttgtgctacaaagcaatttccaagagagatccaacgattagcttggtacaggagaacacattgtcaaatgtttatcggtggtctattgccgtttagtgcaattgcccttcagttacaccacctgtatgcaagcatgtggggctataaaatttacactctacctggaattttgtttcttacgttcatcatcctcatcataatgacttcaatcttgactgtcggtttgacatacattcagctttctgttgaagaccatgaatggtggtggaggtcagtgttgtctgggggttcaacggctatttttatgtttgcctatagcatttacttctatgccagatcaaacatgacgggtttcatgcaactatccttctttattggctataatgcttgcatgtgttatgcgttcttcttaatgcttggtgccattagtttccgtgtttccttgatatttgttcgccatatatacggagacgtagataactcacttgccatacacccctatattcatgacgtgtaatgtaaacccccacccattttctctttggttttcctttcttcccacacccaaacacaaaccccagcaagcctccataaaaccccacacagcccctcaacaactccagcctcaaaatgaagagaacccatttctcattcatggaagaaaatcccaacaatatgatcaacatgggcagccaacagattcctgctttttccgggaaaagaaccaaacaccacgaccctaacaatcttgtgggatttcaaagcatgcagcagcctgaggaattgcatggtgatggtgctgatcatcaggtgcagtcgggacgtgagaggctgaaaaggcaccaagaggaggtggctggccgcgtgactatccccgattcatgggatcaggaggagctgctcaaggattggatcgattattctccgtttgatgcgctgttggttccaaaaggactcacttcagctcgtgaggcacttgccatggagggacgtcgagcaagtagttctcaaggagtgctgagaatagagagtagtaaacttcagagtgatactctcagagagggtatttccaccatcatggctgcgtccaaggaaaaaaaccgcaagttcactgagaccatcgaacttcagattgggctgaaaaattatgatccccaaaaagacaaacgtttcagtggttctgttaggttgccacacatccctcgtccaaagatgaaggtttgcatgcttggagatgctcagcatgttgaagaggctgagaagatagggttggattatatggatgttgaagggctgaagaagctaaacaagaacaagaaattggttaagaaactggccaagaaataccatgcctttttggcatcagaagctgttattaagcagattccccgtcttttgggtcctggtctcaacaaggcaggaaaatttccaaccctggttactcaccaagaatctctcgagtctaaggttgctgagacaaaagcaaccattaagttccaactgaagaaggttctttgcatgggagttgctgtggggaatgcctccatggaggagaaacagatcttccaaaatgtgcaattgagtgttaacttccttgtttcacttttgaagaaaaattggcaaaatgtgaagtgcttgaacctgaagactactatggggaagccatatcgcatctattaagaagtcatttactaatttttggatgtaggggctggttatggaaagcctgatacttaataggagttgtgtttttatctgaatggtcaagttttcgtgtttgttggctgttttactttgtttgatggttatcgacattgttatggtagacatgatcatatctt

SEQ ID NO: 1514 - DNA, 950 bp, Plantago ovata
caggagaaatcggagaagaagcataacaacgcaacaatcatgagtaagctttcgagtgacgccaccaaggaggcaatcacctcaattatggctgatgctaccgaccctgagaagaagaagaacttcactgagactattgagctccagattggtctcaagaactacgatcctcaaaaggacaaacgtttcagtgggtctgttaagctgccccatatcccaaggcctaaaatgaagatctgtatgctcggagatgcccagcatgttgaggaggctgagaaaattggcctggaatctatggatgttgaggctcttaagaagcttaacaagaacaagaaattggttaagaagctggccaagaagtatcacgctttcttagcctcagaatctgttatcaagcagattccccgtctcttgggacctggtcttaacaaagcaggtaagttccctacccttgtgagtcaccaggaatcccttgaatccaaggttaacgagaccaaagccaccgtgaagttccaattgaagaaagttctctgcatgggagttgctgttggcaactgtggcatggaggagaagcaaatcttccaaaatgtccaaatgagtgttaacttcctagtttctcttttgaagaaaaactggcaaaatgtgaggtgcttgtacctgaagagtaccatggggaagccagtgcgcatattctaagaagcttttgatatttgtttgaaatgcttaggaacagaatttgtaagacagcgcagacaattcagtatctccttgttacaggagttcctatttgtttagttttgttgtgtcaaaataccttaaattggtactcttgtcgtttattttcgttgagaactatcattttctttttaaccagatttagcatctgcttttgttgttatgtctgaattctgaacctggtcctagtgtgaagtcttctatagcagttggcc

SEQ ID NO: 1515 - DNA, 1105 bp, Eragrostis curvula
aaggggaatctccggctctcgcatcgatgaagaacgtagcaaaatgcgatacctggtgtgaattgcagaatcccgcgaaccatcgagtttttgaacgtaagttgcaaaccgaggtcctcaaggatggcatcgccaatgtcgttaaggatgccaaggagaagaacaggaagttcaccgagacaattgagctacagattggtctgaagaactatgacccgcagaaggacaagcgtttcagcggctctgttaagctgccccatatcccccgcccgaagatgaaggtgtgcatgcttggtgatgcccagcatgtggaggaggctgagaagatggggcttgactacatggatgttgaatctcttaagaaaatgaacaagaacaagaagcttgttaagaagcttgccaagaagtaccacgctttcttggcatctgaggcgatcatcaagcagattccccgtctccttggtcctggtctcaacaaggcaggcaagttcccgacactggttagtcaccaggagtctcttgaatccaaggtcaatgagacaaaagccacggtcaagttccagctgaagaaggttctttgcatgggtgttgctgtgggcaacttgtcaatggaggagaagcagatccagcagaacatccaaatgagcgttaacttccttgtgtcccttctgaagaagaactggcagaatgtgaggtgcctgtacatcaagagcaccatggggaaaccgtacaggttgttctaagttactgtgctccctgtgaagttgataagataccgggccattgaaccgagcttgtcttaaaacctaggtctgttgaaccttacagttttgtggttgtccaggggaatacaaagaagtatttggtcctttatctagtgctttctttaatagaacttgtggaggaatgctcttcggattatgtaattgcagtttgttatggttcaatcttactgctccatgcgtcaatcccggaaaaaaaaaaaaaaaaaaaaaaaaaaatagactctggttttatccctgggttaaccaattcccgggggccccggggggcgcgggaactgggaacgcggggccattccccctaaaggggccaattaaatccc

SEQ ID NO: 1516 - DNA, 917 bp, Theobroma cacao
gttactccttgcatctcctctatcactcagtcgcgagtcagaattccttgccaaggagccaaacaaggaacaagtaaccatgagtaagcttcagagtgatgcagttagggaagccatttccactatcgttggtgactcgaaggagaagcagcgtaagtttgtcgagacaattgagttgcagattgggttgaagaactatgatccccaaaaggataagcgtttcagtggtgccgttaagcttcctcacattcctcgtcctaagatgaaaatttgtatgcttggtgatgctctccacgtcgaagaggcagagaaaatagggttggactggatggatgtggaagcattgaagaagcttaacaagaacaagaaacttgttaagaagctagccaagaaataccatgcctttttggcttctgaagctgtcatcaaacagattcctcgtcttttaggacctggtctcaacaaggcaggcaaggaagttcccaacacttgtcacacatcaggaatctctggagtcaaaagttaatgagacaaaagctatggttaaattccagcttaagaaggttctctgtatgggtgttgctgtggggaattgcagtatggaggagaagcagatcttccagaatgtgcaactcagtgtcaatttccttgtttcattgttgaagaagaattggcaaaatgtgaggtgcttgcatctgaagagcacaatggggaggccacaacgtatctattaggaaagttcatttactttctggggatcgttttttgagcaagcatgagcaagaaacttttgtactccagacagagacattctctggaatggtgctggattttgtggttctgttttattggattcttttgtttccaacttgatcaattacagacttcttgattaatttggtagattatttggtatc

SEQ ID NO: 1517 - DNA, 717 bp, Ambrosia trifida
taccctggtgttaggaagagctaattaaaaatgagtaaacttcagagcgaagccctcagggaagccattactcagatcaccaccgatgctaaagaaagaaacgtaacttcaccgagaccattgagcttcagatcgggctcaagaactacgacccacaaaaggacaaacgttttagcggtactgttaagttgcctcacattcctcgtcctaaattgaaggtttgcatgcttggagatgcccaacatgtggaagaggctcaaaagattggtcttgaatatatggatgttgaaggactcaagaaacttaacaagaacaagaagctagtgaagaagctagccaagaaacaccaggcgtttttggcttccgaatctgttatcaagcaaattcctcgtttgttgggccctggtctaaacaaggcaggaaagttcccaacgcttgttagtcaccaggaatctctcgaggctaaggtgaatgaaaccaaagcaacggttaagtttcaactgaaaaaggtgctgtgcatgggagttgctgttggtaactgcagcatggaggagaaacagattttccaaaacgtgcagatgagcgttaatttcctcgtttcattgttgaagaagaactggcaaaatgtgagatgtttgtacttgaagacaacgatgggaaagccggttcgcatcttttagatattgtgtttgttttgttttcaaacttgttgtgagg

SEQ ID NO: 1518 - DNA, 872 bp, Ambrosia trifida
cggcaagaggtacgacgggggggtggataggaagaagaagaccacaaaaaatagagtaaacttcagagcgaagcccttagggaagccattactcagatcaccaccaatgctgtagaaaagaagcgtaacttcaccgagaccattgagcttcagatcgggctcaagaactacgacccacaaaaggacaagcgtttcagcggtaccgttaagctgcctcacattcctcgtcccaaattgaaggtttgcatgcttggagatgcccagcatgtggaagaggctcaaaagattggtcttgaatacatggatgttgaaggactcaagaagcttaacaagaacaagaagctggtgaagaagctagccaagaaacaccaagcttttttggcttccgaatccgttatcaagcaaattcctcgtttgttgggccctggtctaaacaaagcaggaaagttcccaacactcgttagtcaccaggaatctctcgaggctaaggtgaatgaaaccaaagcaacggtaaagtttcaactgaaaaaggtgctgtgcatgggagttgctgttggcaactgcagcatggaggagaaacagattttccaaaacgtgcagatgagcgttaatttcctcgtttcattgttgaagaagaactggcaaaatgtgagatgtttgtacttgaagacaacgatgggaaagccgattcgcatcttttagatattttgtttgttttttgttttcgaactttgtgtaggtcagttcttggaagctatttccttttaataggttggtgttggttttgtctcttattcgcgttctttgttgattacgattaaacatttatgttttaatggtttaccgcgtatttttatcttgtagaaaaaaga

SEQ ID NO: 1519 - DNA, 815 bp, Arnica chamissonis
ttctcagggttcttatcggagaagtgaagtttacgagaggagaagtttccgaaaatgagcaagcttcaaagtgaagcccttagagaggcaattactcagattactactgatgccaaagaaaagaagcgtaatttcactgaaactattgagcttcaaattggtttgaagaattacgatccacaaaaggacaaacgtttcagtggcacggtgaaattgcctcacattcctcgccccaaattgaaagtttgcatgcttggagatgcccaacatgttgaagaggctcaaaaaataggccttgaatatatggacgttgagagcctgaagaaacttaacaagaacaagaagttggtgaagaaacttgactaaaaaacaccaagctttcttggcttctgagtccgtcatcaagcagattcctcgtttgttgggccctggtctaaacaaagctggtaagttccctactcttgttagccaccaggaatcccttgaggcgaaggtgaatgagaccaaagcaacagtgaagttccaactaaagaaggtgctctgcatgggagttgctgttggaaactgcagcatggaggaaaagcaaatttttcaaaacgttcaaatgagtgtcaatttccttgtttctttgctcaagaaaaattggcaaaacgtgcggtgcttatacttgaagacaacaatggggaagcccgttcgcatcttttaaggaggttcatatgtttgttatgttttcatcaacatcggaataggtttttttggcttgtcacatgtttgtttttgcaaaacactaaatccatataacttatgagatttat

SEQ ID NO: 1520 - DNA, 1107 bp, Brassica rapa
gatcagatctttgagacaagctcaaaatgaggtacctgactacatctatacattcacagttgtttgaatttaactctccttcttcctttaggctattttgggtgaccaattagataaaatacgtttgattaaggtttatattagcctgctaatggctttggtatatttagataagttgagacactggttacagtttggtttgttccaactatacttgtgtcactgttgtctgtttgattaatggttctgtccttgatggattacagtaagcttcagagtgaggccgtgaaagaagccataactgtaatcagaggcaaatccgaagataagaaacgcaacttcgttgagactctcgagctccagattggtctcaagaactatgaccctcaaaaggacaagcgtttcagcggctccgtcaaactacctcacattccacgtcccaagatgaaaatctgcatgctcggagacgctcagcacgtcgaggaggctgagaaaatggggctagactatatggacgtggagtctctcaaaaagctcaacaagaacaagaagctagtcaaaaagcttgccaagaagtaccacgccttcttggcctcggagtctgtcattaagcagattcctcgtcttcttggtcctggtctcaacaaggcaggcaagttcccgacgctcgtgagtcaccaggaatcgctggaggggaaagtgaatgaaaccaaagctactgtaaagtttcagctgaagaaggttctgtgcatgggtgttgctgttggtaacctctccatggaggagaagcagatttttcagaatgttcagatgagtgttaacttccttgtctcttttcttgaagaagaactggcaaaatgtgaggtgtttgtacctcaagagcacaatgggaccacctcaaagaatcttctgagctcttgcagctccgtcaatggtggctagatacacctgcactcttgtttttaaattgcagacatatagttaagaaatgtgttggagtgactttgtttgatggattttgtagcttatatattatcttgaattacttgttcatgaatattcaacaaacaaagaattttctaaactaaaaaaattatatgccaaagc

SEQ ID NO: 1521 - DNA, 915 bp, Flaveria ramosissima
cgacgagagtacgatggggagtacggcggtgtctgttacgggttcgtaccgaagaagagtaggtttaaggaaaggaaaactaaacgaaaatagagtaagcttcagagtgatgcccttagggaagctattacccaaattactaccgatgctaaagaaaagaaacgtaatttcactgagaccattgagcttcagattggccttaagaactacgacccacaaaaggacaaacgtttcagtggaactgtgaagttgcctcatattcctcgacccaaattgaaagtttgcatgcttggagatgcccagcatgtagaagaggctcaaaagattggtcttgaatatatggatgttgaaggactcaagaagctcaacaagaacaagaagctggtgaagaagcttgctaagaaacaccaggcttttttggcttctgaatccgttatcaagcaaattcctcgtttgttgggccctggtcttaacaaggcaggaaagttcccgacacttgttactcaccaggaatccctcgaggctaaggtgaatgaaactaaggcgacagtcaagtttcaactgaaaaaggtgttgtgcatgggagttgctgttggtaactgcagcatggaggaaaaacagatcttccaaaatgtgcagatgagcgttaatttcctcgtttcattgctgaagaaaaactggcagaatgtgagatgtttgtacttgaagacaacaatgggaaagccagttcgcatcttttaggtattcagtctgtttttctcttacaaatttgttgtgaggtggtgtcggttttgacttatcgggtctctgttatgtgttatcttctcgttttagatgataccatgaacgttatgtttactggttactggttattttaacaatttttttgtcatcttaaggagagtatttgtttcg

SEQ ID NO: 1522 - DNA, 958 bp, Eutrema parvulum
ctgttgatttaggtgtattgagataagatgattttgtttggaacagtttataatggggtttgttcgaattatacttccgtcactgttttttgtttatgttatttgcttggcactggtcttgttgtctacagtaagcttcagagtgaggccgttagagaagccatcactgttatcagagggaaatccgaagagaagaaacgaaactttgtggagacacttgagctccagatcggtctgaagaattatgaccctcaaaaggacaagcgtttcagtgggtctgtcaagttaccacacataccccgtcctaagatgaagatctgcatgctcggagatgcccagcatgtcgaggaggctgacaaaatggggctagactatatggatgtggagtcccttaaaaagcttaacaaaaacaagaagctcgtcaaaaagcttgcaaagaaataccatgctttcttggcctctgaatctgtcattaagcagattccccgtcttcttggtcctggtctcaacaaggcaggaaagttccctactcttgtgagccaccaagaatcactagaggcaaaggtgaatgaaacaaaggctacagtcaaatttcagctgaagaaggttttgtgcatgggagttgcagttggtaacctctccatggaagagaagcagatctttcagaatgtccagatgagtgtcaacttcctcgtctctctcttgaagaagaactggcaaaatgttaggtgtttgtacctcaagagcaccatgggaccaccacaacgaatcttctgagctctctcacctactgtaatggtggctataagacacttgtcctttgtttttgtttcagacacatttgaaagagtgtaagaattgtgttggctcaactttagattttgttttggattgtttaagagatctgcattggttagatcgattttgaagcttatataatcttgaatttgatgtgcat

SEQ ID NO: 1523 - DNA, 935 bp, Amborella trichopoda
  misc_feature (191)..(191): n is a, c, g, or t
  misc_feature (741)..(741): n is a, c, g, or t
  misc_feature (788)..(788): n is a, c, g, or t
  misc_feature (792)..(792): n is a, c, g, or t
  misc_feature (866)..(866): n is a, c, g, or t
  misc_feature (889)..(889): n is a, c, g, or t
  misc_feature (924)..(927): n is a, c, g, or t
  misc_feature (930)..(930): n is a, c, g, or t
tcacgctgatctatatcgcagatacaggaaggagaaacttaccgattgcatgaccttttgttaaagccagaaagggaattccagaggtgccgtgatgagtaagctgcagagtgatacattgagggaggtgattagcaaggtggtaggtgatgccaaaagaaagccacgtaagtcaccgagaccattgaacntcaaattgggttgaagaactatgatccccaaaaggacaagcgcttcagtggatcagtcaagctaccccatattcctcgccctaagatgaaactatgcatgctcggagatgctcaacatgttgaagaggctgagaagatgggattggattatatggatgttgaagggttgaagaagatgaacaagaataagaagctggtgaagaaactcgccaagaaataccacgcctttcttgcatcagaagcagtcatcaagcagatcccaaggcttttgggtcctggtcttaacaaggcagggaagtttcctaccctggtttctcaccaggaatcactggaggcaaaggtgaatgagacaaaggccattgtcaaattccaacttaagaaggttctctgcatgggggttgctgttggcaattgtgctatggaggagaagcaggtctttcagaatgtccaaatgagtgttaacttcttggtttcactgttaaagaagaattggcagaatgtgaggtgcttgtacctgaagagtaccatgggtagggctcacccactcttntaaattgggttttgttagataatcaggagaaaagacaattttgtatntcancgaggtagtgtactatttctgtccctatctagcagaaagagtgatctctctttttaatgttttctggttacatnctgctgtctattcagatcctagnataacgtggctcagggtttatctattatttaaagnnnnacncgatt

SEQ ID NO: 1524 - DNA, 827 bp, Raphanus sativus
  misc_feature (126)..(126): n is a, c, g, or t
  misc_feature (135)..(135): n is a, c, g, or t
  misc_feature (144)..(144): n is a, c, g, or t
  misc_feature (192)..(192): n is a, c, g, or t
  misc_feature (195)..(195): n is a, c, g, or t
  misc_feature (270)..(270): n is a, c, g, or t
  misc_feature (363)..(363): n is a, c, g, or t
  misc_feature (366)..(366): n is a, c, g, or t
  misc_feature (576)..(576): n is a, c, g, or t
  misc_feature (710)..(710): n is a, c, g, or t
  misc_feature (737)..(737): n is a, c, g, or t
  misc_feature (766)..(766): n is a, c, g, or t
  misc_feature (775)..(775): n is a, c, g, or t
ccgtctcatcatcaggatcagatcttttgagacaagctcaaaatgagtaagcttcagagtgaggctgttaaagaagccataactgtaatcagaggaaaatcagaagagaagaaacgcaactttgtngagactctngagctccanattggtctgaaaaattatgaccctcaaaaggacaagcgtttcagtggntcngtcaagttaccacacattccccgtcccaagatgaagatctgcatgctcggagacgcccagcacgtcgaggaggcngagaaaatggggctggactctatggacgtggagtctctgaaaaagctcaacaagaacaagaagctcgtcaagaagcttgccaagaagtaccangcnttcttggcctctgaatccgtcatcaagcagatccctcgtcttctcggtcctggtctcaacaaggctggcaagttcccgacgcttgtgagccaccaggaatcgctggaggggaaggtgaatgaaactaaggctacggtaaagtttcagctgaagaaggttctgtgtatgggtgtcgctgttggtaacctctccatggaggagaagcacatntttcagaatgttcagatgagtgtcaacttcctcgtctctctcttgaagaagaactggcaaaacgtgaggtgtttgtacctcaagagcacaatgggacaccacaaagaatcttctgagctctcgcagctgcttcnatggtggctattacacttgcccttttncttttatttcagacatatttgaaagtagnaagaattgngttgctgtgacttggttgctggattttgtagcttatattatcaatgaagatt

SEQ ID NO: 1525 - DNA, 959 bp, Ambrosia trifida
ggggtacacaatagaacttgagtactggatcaagaccaagacccaggcccaattagggtttcacctcacttattattattgagtcctataacacggccgctgttttcctctttaacttcatcggtgctgctgttagggtttatacctaagacgtaaggaaaacctaacaaaaatgagtaagcttcagagtgaggccctgcgtgaagccattactcaaattaccaccgctgccaaggaaaacaagcgtaatttcactgagacaattgagctccagattgggctcaagaactacgacccacaaaaggataagcgtttcagtggcaccgtgaaattgcctcacattcctcgtcctaagttgaaggtttgcatgcttggggatgctcagcatgtagaagaggcccaaaagatcggtcttgaatacatggatgttgaaagtctcaagaagcttaacaagaacaagaagctcgtgaagaagcttgccaagaaacaccaggcttttttggcttctgaatctgttatcaagcagattccccgtttgttgggtcctggtctaaacaaggctggtaaattcccgacacttgtttcccaccaggaatccctcgaggctaaggtgaatgaaaccaaggcaactgtcaagtttcaactgaaaaaggtgttgtgcatgggagttgctgtcgggaactgcagcatggaggaaaaacagatttttcaaaacgtgcagatgagcgttaattttcttgtttcgctgttgaagaaaaactggcagaatgtgcgatgtttgtacttgaagactacaatgggaaagcctattcgcatcttttaggtgtttatcgttgtttttgctggaggccagttgttgcaagcatttccctttaatgggtgctgttgtttttgacttgttggatgtttgttttctttttgtattagatgctgttatgaacattatgtttaatggttac

SEQ ID NO: 1526 - DNA, 1101 bp, Fagus grandifolia
gttctcctctgccatcgctctctcactgcagcgcctctctctacagagcctccattggagaagaagcaagtgaaaagagaatcctctaaccatgagtaagcttcagagcgatacattgagggaggtaatctctcaggtggtgaacaacgcgaaggagaagaagcgtaacttcacggagaccatagagctccaaatcggattgaagaactatgatccccagaaagacaagcgtttcagtggctccgtcaagctccctcatatccctcgccctaagatgaagctttgcatgcttggtgatgcccagcacgttgaagaggctgagaaggtaggattggagtatatggatgtggaagggctgaagaagcttaacaagaacaagaaactggtgaagaagcttgccaagaagtaccatgcctttttggcatctgagtcggtgattaagctgattcctcgtcttttgggtcctggtcttaacaaggcaggtaagtttccaacactggtgactcaccaggaatccttggagtcgaaggttaatgaaacaaaagcaatggtgaagtttcaactcaagaaggttctttgtatgggcgttgctgttgggaattgcggtatggaggaaaagcagatcttccagaatgtgcaaatgagtatcaacttccttgtttctttgttgaagaaaaattggcaaaatgtgaggtgcttgaatctgaagagtaccatggggagcgcagtccgtctctattaagttcattttgctgctagtgagttatttaggagaagaagcctgagagaaatgtcttatgaacactatgtaagcaagacattccttggtgaatgctcctgaggtcctttttgttttcattgttttggattctttagcttcaaattttagttaatgcctgatatttttgttttgatttgatgttattggtgggtgagtaaagaaagctccttgtgtttctttttgggtatggtttagtggcatggtttgattcaggttataaggttattatgtccataaacatgggcgttttgtttcttcttgtaactttcctattatgagagagatccgttgcccttatcaattgaaagaaggaaccggct

SEQ ID NO: 1527 - DNA, 961 bp, Ricinus communis
agggtttatgacagaacggcttgtataagtaaatcggcctagccggaccatttctagggtttcttttgagcaataaacctctaaagactgtttctttaaagcttccagtcatgagtaagcttcagagtgaggcgttgagagaggcaatcactactattatgacggcttccaaggagaagaagcgtaagtttactgagactattgagctccagattgggctcaagaattatgatccgcaaaaggacaaacgtttcagtggttctgtgaagttgccacatatcccccgccctaagatgaagatttgtatgcttggagatgctcagcacgttgaggaggctgaggcaataggtctccaatggatggatgtcgaagctttgaagaagctgaataagaataagaagcttgttaagaagcttgcgaagcagtaccatgccttcttggcgtcggaatctgtcatcaagcagattcctcgtcttttgggccctgggctgaacaaggcagggaaattccctacccttgtgaatcaccaagaatcgctggagtctaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgctaaaaaagaactggcaaaatgtgaagtgtcttaacctgaagaccaccatgggaagcccacagcgcgtattttaaggagatcttcagttcgtcttttggacttgtttttcttgaatacttatataacagttttgtttttatataacagatcgtacaaaatttatagaatttttccttggcttttattttaactgaataataaattaacaaaatccagaaattcttctaaatcctttttgtatttatgactgcataatcactacctaatgtttttg

SEQ ID NO: 1528 - DNA, 970 bp, Epimedium sagittatum
gaagctcggcggtacgtttcgtttctccctcttcctccatctactcttctcctacataggtttctcgcttccggctttgtaggtagctgtagaagagctttggaaaacagggaggatgagtaagcttcagagtgatgtgttaagggaatgtatcacaaagatagttgaaaggtccaacactaagaagcgaaagttcacggagactattgagcttcagattggtctgaagaattatgatccccagaaggataagcgtttcagtggttctgtcaagctgccacatatccctcgtcccaagatgaaagtgtgcatgcttggagatgctcagcatgtagaagaggcagtgaagatcggtttggagtttatggacgtggaaggtctgaaaaagctcaacaagaacaaaaagctagtgaagaagcttgccaagaagtaccatgcttttcttgcatctgaagctgtgattaaacagattcctcgtcttcttggtcctggtcttaacaaggcaggtaagtttccaaccctcgtgactcatcaggaagctttggagtctaaagttaatgagaccaaggctatggtcaagttccaacttaagaaggttctttgcatgggagttgctgttggtaacttgggaatggatgagaagcagatcttccagaatgtgcaactcagtgtcaatttccttgtgtctttgttgaagaagaattggcagaatgtaaggtgcttgtatttgaagagttcgatgggcaggcccgaaagaatcttttgatcccacctgcattttgcattttgttactagaactttagcagtactagccttgaaacagtctgtttgtttctttagtttcttatctatcttgggcggaagactatttatatttggaacagctttattttttttaagtttttctatcgagttttggtgacatgagaaggaatatcccttgttctggttattattatttattttttt

SEQ ID NO: 1529 - DNA, 819 bp, Helianthus annuus
gaagtgaagtttcactaaggaaaacctaacaaaaatgagtaagcttcagagtgaagccctgcgtgaggccattactcaaattaccaccgatgccaaagaaaagaaacgtaatttcaccgagacaattgagctccagattggactcaagaactacgacccacaaaaggacaagcgtttcagtggcaccgtgaaattgcctcacattcctcgtcccaaattgaaagcttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccaacgcttgtttcccaccaggaatccctcgaggctaaggtgaatgaaaccaaggcaactgtcaagtttcaactgaaaaaagtgttgtgcatgggagttgctgtcgggaactgcagcatggaggaaaaacagatttttcaaaacgttcagatgagcgttaactttcttgtttcgttgttgaagaaaaactggcagaatgtccgatgtttgtacttgaagacgacaatgggaaagccagttcgcatcttttaggtgtttaactttgtttttggttgagccagttgttggaagcatttccctttaatgggtgctattgtttttgacttgttggaatgttgttttcttattgtattagattttgctatgaacattatggttaatggtta

SEQ ID NO: 1530 - DNA, 721 bp, Thalictrum flavum
caatcacccaagttactggagaagccaaagagaaaaagcgaaagtttactgagacagttgagctccagattgggcttaagaactatgatcctcaaaaagataagcgtttcagtggttctgtgaagctgccacacattccgcgtcctaagatgaagatttgcatgcttggagatgctcagcatgttgaagaggcagagaaaataggtttggagtatatggatgtagaagggctaaagaaactgaacaaaaacaagaaacttgtgaaaaagctagcaaaaaaataccatgcttttctagcatcagaagctgtcattaagcagattcctcgtcttcttggccctggtcttaacaaggcaggaaaattcccaactcttgtgactcatcaggaatcattggaatcaaaagttaatgaatccaaggctatggtgaagtttcaacttaagaaggttctttgcatgggggttgctgtgggtaatctcggaatggatgagaagcagatcttccaaaatgttcaactcagtgtcaactttcttgtctcattgttgaaaaagaactggcagaatgtgaggtgcttgtacctgaagagctcaatggggaagccattccgtatcttctaaaacattgtaattttgttagattgagtacactttgtaccaaggtagtgagcaggattagaaacttgttttggaaatgctcagatttgtcgtggttgtactattga

SEQ ID NO: 1531 - DNA, 919 bp, Trigonella foenum-graecum
atcatttcgtgcgcctccaatcttcttcctcttcctcgcaccaaggtattagatccaattcctgcaagactctgattcaagatgagtaagcttcagagtgatgctgtgagagaagcaattacaggaatcatggctgattccaaggagaaaaaccgtaaatttgttgagacgattgaactccagattgggcttaagaactacgacccccaaaaggataagcggttttctgggtctgtcaaattgccccacattcctcgacccaagatgaagatttgcatgcttggagatgcccagcatgttgaggaggctgagaaaataggactggaatcaatggatgttgaagctttgaagaagctcaacaaaaacaaaaaattggttaagaagttggcgaagaagtaccatgcctttttagcatctgaagctgttatcaagcagattcctcgtcttttgggtcctggtcttaacaaggcaggaaagttccctacgcttgtttcccaccaagaatctcttgaagctaaggttaatgagactaaggctatggtcaaattccagcttaagaaagtgctgtgcatgggagtagctgttggcaatgtgagtatggatgagaaacaaatcttccagaatgtgcaactgagtgttaacttcctcgtgtctctgctgaagaaaaactggcagaacgtgaggtgcttgtaccttaagagctcgatgggaaaatcttaccgcgtcttttaaatggctgtttttaaattcagtgtatttgaaattgcgcttactattttgattactgtaagagctgagacaggaggtttactttttcttcagttttgtttgatgagattttgttgtcagtatttcttgttcttgattggtgttaaattgcttagcaacattaatgtcaagggtgctaattttattccct

SEQ ID NO: 1532 - DNA, 993 bp, Arabidopsis thaliana
aggcttcgcctttcgagaaatttagggtttcttctgtctgtctcgtcactcaggatcagatcttagctaaattgagacaagctcaaaatgagtaagcttcagagtgaggccgttcgtgaagccatcactactatcacagggaaatccgaggcaaagaaacgtaactttgtcgagactattgagctccagatcggtctgaagaactatgaccctcaaaaggacaagcgtttcagtggatctgtcaagttaccacatatcccccgtcctaaaatgaagatctgcatgctcggagatgcccagcatgttgaagaggctgagaagatggggttggaaaacatggatgttgagtctctaaaaaagcttaacaagaacaagaaactcgtcaagaagcttgcaaagaaataccatgctttcttggcctctgagtctgtcattaagcagattcctcgtcttcttggtcctggtcttaacaaggcaggaaaattcccaactcttgtgagccaccaggaatccttggagtcaaaggtgaatgaaacaaaggcaacagtgaagttccagctgaagaaggttctgtgcatgggagttgcagttggtaacctttcaatggaagagaagcagatctttcagaatgtgcagatgagcgtcaacttcctcgtctcgctattgaagaagaactggcaaaatgtcaggtgtttgtacctcaagagcacaatgggaccaccacaaagaatcttctgagctttcacctacttaaaattggtggctataagacacttcttcttaccctttcgtttttgtttcagacatatctgttaaacagtgtaagagttgtgctgctactctcctctttagcttttggtttggataatttgaaataactgcagtgattttggttaatggattttgtagcttatattatctttgaattagatgtgcttatttcaaagacgaatcaatccacagatgtgaataaaaacagaaattttcgttttc

SEQ ID NO: 1533 - DNA, 989 bp, Arabidopsis thaliana
atttttcttcttccttgatataaaatcttcagccgcctctgaaacataactagggcttccgctttcttcaccattcaggatcagagattcgtgacctgagaagacactcaatatgagtaagcttcagagtgaggctgttagagaagccataacgactatcaagggaaaatctgaggagaagaagcgtaactttgttgagacagtggagcttcagattggtctgaagaactatgacccacaaaaggataagcgtttcagtggatctgtgaagctcccacatattcctcgcccaaaaatgaagatctgtatgcttggagatgctcagcatgttgaggaggcagagaaaatgggacttagtaacatggatgttgaggctttgaaaaagcttaacaagaacaagaagcttgttaagaagcttgctaagtcttaccatgctttcttggcttctgagtctgtcattaagcagattcctcgtcttcttggtcctggtcttaacaaggcaggaaagttcccaacacttgtgagtcaccaagagtcattggaagcaaaggtgaatgagaccaaagcaacagtgaagttccagttgaagaaagttctgtgtatgggtgttgctgttggtaacctttccatggaagagaagcagctcttccagaatgtgcagatgagtgttaacttcctcgtctcgctcttgaagaagaattggcaaaacgtaaggtgtttgtacttgaagagcaccatgggaccaccacaaagaatcttttgagctctctcttcttatccttcttccatctcagaattttgcattctgtttttgtttcagagatctgtgcttgttgggatatggtttggatttatattagcagttgttttttgttgacaatatattatgcaatattcgttttaattatcatattttttctttatctcctaaaatatgattttgatttcatcagtttgaaattttgtctttcaaaccttaaaattttctg

SEQ ID NO: 1534 - DNA, 929 bp, Manihot esculenta
cgtctgctcagcttggtcatactacatcttttctctgccgataaatctctcccttgaggctcacaggagaggaacccgctgtatagcttccaacatgagtaagctccagagtgaggcattgagagaggccatctctactattatgactgcatccaaagagaagaagcggaacttcactgagacaattgagctccaaatcgggcttaaaaattatgatccccagaaggataagcgtttcagtggttcggtgaagctgccacatattcctcgacccaaaatgaaaatttgcatgcttggagatgctcagcatgttgaggaggcagagggaataggtcttcaatggatggatgtggaagcattgaagaaactaaacaaaaataagaaattggtcaagaaacttgccaagcagtatcatgcctttttggcctctgaatctgtcatcaagcagattcctcgtcttctgggtcctggtcttaacaaggcaggaaagttccccaccctcgtgacccaccaagagtccctggagtcaaaagtgaatgaaacaaaagcaacagtcaaattccaactgaagaaggtgctttgcatgggagtggctgttgggaactgtgctatggaggagaaacaagtcttccaaaatgtgcagatgagtgtcaatttcttggtgtctttgttgaaaaaaaactggcagaatgtgaagtgcctacacctcaagactaccatgggagcaccacaacgcgtcttttaagttctttagtttgaatttttcgaagctttgtaccagagttatttacaggagtattttcgcttgaatggtcaatttttctcattgtatggctgtctgttttgttctatggaatttgcgatttaatgatataattttagacttggcttatagcttcaattggagagttgtgaggaaaattgcatat

SEQ ID NO: 1535 - DNA, 1068 bp, Ricinus communis
caccgcctatataaatagataggcttagccgcaccgtttccttgttgctagggttttggtggggctataaacttctcaagactgtttctttcaagcttcaagtcatgagtaagcttcagagtgaggcgttgagagaggcaatcactactattatggctgcttccaaggagaagaagcgtaagtttactgagactattgagctccagattgggctcaagaactatgatcctcaaaaggacaaacgtttcagtggttctgtgaagttgccacatatcccccgccctaaaatgaaaatttgtatgcttggagatgctcagcacgttgaggaggccgaggcaataggtctccaatggatggatgtcgaagctttgaagaaattgaataagaataagaagcttgttaagaagcttgcaaagcagtaccatgctttcttggcttcggaatctgtcatcaagcagattcctcgccttttgggccctggtttgaacaaggcaggaaaattccctacccttgtgactcaccaagaatctctggagtccaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgttaaaaaagaactggcaaaatgtgaaatgtctcaacctcaagaccaccatgggaactccgcagagaatcttttaaggagattctcagtttgcttttgtacttgtttttcttgatacttatataacggttttgttttttgtattgaatgttcaagctatcagttcagatccgttttgttttatttttgaatttgctagtaacattagttgtaatgttaaacatgagtttctttttaatgccacctcatattgcactggttatttcaactctcctccgcaaccttagtgtggaaaatatgttcttttcctaaagcaatagttgcatccggtgcatgtgtgggcaagtcagatttagtaagttctgataattggtaatttttgctgttgca

SEQ ID NO: 1536 - DNA, 1750 bp, Ricinus communis
ggtttattggagcaccgcctatataaatagataggcttagccgcaccgtttccttgttgctagggttttggtgggtactgtctcgctttctttctctcctccctctcactcgattctgtatttcctggaaaatttctttgattcttgtaatcttatcgctctattattgttcttttgttcttacagggctataaacttctcaagactgtttctttcaagcttcaagtcatgagtaagcttcagagtgaggcgttgagagaggcaatcactactattatggctgcttccaaggagaagaagcgtaagtttactgagactattgagctccagattgggctcaagaactatgatcctcaaaaggacaaacgtttcagtggttctgtgaagttgccacatatcccccgccctaaaatgaaaatttgtatgcttggagatgctcagcacgttgaggaggccgaggcaataggtctccaatggatggatgtcgaagctttgaagaaattgaataagaataagaagcttgttaagaagcttgcaaagcagtaccatgctttcttggcttcggaatctgtcatcaagcagattcctcgccttttgggccctggtttgaacaaggcaggaaaattccctacccttgtgactcaccaagaatctctggagtccaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgttaaaaaagaactggcaaaatgtgaaatgtctcaacctcaagaccaccatgggaactccgcagagaatcttttaaggagattctcagtttgcttttgtacttgtttttcttgatacttatataacggttttgttttttgtattgaatgttcaagctatcagttcagatccgttttgttttatttttgaatttgctagtaacattagttgtaatgttaaacatgagtttctttttaatgccacctcatattgcactggttatttcaactctcctccgcaaccttagtgtggaaaatatgttcttttcctaaagcaatagttgcatccggtgcatgtgtgggcaagtcagatttagtaagttctgataattggtaatttttgctgttgcagatgagttttcacttctcattttcattttgaagaaagttatgatttttaggagcctttggatgttactcgtttaataaaaactgtagtttctttgtcggacttcactttgcttgagaaccagcataaggaaatgtgatactcagtgttctacatctttcactattctacttataagttcgtacactatgttagtctccgcagttagctcttcttctgccaaccttgtagttgagctaaacttgatgttgcctcttatttttcctttgccatcatctttggacgtttgtatgccaacatggatgaactttgtatcgtatgttttctggagttctaaagaaaagttagcacgacctcttagccccttatgaataaagaattttgtaccggtcatccctgtccctttggaatctgtatagtccaaagaattgtaggtggcaggcaattacattgcacagcaaaacccaactgcattttatttgactagtttaagaaaggttctcatttgagtggttactttatgcgctactctggcttttcaacgacaatatgagtgtctg

SEQ ID NO: 1537 - DNA, 1028 bp, Cichorium intybus
cggggttttggtgcgtaccaacatcggcactttgaaaccctactctcagggttcttacgggagaagtgaagcttaaggaaaagaaaagtttccgaatatgagtaaacttcaaagcgatgccctcagagaggcaattactcaaatcacaactgatgccaaagaaaagaagcgtaatttcaccgaaaccattgagctccagattggcttgaagaattatgatccacaaaaggacaagcgtttcagtggtaccgtgaaattgccccacattccaaggcccaagttgaaagtttgcatgcttggagatgcccaacacgttgaagaggctcaaaagattggtcttgaatacatggatgttgaaggtcttaagaagctgaacaagaacaagaaattggtgaagaaacttgctaagaaacaccaagctttcttggcttctgaatctgttatcaagcagattcctcgtttgttgggccctggtctaaacaaggctggtaagtttcctactcttgttagccaccaggaatcccttgaggctaaagttaatgagaccaaagcaactgtgaagtttcaactgaaaaaggtgctttgtatgggagttgctgttggaaactgcagcatggaagagaaacagatcttccagaatgttcaaatgagtgttaactttcttgtttctttgttgaagaagaattggcaaaatgtgaggtgcttatacttgaaaacaacaatgggaaagccagttcgcatcttttaagtggtttacttgttttttgtgttttaattttggattaatgttaaggtcagtacttgagaaaaaatgtatttcccttgaacaggaaatagttctttttgacttgttacatgtttgtttggtacttctcattattattagtagccctacgttaatacatgaaattgttatttttcttgatccatcgattaattgttttagactgaggtttgctttattcttagcattaatgtggagaagcacatatactaaaaaaaaggctgcctcggcccaatcaaaaaag

SEQ ID NO: 1538 - DNA, 815 bp, Trifolium pratense
tgattctaatccaaaatgagtaagcttcagagcgaagcagtcagagaagccatctcaggaatcatgaccgattcaaaggataagaatcgtaagtttgtggagactattgaacttcaaattggtttgaagaactatgacccacaaaaagacaagcgttttagtggctctgttaagttgccccatatccctcgtcctaagatgaagatttgtatgcttggagatgcccagcatgttgaggaggctgagaagattggattggaatccatggatgtagaagccttgaagaagctcaacaaaaacaagaagttggtgaagaaacttgccaaaaaatatcaggctttcttagcttctgaggctgtcattaagcagattcctcggcttttgggtcctggactcaataaggcaggaaagttcccaactcttgtttctcaccaggaatctctcgaaggaaaggtaaatgagaccaaggctatggtcaagttccagcttaagaaggtgctctgcatgggagtagccgttggtaatgttagcatggatgaaaaacaaatctttcaaaatgttcaactcagtgttaatttccttgtctccctattgaaaaagaattggcagaatgttcggtgtttgtacctaaagagttccatggggaaatcataccgtgtcttttaggggatttactcttctatttctcaatattcattcagtggcttgtcatctacatcaatacattaattgtgctaatagcgagctggatagaaaatttcgttttgttacagttttgctggattgtttatggttaatttttatttttatgttcg

SEQ ID NO: 1539 - DNA, 892 bp, Cynara scolymus
  misc_feature (729)..(729): n is a, c, g, or t
  misc_feature (799)..(799): n is a, c, g, or t
ggcgggggattcggcactttcaaccctactcgcagggttctcaacagagaagtgaaggttagcgaaaggaaaatttccgaacatgagtaagcttcaaagcgaagccctcagagaggcaattactcagattactaccgatgcaaaggaaaagaaacgtaacttcactgagaccattgagctccagatcggcttgaagaactacgaccctcaaaaagacaaacgtttcagtggtaccgtgaaattgcctcacattccacgtcccaaattgaaagtttgtatgcttggagatgcccagcatgttgaagaggctcaaaagattggtcttgaatatatggatgttgagggtctgaaaaagttgaacaagaacaagaagttggtgaagaaacttgctaagaaacaccaagctttcttggcttctgagtctgtcatcaagcagattcctcgtttgttgggccctggtctaaacaaggcaggtaagttccctactcttgttacccaccaggaatcccttgaggccaaggtaaatgagaccaaagcaactgtaaagttccaactgaaaaaggtgctctgcatgggagttgctgttggaaactgcagcatggaggataaacagatcttccagaatgtgcaaatgagcgttaactttcttgtttctttgctgaagaagaattggcaaaacgtgaggtgcttatacttgaagacaacaatgggaaagccgggtcgcatctnttaagcagtttatttatgttttcattttgggttatgttgaggttggtacttgaaaaggttgtttcccatncacaggagacgttccattttgatttgttaccttttggttgctactatatttttagacggttctcttcagaacattataataattgttttttaa

SEQ ID NO: 1540 - DNA, 941 bp, Lotus japonicus
atttttgcctccggtatctcctcttcctctatccgattctctcaccttttcttctgctgctgcgctaagatctaacaccccattttcgttttctccttctttctcttcacaggtgtaagatccaattcgaaaaaccccaattctcaaaatatgagcaagctgcagaatgatgctgttagggaagctatctctggaatcatgactgattccaaggagaagaaccggaaatttgtggagaccattgagctccaaattgggttgaagaactacgacccacagaaggacaaacgtttcagtggctctgtcaagttgcctcacattcctaggcccaagatgaaaatctgcatgcttggagatgcccagcatgtggaggaggctgagaagataggtcttgagtccatggatgttgaagctttgaagaagctcaacaagaataagaagctggtgaagaagctggctaagaagtaccatgcctttttggcttctgaagctgtgatcaagcagatccctcgtcttctgggtcctgggaagttccctacacttgttactcaccaggaatctctagagtcaaaggtcaatgagaccaaggctatggtgaagttccagctgaagaaggtgctctgcatgggtgtagctgttggcaacgttagtatggaggaaaagcaaatcttccaaaacgtacaattgagtgtcaacttcctcgtctccctcttgaagaaaaactggcaaaatgttaggtgcttgtacctgaagagcactatggggaaatcataccgtgtcttctaaggagctgttgtaattgcagtgaatttccgatctcatttgtttcctcttattacttggataggagtttcaatctctctacagttttgttggatgttttttttaacaaaagaatttcatattcctgcttgttttgtttaagtgctttgcaacaattg

SEQ ID NO: 1541 - DNA, 970 bp, Medicago truncatula
ggttttctttgttcttactacaccagtgttagtgttgttcgcagctcttcttcgcatcgtagtagtacacttcgcacctcttcttctctatcgaagatgagtaagcttcagagtgatgctgtgagagaagctattacaggaatcatgggtgattccaaagaaaaaaaccgtaaatttgtggagactattgaactccagattggtttgaaaaactatgatcctcaaaaggataagcgtttcagtggttctgttaaattgcctcacattccgagaccaaagatgaaaatttgcatgcttggtgatgcccaacatgttgaggaggctgagaaaataggattggaatcgatggatgttgaagctttgaagaagctaaacaaaaataagaaactggtgaagaaattagcaaagaagtaccatgcctttttagcttctgaagctgttatcaagcagattcctcgtcttttgggtcctggtctcaacaaggcaggtaagttccctacacttgtttcccaccaagaatctcttgaggccaaggttaatgagactaaggctatggtcaaattccagcttaagaaagtgttgtgcatgggagtagctgttggcaatgtcagtatggatgaaaagcaaatattccaaaatgtacaactcagtgttaacttccttgtgtccttgttgaaaaagaactggcaaaatgttaggtgcttgtatctgaagagctccatgggcaaatcttaccgagtcttttaaaggcttgattttgaatacaatgaatttgggattgtgcgtaatattttgttattgtaatagctgggacaagaagagtttttatcatctttctacaattttgttggttgagattttgttgttacaattttgtgttcttgaatgttgtttaattggttacaaacgttggataattataggggagctaattttaatccccgggttttacatctttttgcctcttcta

SEQ ID NO: 1542 - DNA, 975 bp, Medicago truncatula
tctagggttttctttgttcttactacaccagtgttagtgttgttcgcagctcttcttcgcatcgtagtagtacacttcgcacctcttcttctctatcgaagatgagtaagcttcagagtgatgctgtgagagaagctattacaggaatcatgggtgattccaaagaaaaaaaccgtaaatttgtggagactattgaactccagattggtttgaaaaactatgatcctcaaaaggataagcgtttcagtggttctgttaaattgcctcacattccgagaccaaagatgaaaatttgcatgcttggtgatgcccaacatgttgaggaggctgagaaaataggattggaatcgatggatgttgaagctttgaagaagctaaacaaaaataagaaactggtgaagaaattagcaaagaagtaccatgcctttttagcttctgaagctgttatcaagcagattcctcgtcttttgggtcctggtctcaacaaggcaggtaagttccctacacttgtttcccaccaagaatctcttgaggccaaggttaatgagactaaggctatggtcaaattccagcttaagaaagtgttgtgcatgggagtagctgttggcaatgtcagtatggatgaaaagcaaatattccaaaatgtacaactcagtgttaacttccttgtgtccttgttgaaaaagaactggcaaaatgttaggtgcttgtatctgaagagctccatgggcaaatcttaccgagtcttttaaaggcttgattttgaatacaatgaatttgggattgtgcgtaatattttgttattgtaatagctgggacaagaagagtttttatcatctttctacaattttgttggttgagattttgttgttacaattttgtgttcttgaatgttgtttaattggttacaaacgttggataattataggggagctaattttaatccccgggttttacatctttttgcctcttcta

SEQ ID NO: 1543 - DNA, 717 bp, Parthenium argentatum
cttcataggtgctggcattatagggttcatacaaaagacgtgaagtttaacgaaggaaaacctaacaaaaatgagtaagcttcaaagtgaagccctgcgtgaagccattactcaaattaccaccgatgctaaggaaaagaaacgtaacttcactgagacaattgagctgcagattgggctcaagaactacgacccacaaaaggacaagcgtttcagtggaaccgtgaaattgccgcacattcctcgtcctaaactgaaagtgtgcatgctcggggatgcccagcatgtagaagaggcccaaaagatcggtcttgaatacatggatgttgaaagtctcaaaaagctcaacaagaacaagaagctggtgaagaagcttgcaaagaaacaccaggcctttttggcttctgaatctgttatcaagcagatccctcgtttgttgggtcctggtttaaacaaggccggtaaattcccgacacttgtttcccaccaggaatccctcgaggctaaggtgaatgaaacgaaagcaactgtcaagtttcaactgaaaaaagtgttgtgcatgggagttgctgtcggaaactgcagcatggaggaaaaacagattttccaaaacgtgcagatgagcgttaattttcttgtttcgctgttgaagaaaaactggcaaaatgtgcgatgtttgtacttgaagacaacaatgggaaagccggttcgcatctt

SEQ ID NO: 1544 - DNA, 910 bp, Rosa hybrid cultivar
cttctcttctctacggagagaaatcgttggtggatcggccatcttaagtttcgaccatgagtaagcttcagagtgatactctcagggaggctatctctatcatcatggccgcttccaaggaaaagagtcgaaagttcacagaaaccatagaacttcagattgggctgaaaaattatgatccccaaaaggacaagcgtttcagtggttctgttaagttgccacacattcctcgtccaaagatgaaggtctgcatgcttggagatgctcagcatgttgaagaggctcagaagatcggtttggagtacatggatgtagaagcgctgaagaagttaaacaagaacaagaaattggttaagaaactggctaagaagtaccatgcctttttagcatcagaagctgttatcaagcagattccccgtcttttgggtcctggtctcaacaaggcaggaaagttcccaacccttgtttctcaccaagaatccctagagtctaaaatttctgagacaaaagcaacaattaagttccaattgaagaaggttctttgcatgggagttgctgtagggaatgtctcaatggaggagaagcaaatcttccaaaatgtgcaattgagtgtgaacttccttgtttcactattgaaaaaaaattggcaaaatgtaaagtgcttgaacctgaagaccactatggggaagccatatcgcatttattagagtcttcacttatttttggagatttgtagctggaggttgtaaggagcctgctccttataggaagtgtgtgtattcaaatggtccagtttttttcttatttgcctattttacttttttgcttaatgcttgttgacgttggtatgctagactttgtattattattgttgaagagtaaactggatttcattttgaaaaaaaaaaaa

SEQ ID NO: 1545 - DNA, 912 bp, Rosa hybrid cultivar
ctcttctcttctctacggtgagaaatcgttggtggattggtcatcttaagtttcgaccatgagtaagcttcagagtgatactctcagggaggctatctctatcatcatggccgcttccaaggaaaagagtcgtaagttcacagaaactatagaacttcagattgggctgaaaaattatgatccccaaaaggacaagcgtttcagtggttccgttaagttgccacacattcctcgtccaaagatgaaggtctgcatgcttggagatgctcagcatgttgaagaggctcagaagatcggtttggagtacatggatgtagaagcgctgaagaagttaaacaagaacaagaaattggttaagaaactggctaagaagtaccatgcctttttagcatcagaagctgttatcaagcagattccccgtcttttgggtcctggtctcaacaaggcaggaaagttcccaacccttgtttctcaccaagaatccctagagtctaaaatttctgagacaaaagcaacaattaagttccaattgaagaaggttctttgcatgggagttgctgtagggaatgtctcaatggaggagaagcaaatcttccaaaatgtgcaattgagtgtgaacttccttgtttcactattgaaaaaaaattggcaaaatgtaaagtgcttgaacctgaagaccactatggggaagccatatcgcatttattagagtcttcacttatttttggagatttgtagctggaggttgtaaggagcctgctccttataggaagtgtgtgtattcaaatggtccagtttttttcttatttgcctattttacttttttgcttaatgcttgttgacgttggtatgctagactttgtattattattgttgaagagtaaactggatttcattttgaaaaaaaaaaaa

SEQ ID NO: 1546 - DNA, 696 bp, Sequoia sempervirens
gcgataacaggactagtgggagagagcaaagagaagaataggaagtttgtggagacgatagagctgcagatagggctgaagaactatgacccccagaaggacaagcgtttcagtggctccgtcaaactacctcacatccctcgccccaagatgaagctctgtatgctcggagatgcccagcatgttgaagaggctgtgaaaataggtctggactacatggatgtggaaggattaaagaaaatgaacaagaacaagaaactggttaagaagcttgcaaagaaatatcatgcttttctcgcatcagaagcaattattaagcagattcctcgacttcttggtcctggtctaaacaaggcaggtaaatttcccactttggtgtcacatcaagagtcattggaggggaaagtaaatgaaaccaaagctacaatcaagttccaattgaagaaagttctctgtatgggtgttgccgtgggcaactgtggcatggaggaaaagcaaatatttcagaatgtccagctgagtgtcaactttctggtgtccttgcttaagaaaaactggcaaaatgttcgttgcctttatctgaagagcaccatgggcaagccatctcggatattctaatctaatactgcaattagttttagcttttgctcaattaactttgagatatgtattgttttgttcgtttaatgtatgagg

SEQ ID NO: 1547 - DNA, 912 bp, Fragaria vesca
gcctttcactcagagccgtctcctccatccctctcattccttcatccctgttccgatttcgtcatgagtaagcttcaaagtgaggcattgagggaggccatctcccagatcaagactaatgcggagaccaagaagaggaagttcactgagactgtggagttgcagattggtctgaagaactatgacccacaaaaggacaagcgtttcagcggttccgtcaggcttccccacattcctcgccccaagatgagggtttgtatgcttggagatgcccagcatgtcgaagaggctgagaagatgggattggcctacatggatgtggaatccctgaagaagcttaacaagaacaagaagcttgtcaagaagcttgcaaagaagtatcatgcttttttggcttctgaggctgtcatcaagcaaattcctcgtcttttgggccctggactcaacaaggcaggtaagttcccaactcttgtgagtcaccaggaatctctggaggcaaagcttaatgaaaccaaggccatggtgaagttccaactcaagaaggttctttgtatgggtgttgctgtcgggaatcttgccatggaggagaagcagatattccagaatgtgcaactcagtgtcaatttcttggtttctctattgaagaagaattggcagaatgtgaggtcgttgaacctgaagagcaccatgggcaaagcaattcgaatctactaagttcttacgtttcagcaggagctattatgtggacgaagagcagtagcaaaactatcatccttttgtttactttagtttaaattcatagcctaaactacaaggtgtactgtgatttttgttcaattgaatgcttaattttgaagggattctgtttgttcttcaatatctgcttgtcatggtttttagtttgttgtgtac

SEQ ID NO: 1548 - DNA, 740 bp, Euphorbia peplus
gaacaccttcaaaattcaatcatcatgagtaagcttcagagtgaagcattgagggaggctatcaccactatcatgactgcctccaaggaaaagaagcggaatttcacagagacaattgaactccagatagggcttaagaactacgatccccaaaaggataaacggttcagtggctctgtgaaattgcctcacatccctcgccctaagatgaaggtttgcatgcttggagatgctcagcatgttgaggaggctacagcaattggcctccaatggatggacgtggaggctcttaagaagctcaacaagaacaagaagcttgtgaagaagctggccaagcagtaccatgcctttttggcttctgaatctgtcattaaacagattccccgtcttcttggccctggtctcaacaaggcaggtaagttcccaactcttgtgacccaccaagagtccttggagtctaaggtcaacgagacaaaagccacggttaagtttcagttgaaaaaggtgctttgcatgggtgttgctgttggaaactgtgccatggaggagaagcaagttttccagaacgttcaaatgagcgtgaacttccttgtctctctacttaagaagaactggcaaaacgtgaagtgcctaaacctgaagactacaatgggttctcctcaacgtgtcttttaaggagtttgatttcgaattgcagttgaacttttgagagacagtttcttgataattatagaattttt

SEQ ID NO: 1549 - DNA, 861 bp, Fagopyrum esculentum
tcgggggtacccttctctgttttcgctgcacccatcaaactcgagcagccgccatgagtaagctttcgaacgatgccttaagagaggccatatctaccatctccaaatctgccgcggagaagccgaagaagttcaccgagaccatagagcttcagattggtctcaagaactatgacccacaaaaggacaaacgtttcagtggctccgtcaagctcccccacgttccccgccctaagatgaaggtctgcatgctcggagatgcccagcacgttgaagagtctgagaaagttgggctggactcaatggatgttgaagctctgaagaagttgaacaagaacaaaaagttggtgaagaagcttgccaagaaataccatgcctttttggcatccgaagctgtgatcaagcagatcccacgtttgcttggtccggggcttaacaaggcaggaaagttccccaccctggtttcacaccaggagtcattggagaacaaagtgcaggaaatcaagtcaacagtgaagttccagcttaagaaggttctctgcatgggtgttgctgttggaaactgtggcatggaggagaagcagatcttccagaatgttcagatgagcgttaacttccttgtctctttgctgaagaagaattggcaaaatgttcgttgcttgtacctgaagagcaccatgggaaggccagttcgcatcttctaagccttgaaatgttttctagttgcagctgtaatggattgccaattttgttaactttgtttcatgttgcactcaaattcttcaattcaagtttgatactcaatcctcccagcatattagatttgaaattttactacgattgctgattgctgcttcagtt

SEQ ID NO: 1550 - DNA, 707 bp, Flaveria ramosissima
ggcactttgaaaccctactctcagggttctcacggagacgtgaagttaacgagaagagaagtttcctaaaatgagcaagcttcaaagtgatgccctcagagaggcaattactcagatcaccactgatgccaaagaaaagaaacgtaatttcaccgagaccattgagcttcaaattggcttgaagaattacgacccacaaaaggacaaacgtttcagtggtacagtgaagttgcctcacattcctcggcccaagttgaaagtttgcatgcttggtgatgcccaacatgttgaagaggcccaaaaaattggtctagaatatatggatgttgagggtctgaagaagcttaacaagaacaagaagttagtgaagaaacttgctaaaaaacaccaagctttcttggcttctgagtctgtcatcaagcagattcctcgtttgttgggccctggtcttaacaaagctggtaagtttccgacacttgtcacccaccaggagtcccttgaggctaaggtgaatgagaccaaagcaacagtgaagtttcaactaaagaaggtgctgtgcatgggagttgctgttggaaactgcagcatggaggaaaagcaaattttccaaaacgttcaaatgagtgtcaattttcttgtttctttgctcaagaaaaattggcaaaacgtccggtgcttatacttgaagacaacaatggggaagcctg

SEQ ID NO: 1551 - DNA, 909 bp, Rosa hybrid cultivar
gcctcactcagctgtagccgtctcctccttcctctggtttttttaggtttcaccccagttgttccagtaacgatttcgccatgagcaagctgcaaagtgaggcattgagggaggccatctcccagattaagactaattcggagacgaagaagaggaagttcaccgagacagtggagttgcaaattgggttgaagaactatgacccacaaaaggacaagcgtttcagtggttccgtgaagcttccccacattcctcgtcctaagatgagggtttgcatgcttggagatgctcagcatgttgaagaggcagagaagatgggattggcctacatggatgtggaatcgctgaaaaagcttaacaagaacaagaagctggtcaagaagcttgcaaagaagtatcatgcatttttggcttctgaagctgtcatcaagcaaattcctcgtcttttgggccctggtcttaacaaggcaggtaagtttccaactctggtgagtcaccaggaatctctggaggcaaagcttaatgaaacaaaggccatggttaagttccaactcaagaaggttctttgtatgggtgttgccgtcgggaatcttgccatggatgagaaacagatattccagaatgtgcaactcagtgtcaatttcttggtttctctgttgaagaagaattggcagaatgtgagatcattgaacctgaaaagcaccatggggaaagctatccgaatttactaaattcttgcgtttcagccgaggcattcatgtggaagaagagcattagcaaaactatgttgctttttgttgactttagtttaaattcctagcccaaactacaatgcgtaccgtgatttttgtttaaaagtgaatgctcatggataattttgaagggattttgtttttcttaaattatctg

SEQ ID NO: 1552 - DNA, 700 bp, Helianthus annuus
tagggtttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgccctaagttgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttggttcattggtgaagaaaaactggcagaatgtccgatgtttgtacttgaagacgacaatgggaaagccggttcgcatctttta

SEQ ID NO: 1553 - DNA, 691 bp, Brassica rapa
ggttctctctctctgtttccgatcttccacaggtggaacagtatctgagaaactgccaaaatgagtaagctccagagtgaagccgtgagagaggcgatatcctcaatgatcactcactgcaaggagacaaagccacgcaagttcactgagaccatcgagctccagattggtcttaagaactatgacccacaaaaggacaaacggtttagcggatcggttaagctgcctcacattccaaggcccaagatgaagatctgcatgctcggtgacgcccagcacgttgaagaggctgagaagattgggttggactctatggatgttgaagctcttaagaagttgaacaagaacaagaaacttgttaagaagctagctaagaagtttcatgctttccttgcttctgagtctgtcattaaacagattcctcgtcttcttggtcctggtctcaacaaggcaggaaagttccctacacttgttagccaccaagagtctttggaggccaaggtgaatgagactaaggcaacagtcaagttccagctcaagaaggttctgtgcatgggtgtcgctgttgggaatctcggcatggaggagaagcagatcttccagaacgttcagatgagcgttaacttccttgtttcactcttgaagaaaaactggcaaaacgtgaggtgtttgtacttgaagagcacaatgg

SEQ ID NO: 1554 - DNA, 760 bp, Catharanthus roseus
tagtggatccaaagaattcggcacgaggtataaaactccgccgcgcaccaccatagtcacctccctcccctccaccggaactctagtggagcacaattcaggagtgaagaatttcagggacattaaatcatgagtaagcttcagagtgatgccctcagagaagccatttctcagattaagaatgacgctgatgctaaaaaacggaactttacggagacagttgagcttcagattggactgaaaaattatgatccccagaaggacaaacgtttcagtggctctgtgaggttaccacacattcctcgtccaaagatgaaagtttgcatgcttggagatgctcagcacgttgaggaggccgaaaagattggtctggagtacatggatgtggaaggcctgaagaagctgaacaaaaacaagaaattggtcaagaagcttgctaagaaatatcatgctttcttggcttcagaagctgtgataaagcagataccgcgtctcttagggcctggtcttaacaaggctggcaaatttcctacccttgttacacaccaggaatcccttgaatctaaagttaacgaaaccaaggcaacagtaaagtttcagttgaagaaggtgctttgcatgggagttgcagtggggaattgtgctatggaggaaaagcaaatctttcaaaatgtgcagatgagtgtgaatttccttgtttccttgttgaagaagaattggcaaaatgtgaggtgcttgtacctcggccgcgaccacgcta

SEQ ID NO: 1555 - DNA, 737 bp, Hevea brasiliensis
cctgtaggatcctttcttgaaagcttccaatcatgagtaagctccagagtgaggcattgagagaggccatttctactattatgactgcatccaaagagaagaagcggaacttcactgagacaattgagctccaaattgggctcaagaattacgatccccagaaggataagcgtttcagtggctcggtgaagctgccacatattccccggcccaaaatgaaaatttgcatgcttggtgatgctcagcatgttgaggaggcagagggaataggtttgcagtggatggatgtggaagcattgaagaaactaaacaagaacaagaaattggtcaagaaactcgccaagcagtaccatgcgtttttggcttcagaatcagtcatcaagcagattcctcgtcttctgggccctggtctcaacaaggcagggaagttccctacccttgtcacccaccaagagtccctagagtctaaagtgaatgaaacaaaagcaacagtgaagttccagttgaagaaagtgctttgcatgggagtggctgttgggaactgtgctatggaggagaagcaggtgttccaaaatgtgcaaatgagtgtcaatttcctagtttctttgttgaagaaaaactggcagaatgttaagtgcctacacctcaagactaccatgggggcgccacaacgcatcttttaaggaggtctttagttttaattttgaagatgtgtaccagagatctaattaaagaag

SEQ ID NO: 1556 - DNA, 913 bp, Mesembryanthemum crystallinum
  misc_feature (815)..(815): n is a, c, g, or t
  misc_feature (913)..(913): n is a, c, g, or t
cctacatagtgctagatgcatcggcacgaggccaaaccctagcgtcctctctctctcctctccggttttttcgagtttcctccatttaactattactcatgagtaagcttcagagtgacgcagtgagggaagccatctctggtattcaaaatgatgcccgagagaaaaatcgcaagtttacagagacaattgagctccagattgggctgaaaaactatgatcctcaaaaggacaagcgtttcagtggtactgttaagttgcctaacattccccgcccaaagatgaaggtttgcatgctgggtgatgcacaacacgtcgaagaggctgagaggattggtttggagtggatggatgtggaagcattgaagaaacttaacaagaacaagaaactggttaagaagcttgctaagaagtaccatgctttccttgcatctgaatcagttatcaagcagatccctcgtttgctgggtcctggtcttaacaaggcaggtaagttccctgctcttgtcactcaccaggaaccccttgagaacaaggtaaacgaggccaaggcaactgttaagttccagcttaagaaggttctttgcatgggagtcgctgttgggaattgcggcatggacgacaagcagattttccagaatgtgcaaatgagtgtcaactttctagtttcactattgaagaagaattggcagaatgttcgatgcttgtacctgaagagtaccatggggcagccataccgcattttctaagaatgtgttaatccttcttttttatttgggtggaaactttgtaggagctcttggaatttggttaanttggtggggaagtaaacccaggggttaaacattgggaagctaagataactggaaagaaggccctggatgacaagaccccttaggtttttctttaactn

SEQ ID NO: 1557 - DNA, 918 bp, Jatropha curcas
cggcgctctaaacatggatccccgggctgaggaattcgaattccacttgcttgttgcggtaatccgtaaaacctgttagagcgtttcttggaacctgccaataatgagtaagcttcagagtgagacattgagagaggctatctctactattatggctgcttctgtggagaagaagcgtaactttactgagacaattgagctccagattggactgaagaactatgatcctcaaaaggataagcgtttcagtggctctgtgaagttgcctcacatccctcgtcctaagatgaagatttgcatgcttggagatgctcagcatgttgaggaggctgaggcaataggactacaatggatggatgtggaagcattgaagaagctaaacaagaacaaaaaattggttaagaaacttgcaaagcagtaccatgccttcttggcttcagaatctgtcatcaagcagattcctcgtcttctgggccctggtctgaacaaggcaggtaaatttcctacccttgtgacccatcaggagtccctagagtctaaagtgaatgaaacaaaggcaacagtgaaattccaattaaagaaagtgctctgcatgggagttgctgttggcaactgtgctatggaggagaagcaagtcttccaaaatgtgcaaatgagcgtcaattttcttgtttccttgttgaagaagaactggcaaaatgtgaagtgcctaaacgtcaagactacaatgggtaacccagttcgcatcttttaaaggagcagcttatttggagttttgagatttttacgagatgtagcattccagttacctgtagaagtgtcttactttaaagatcacattttcttcttggattgttgttatttttgttttgttggaattgctagtaaaattgaaatgcttgattatagttttttatc

SEQ ID NO: 1558 - DNA, 868 bp, Pisum sativum
cgctttttgttgtgagatctgtagctgattacccactgtattctgttatcaaaatgagtaagcttcaaagtgaggctgtgagagaagccatctcaggaatcatgggtgattccaaggacaagcaaaggaagtttgtggaaactattgagcttcaaattgggctcaagaactacgatccacaaaaggacaaacgtttcagtggatccgtcaagttgccccatatccctcgccccaagatgaagatttgtatgcttggagatgcccaacacgtcgaagaggcagagaaaataggtttggagtcgatggatgttgaagctttgaagaagctcaacaagaataagaagttggtgaagaaactagccaagaggtaccatgccttcttagcttctgaggcagtcattaagcagattccccgtctcttgggtcctggtctcaataaagcagggaagtttccaacacttgtgtcccaccaagaatctcttgaggcaaaggtaaatgagaccaaagctatggtcaaatttcagcttaagaaggtgctctgcatgggagtagccgtgggcaatgttagcatggacgagaagcaaatctttcaaaatgttcaactcagtgttaacttcctagtctctttgttgaaaaagaactggcagaatgtccgttgcttgtatctgaagagttcaatggggaagtcttaccgtgtcttttaggaagtttattttcttaacattgttccgatattcagcggcgcgcaatctctctctttagttatcctaatagttggatagaatatttcatcttctcacaattttgctggttttttaatgttaatttttgtctttatgttaaaatacttgatgattttacgattgct

SEQ ID NO: 1559 - DNA, 776 bp, Euphorbia esula
  misc_feature (22)..(22): n is a, c, g, or t
ggcacgagggctccctcctctntccgcccccttcaggaacaccttcaaaattcaatcatcatgagtaagcttcagagtgaagcattgagggaggctatcaccactatcatgactgcctccaaggaaaagaagcggaatttcacagagacaattgaactccagatagggcttaagaactacgatccccaaaaggataaacggttcagtggctctgtgaaattgcctcacatccctcgccctaagatgaaggtttgcatgcttggagatgctcagcatgttgaggaggctacagcaattggcctccaatggatggacgtggaggctcttaagaagctcaacaagaacaagaagcttgtgaagaagctggccaagcagtaccatgcctttttggcttctgaatctgtcattaaacagattccccgtcttcttggccctggtctcaacaaggcaggtaagttcccaactcttgtgacccaccaagagtccttggagtctaaggtcaacgagacaaaagccacggttaagtttcagttgaaaaaggtgctttgcatgggtgttgctgttggaaactgtgccatggaggagaagcaagttttccagaacgttcaaatgagcgtgaacttccttgtctctctacttaagaagaactggcaaaacgtgaagtgcctaaacctgaagactacaatgggttctcctcaacgtgtcttttaaggagtttgatttcgaattgcagttgaacttttgagagacagtttcttgataattatagaattttt

SEQ ID NO: 1560 - DNA, 917 bp, Triphysaria pusilla
agttcgtggttttctcagttgctgcctctcgcaacctatcatcctcctctgaacaagtgagctgggaagatacgaacatattgaaccatgagtaaggtttcgcctgatgctatcagagaggcaattgctactattgctacagagtctaaagagaaaaaccggaagttcactgagacaatagagcttcagattgggctgaaaaactatgacccacaaaaggataaacgtttcagtggttctgttaagctgccccacattccccgtcccaaaatgcagatttgcatgctcggtgacgcccagcacgctgatgaggctgaaaagattgggttggcttccatggatgtggaggctctgaagaaactgaataagaacaagaagttggtcaagaagctggccaagaagtaccatgctttcttagcttctgaagctgttattaagcagattcctcgtcttctcggacctggtctaaacaaagcaggtaagtttccaacacttgtgagtcaccaggaatctctggagggaaaggtgaatgagaccaaggctactattaagttccagctgaagaaggtgctttgcatgggagtagctgttggtaacttgggtatggaagagaagcagatattccagaatgtgcaaatgagcattaatttccttgtttctcttcttaagaagaattggcaaaatgtgaggtgcttgtacttgaagagtaccatggggaagccacaacgcatcttttaaaagacttgttttcgctctttggaattttaggaaattgaagttttattatgctttttgtatccgttaaatttcttgttgacattggaatcttttggttttctatctttttgatactatatgctgagatgaattttgcttagtgtaatattgtttgttttgagatatgctttggtccttgc

SEQ ID NO: 1561 - DNA, 867 bp, Ambrosia trifida
cacttccaaaccctagtttcagggttctcactaaaggttgaagctaacaataagacaagttactgaaaatgagtaagcttcaaagtgaagcccttagagaggcaattactcagatcactactgatgcgaaggaaaagaaacgtaactttactgaaaccattgagcttcagattggtttgaagaattacgatccacaaaaggacaaacgtttcagtggtaccgtgaaattgcctcacattcctcgccccaagcttaaagtttgcatgcttggagatgctcaacatgttgaagaggctcaaaaaattggccttgaatacatggatgtcgagagtttgaagaagttgaacaagaacaagaagttggtgaagaaacttgctaagaaacatcaagctttcttggcttctgagtctgtcatcaagcagattccgcgtttgttgggccccggtcttaacaaagcaggtaagttccctactcttgtttcccatcaagaatctctagaggcgaaggtcaacgagacaaaagcgacagtcaagtttcaacttaagaaggtgctctgcatgggagttgccgttggaaactgcagcatggaagaaaagcaaatcttccagaatgttcaaatgagtgtcaacttcttggtttctttacttaagaagaattggcaaatgtgcggtgcttgtacttgaagacaacaatgggaagccggttcgcatcttttaaagagtttattgttatgttttcatttcatttcgggttaatgttgaggtcagtactggaaaacatatttcccatgaacagggaatggtcctttttggctttttacatgtttgtttggtactatagctttggactccttcggttatatcattg

SEQ ID NO: 1562 - DNA, 836 bp, Flaveria ramosissima
agaattgaagctaacgaggggagaagtgtctgaaaatgagcaagcttcaaagtgatgcccttagagaggcaattactcagatcaccactgatgctaaagaaaagaagcgtaacttcactgaaaccattgagctccagattggtttaaagaattacgatccacaaaaggacaaacgtttcagtggtactgtgaaattgcctcacatccctcgccccaaacttaaagtttgcatgcttggagatgctcaacatgttgaagaggcacaaaaaaaattggtcttgaatatatggatgttaaggggttgaagaagctgaacaagaacaaaaagttggtgagaaacttgctaagaaacatcaagctttcttggcttctgagtctgttatcaagcagattcctcgtttgttgggccccggtttaaacaaagcaggcaagttcccaactctcgttacccaccaagaatctcttgaggcaaaagtaaacgagactaaagcaacagtcaaattccaactgaagaaggtgctctgcatgggagttgctgttggaaactgcagcatggaagaaaagcagatcttccaaaacgttcaaatgagtgtcaatttcttagtttctttgcttaagaagaattggcaaaacgtgcggtgtttgtacttgaagacaacaatgggaaagccggtccgcatcttttaagttcatttgttatgtttttatttttggtttaatgttgaggctagtacccaaaacatatttcccatgagctgggagtagtaatcctttttggctttttacatgtttgtttggcgctatatttttggaccctcagttttagactaataact

SEQ ID NO: 1563 - DNA, 3320 bp, Manihot esculenta
atttaattcaacaaatcccttccaaaattaaacctcaaatgaatatccttttcttccttctgtttacgactgcgttctcttttctccggttcgtttgttcttctccggccgatcacagctacaatgtaggagatcctgtacctctattcgtcaacaaagttggtcccttgcacaatcccagtgaaacctaccgctactatgatttgccattctgtcgtccagataatgtaattcgaaagaaagaaacgcttggtgaggtgttgaatggggatcgtttgagtagtgctttgtatgacttgaaattcagggaggacaaaactggggttaccctttgtaagaagaagcttaaaggagatgaagttttgaggtttagagatgctattatcgatgatttctacttccaaatgtattatgatgatctcccgttatggggctttattgggaaagttgaagaacaaagttggattgttggtcagagagagtttaagtattatctgtttaaacacgttcagtttgatgttctttatcgtggcaatcgagtcattgaagtaagtgcttttagtgatccaaatcatgctgtggatataactgaagatgttgatatagatgttgagttcacttattcagttatctggaatgcgacctcagctccatttgagaccaggatggacaaatattcgagggcttcgtttcatccagtacaccagcagatccattggttctcatttgttaactcaatcatcatcattttgctcctgatgggattgctcactgggctttttatgcgacgtctcaggaatgatttgaaaaagtgttctggtggagatgaagaggaagataaagaggttggctggaaatacatccatagtgacgttttcagatacccacataacatatccttgttttctgctgtcttgggcacaggcactcaactgctgacaatggtttgctttttatttgttttggcatttgttggtgtgctatacccttacaatcgtggagccttgtgcacttctttcgtcttggtatatacactcacatctgtggttgggggttataccactgctgctttccacaatcagtttgctcaaactggatggaaaaggagtgttattttcactgggattctgttcctcggtccattgtttgtgatactatccattttgaatatcattgctgtatcttatgggaccacagccacacttccatttggaaccattatggtgatacttctcatacacgtattttttactgttccattgcttgccttgggagggcttcttggttactgtttcaggtctgtatttcaagccccttctgctacaaaaaggtacccaagggagattccgccattaggatggtacaggaaaacacctgctcaaatgtttcttgcaggaattttatgctgtagtgcaattatccttgagttacaccacttatatgcaagcttgtggggctataaaatatgcactctgcccagcattttgtttgtcactttcatcatccttatcttacttaccgcactcttaagtatcgttatgacatacattctgctctccgcagaggaccatcagtggtggtggagatctgtgttgtgtgggggtgcacctgccatttttatgttcagttatggtatctgcttctttgccaggtcaaatatgaggggcttcatgcagctatcatttttcttagggtataatgcttgcatttgctatgcatttttcttgatgctgggtacagtcagttttcgtgcttcattcatgtttgtttcccacatataccatgctgttaagagtgagtgaacaatttccttttaactttgtaatggcctgtcacttttccagtaaactccactcctcctcaaaggcttaagaagggagacgaggtggggtgggagaacacagagagagagagggagagagaggggaaggcaaaatttattaattcttcttgtaacatgtatggagtcttccaagacttgaggatattgaaagcaagagaggaaatctgtgtttgtagtattggaagatgtaaccaacgctataaaccacaaaaaattgctagcatgggaacccctcaaaagtttcctgcattttcctcagaaacaaacaactcagcagcagcaaaattgtctgcaagcgaacatggtaatgaagacagtatttgcggacgtgaaagattaaagaaacatcgacaagaggtggctggtcatgttgtgattccagagagttggggccatgaaaattttcttaaggattggattgattgttcttccttcgacaagttattagccccagatggaatttcatctgctcgccaatctcttgctgctcagggacgacagaaaccaacttccaattctcaacgtttcaggatagcaagtagtaagcttcagagtgaggcattgagagaggccatctctactattatgaatgcttctaaagagaagaagcgtaacttcactgagacaattgagctccaaattgggctcaagaattatgatccccagaaggataaacgtttcagtggctccgtgaagctgccacatatcccgcggcccaaaatgaaaatttgcatgcttggagatgctcagcatgttgaggaggcagagggaattggcctacaatggatggatgtggaagcgttgaagaagttgaacaaaaacaagaaattggtcaagaaacttgccaagcagtaccatgcctttttagcttcagaatctgtcatcaagcagattcctcgtcttctgggtcctggtctcaacaaggcaggtaagttccctaccctggtcacccaccaagagtctctggagtccaaggtgaatgagacaaaggcgacagtgaagttccaattgaagaaggtactttgcatgggagttgccgttggtaattgtgctatggaagagaagcaggttttccagaatgtccagatgagcgttaatttcctagtttctttgttgaagaagaattggcaaaatgttaagtgcctgcacctcaagactaccatggggacaccacaacgcgtcttttaaggagtacacttcagtttactatttggagttgtgtaccagagatctagaatttcttgatatttactggagtattgtgcttgaatggtcaattgccaaattggagagccgttttgttttgttctgttatgtttttgttgaaattgctagtaatgatataattttagacttctgtagagtttttattagagaggtgtgaacttaattttctttgatttgcagtaaaatgttaaacggttttatctcatatgacacatgctatttggtcccattttttgatggcacataagtt

SEQ ID NO: 1564 - DNA, 824 bp, Gerbera hybrid cultivar
agtgttcctacaggagaagtgaagttgaaggaaggaaaattgtatcacgatgagtaagcttcagagtgaagccctgcgagaagctattactcagattaccaccgatgccaaggaaaagaaacgtaattttactgagaccattgagctccagattggactcaagaactatgacccacaaaaggacaaacgtttcagtggtactgtgaagttgccacacattcctcgtcccaagttgaaagtttgcatgcttggagatgctcagcatgtggaagaggctcaaaagaaggccttgaattatggacgttgaagggcttaagaagctgaacaagaataagaagctagtgaagaagcttgctaagaaacaccaagcttttttggcttctgagtctgtcatcaagcagattcctcgcttgttgggacccggtctaaacaaagcaggaaagttccctacacttgttacccaccaagaatccctcgaagctaaggttaacgaaacaaaggccactgtgaagtttcaactgaaaaaggtgctttgcatgggagttgctgtaggaaactgtagcatggaagataaacagattttccaaaacgttcaaatgagcgtcaatttccttgtttcgctactcaagaagaattggcaaaatgtgaggtgtttgtacttgaagacaacgatgggaaagccggttcggatcttttaggttatgtatttttgttttaactctgggctgttgaggtgagtactttgtcttatttaatgtttgttttatcttaattttagatgctaccatgaacattatattaatgtatttttgcttagtctattt

SEQ ID NO: 1565 - DNA, 779 bp, Ipomoea nil
ggcttcgtatacctcaggacttgacttcaggtatttacaagggacagcaaagtcgtccgccatgagtaaattgcaaagtgatgccgtgagggaagcaatcacccagataatgggggattccaaggagaagaatagaaaattcacagagactattgagctgcaaattgggttgaagaattatgatccccagaaggataagcgtttcagtggctctgttaaactaccccacattccccgccctaagatgaagatatgcatgcttggtgatgctcagcatgttgaagaggcagaaaagattggaatggagtatatggatgtggagtttaaagaaactcaacaagaacaagaaacttgtaaagaagctggctaagaagtaccatgccttcttggcatctgaagctgttattaaacagattccaaggcttttgggccctggtcttaacaaggcaggtaagtttccaacattggtgacacatcaagagtccttggagaacaagtccaatgaaacgaaagctatggtgaaatttcagcttaagaaggtcctctgtatgggtgttgcagttggaaatgtggcaatggaggagaagcaggtgtttcagaatgttcagatgagtgtcaacttccttgtctcgctgttgaagaaaaactggcaaaatgtcaggtgcttgtatctcaaaacaaccatgggaaggacagtccggatcttttgagttggtgcttttgtttttctagagttctgtagggagagctgagaattggatttgtcatcttcttctagt

SEQ ID NO: 1566 - DNA, 733 bp, Lotus japonicus
ggcttcccagctccagccgccaaatctcattagggtttcgccactgctgtgagctcttcttccaatgattcggaacgatgagtaagcttcagaatgatgctgtcagagaagctatctccggaatcatgactgattccaaggagaagaatcgcaaatttgtggagaccattgaactccagattggtctcaagaactatgatcgccagaaagacaagcgtttcagtggctctgtcaagttgccccatatccctcgacccaagatgaagatttgcatgcttggtgatgctcaacacgtcgaagaggcggaaaaattggattgaactggatggacgtcgaagcattgaagaagctgaacaaaaataagaagttggtgaagaagctagctaagaaataccatgcatttttagcttctgaggctgtcattaagcagattcctcgtcttttgggtcctggtctcaacaaggaaggcaagttccctacacttgtcactcaccaagaatcccttgaagcaaaggttaatgagactaaggctatggtcaaatttcagctcaaaaaggtgctctgcatgggagtcgccgtgggtaatgttagcatggaagaaaaacagatctttcaaaacgtgcaactgagtgttaacttccttgtctctttgttgaaaagaactggcaaaatgttagtgcttgtatctgaagagtaccatggggaaatcgtaccgcgtctttaaggatttatt

SEQ ID NO: 1567 - DNA, 818 bp, Cajanus cajan
tagggtttggcctgcggtactttctctgctctcacaagactttcctattagattttctaccatttttcttctgcttccttcgccgagtccaattctcactttctctttctctgcatttttgttcgcagcttttagatctatatccacctagcccttcatttggaaaaccccaagtttcaaacatgagtaagcttcagagtgatgctcttagggaggcaatctcaggaatcatggctgattccaaggagaagaaccgtaaatttgtggagaccattgagctccaaattggactgaaaactatgatccccaaaaggacaagcgttttaagtggctctgtcaagttgccccacatccctcgccccaagatgaagatatgcatgcttggtgatgcccaacacgttgaggaggccgagaagataggattggattacatggatgtagaggcattgaagaagcttaacaaaaatatgaaattggtgaagaagctagccaaaaaatatcacgctttttttggcttctgaagcagtcatcaagcaaattcctcgtctcttgggacctggtctcaacaaggcagggaagttcccaacacttgtgactcaccaagaaactctcgagtcaaaggttaatgagagtaaggctatgatcaaattccagcttaagaaggtgctctgcatgggagtagctgtggggaatgttagcatggaggaaaaacaaatcttccaaaatgtacaactgagtgttaacttccttgtctcattgttgaaaaagaactggcagaatgtaaaggtgcttgtatctgaagagttccatggggaaat

SEQ ID NO: 1568 - DNA, 796 bp, Camellia sinensis
gggatcgctcagttatcggctattacaaaccctaatctagggttttcttctctcagaaagtcggaagaaaaggaaaaaagtttcaatcatgagtaagcttcagagtgatgccttgagggaagcaatcacccagattactaatgatgccaaggagaaaaagcgtaacttcactgaaaccgttgagctccagattggactgaaaaactatgatcctcagaaggacaagcgtttcagtggttctgtgaagttgcctcatatccctcgtcccaaaatgaaggtttgcatgcttggtgatgctcagcacgtggaagaggctgagaagataggtttggagtatatggatgtggaggggctgaagaaacttaacaaaaacaagaaactggttaagaaacttgcgaagaaatatcatgccttcttagcatcagaagctgtcatcaagcagattccccgtctattaggacctggtctcaacaaagcagggaagtttcctacccttgtcactcatcaagagtctctcgagtctaaagttaatgagactaaagcgacagtcaaattccaactgaagaaggttctctgcatgggagttgctgttggcaacctcagtatggaggagaagcagatttttcaaaatgtgcaaatgagtgttaattttctggtttcattgttgaagaagaactggcaaaatgtgagtgcttgtacctgagagtaccatggggaaaccagtcgcatcttctaaacttctttctctgtttacggagcaatttagtgtgagcatgcttacagattttctgattga

SEQ ID NO: 1569 - DNA, 902 bp, Ambrosia trifida
tctcagggttcttaccgaagaagtgaagctaacgagaacagacatatcccaaaatgagtaagctacagagtgaagctttgagagaggcaattacacagaatcacaactagatagctaaagaaaagaaacgtaaatttcactgaaaccattgagctacaaattggtttgaagaattatgatccacaaaaggataagcgtttcagtggtacagtgaagttgcctcacattcctcgccctaagttgaaagtttgcatgcttggtgatgcccaacatgttgaagaggcccaaaaaattggacttgagtatatggatgttgagagtttgaagaagctgaacaagaataagaagttggtgaagaaacttgctaaaaaacaccaagctttcttggcttctgagtctgtcatcaagcagattccccgtttgttgggtcctggtctaaacaaagctggtaagttccctacacttgttagtcatcaggaatccctagaggcaaaagtgaatgagacgaaagcaacagtcaagttccaactgaagaaggtgctctgcatgggagtggctgttggaaactgcagcatggaggagaagcaaattttccaaaacgtccaaatgagtgtcaatttcttagtttctttgctaaagaagaattggcaaaatgtgcgatgcttatacttgaagacaacaatggggaaacgccggtcgcattacgtttaaggaagtagtttatttgtttgtattgtttttcgtttaggttaattggttaagtctagttgttaggaaagtattattctctatagaacacaagtaacttttagtttttttttgactttactatttgtttttgtttcttgtagtactaactaaactaaattcttaatttacgttacggaattaaacttaaaact

SEQ ID NO: 1570 - DNA, 801 bp, Citrus sinensis
atgcttcggagaagagaaagagaaacaagtagacgacccctattgtttcagcggaagaaactcaagaaaggaactactacacgttttaattgggtcgggggaaatacaaaagacaagagtgagattgagaatagtaaactatcgagtgaggtgctgagagaggcggtctccactatctgtggggacgcaaaagaaaaaaaccgcaactttgttgaaaccattgagcttcaaattgggttgaagaattatgatcctcaaaaggacaagcgcttcagtgggtctgttaaacttccccacattcctcgtcctatgatgaaagtgtgcatgcttggtgatgcccagcatgttgaacaggctgagaaaatcggtatggactacatggatgtggaagcactcaagaagcttaacaagaacaaaaaacttgttaagaagctggccaagaaatatcatgccttcttagcatctgaagctgtcatcaagcagattcctcgtcttttggggcctggtctcaacaaggcaggcaaggaagttcccaacactggtgactcatcaagagtccctggaagcaaaagttaatgaaacaaaagctgtggtgaagtttcaacttaagaaagttctctgtatgggtgttgctgtgggtaattgcagtatggaggagaagcaggttttccagaatgtgcagctcagtgttaatttccttgtttcattactgaagaaaagttggcaaaatgtaagatgtttgcacctgaagagtaccatggggagaccacaacgcatctactaaagatcattggcttccca

SEQ ID NO: 1571 - DNA, 834 bp, Ambrosia trifida
aggaaaagttaactgaaaatagagtaagacttcaaagtgaagcccttagagaggcaattactcagatcactactgctgcgaactgaaaagaaacgtaactttaccgaaaccattgagcttcaaattggtttgaagaattacgatccacaaaaggacaaacgtttcagtggtaccgtgaaattgcctcacattcctcgccccaagcttaaagtttgcatgcttggagatgctcaacatgttgaagaggctcaaaaaattggccttgaatacatggatgttgagagtctgaaaaagttgaacaagaacaagaagttggtgaagaaactcgctaagaaacatcaagcttttttggcttctgagtctgtcattaagcagattccccgtttgttggggcccggtcttaacaaagcaggtaagttccctactcttgtttcccaccaagaatctctagaggcgaaggtgaacgagacaaaagcgacggtcaagtttcaacttaagaaggtgctctgcatgggagttgccgttggaaactgcagcatggaagaaaagcaaatctttcagaatgttcaaatgagtgtcaacttcttagtttctttgcttaagaagaattggcaaaacgtgcgatgcttgtacttgaagacaacaatgggaaagccgattcgcatcttttaaagagtttatttgttatgttttcgttttggattaatgttgaggtcagtactggaaaacatatttcccatgaacagggaatagtccttttgctttttacattgtttgtttgagtaaactgtctatttcgtcctgaggtttggctactttttgcctagtttcatt

SEQ ID NO: 1572 - DNA, 978 bp, Malus domestica
gagtcgctacttctcctttcaccctcactcagtagcggcagcccgaaaatcctgttctttcgtcttccttcttcaggaagttttttcgcagcgaggacaaagatctaaccaaccatgagtaagctgtcaagcgatgggctgagggaagccatttctcagattaagacgaactctgagacaaagaagaggaagttcactgagacagtggagcttcagattggtctgaagaactatgacccccaaaaggacaagcgtttcagtggttctgtcaggcttccacacattcctcgccctaagatgagggtttgcatgcttggagacgcccagcatgttgaagaggcagagaagatgggtttggattatatggacgtggaaagcttgaaaaagctgaacaagaacaagaaacttgtgaagaagcttgccaagaaataccatgcctttttagcttctgaagctgtcattaagcagattcctcgtcttcttggccctggtcttaacaaggcaggtaagtttccaaccttggtgagtcaccaggaatctctggaggcaaaacttaacgagaccaaagctatggtgaagttccaacttaagaaggttctttgcatgggtgttgctgtcggaaatctcgctatggaggagaagcagattttccagaatgtacaactcagtgtcaatttcttggtttcattgttgaagaagaactggcaaaatgtgaggtccttgaacttgaagagtacgatggggaaagctatccgtatctactaagttaatctttatcgaaaactttccaagtgaaggaagcatcagcgtaacttttttgaaagacatttatacctttcggtgttctattttgtttttgatgactttgatttcgttgttaaaccataatttagtactcgatgttgctctggatgaatgcttttggaaaattttgaaggaaagccttttctttctctccggtgtttggtggatggtgat

SEQ ID NO: 1573 - DNA, 1057 bp, Malus domestica
atgtcgagggtttatctgtcgatatatctcaccacctcccattatcttaaagctcctctgccgccagaaaccctaacgagcccttctcttacattcaggtcagaattcttcgtttggtccggcagcttaagcttcggccatgagtaaacttcagagtgataccctccgagagggtatttccatcatcatgacggcgtccaaggaaaaaaaacgtaacttcactgagactattgaacttcagattgggctgaaaaattatgatcctcagaaggacaaacgtttcagtggttctgttaggttgccacacatccctcgtccaaagatgaaggtctgcatgcttggagatgctcagcatgttgaggaggctgaaaagattgggttggactatatggatgttgaagggctgaagaagctcaacaagaacaaaaagttggttaagaagttggcaaagaaataccatgcctttttggcttcagaagctgttattaagcagattccccgtcttttgggtcctggtctcaacaaggcaggaaaatttccaacccttgttagtcaccaagaatccctcgagtctaaggtttccgagacaaaagcaatgatcaagttccaactgaagaaggttctttgtatgggagttgctgtagggaatgtatccatggaagagaagcaggtctttcaaaacgtccaattgagcgttaactttcttgtttcgctgttgaagaaaaattggcaaaatgtaaggtgcttgcatttgaagactactatgggtaagccatatcgcatctattaagtactttagcttatttcgggagttctttagggagatgagaggttattggagcctgatacataataggaagtgtgtttatctgaatggtcaagttttggtattggttggctgttttacgttgtttaatggtaatcgtcacggtaatgttctactaaatatatatatatattgtcggagtggaagcctggttttgatattttggcgtgagcatatatgtatgaagaacattttctatgtaaggaatgcaatttttcccaattccattga

SEQ ID NO: 1574 - DNA, 845 bp, Fagus grandifolia
tagctagggttccttctctgtcttctgggttttgtttgcaggtggaaaatctgttagtgggtctttggagaaaagagagtttcaaagatgagtaagcttcagagtgatactttaagagaggctatctccactctttttgtcgggtccaatgacaaaaagaggaatttcactgagactattgaactccagattggtttgaaaaactacgatccccagaaggataagcgtttcagtggttctgttaagttgccacacatccctcgcccaaagatgaaggtttgcatgcttggtgatgcacaacatgttgaagaggcagagaagatgggtttagattatatggatgttgaagcattgaagaagcttaaacaaaaacaagaaattggttaagaagcttgccaagaaataccatgcctttttggcatcagaatctgtcattaagcttatcccccgtcttttgggccctggcctcaacaaggcaggtaagttcccaaccctcgtcactcatcaagaatcaattgattctaaagttaatgagacaaaggctatggttaaattccaactgaagaaggtgctttgtatgggagttgctgttgggaatgttgccatggaagagaagcaggtcttccaaaatgttcaaatgagtgttaatttccttgtttcactcttgaagaagaactggcaaaatgtgaggagcttgtcgctgaagactaccatggggaagccagtgcgcgtatactaaaatcttttgtcaagggggttttgtaggcgagctgtaatacttataagtgtgctttgaatcgtcaaattttcttgttggttggctgttttaccattttcttttctct

SEQ ID NO: 1575 - DNA, 974 bp, Fagus grandifolia
agctgagcgcctcatttgctatatatatactctcatcttagccgccacaaaccctagctagggttccttctctgtcttctggtggaaaatctgttagtgggtctttggagaaaagagagtttcaaagatgagtaagcttcagagtgatactttaagagaggctatctccactctttttgtcgggtccaatgacaaaaagaggaatttcactgagactattgaactccagattggtttgaaaaactacgatccccagaaggataagcgtttcagtggttctgttaagttgccacacatccctcgcccaaagatgaaggtttgcatgcttggtgatgcacaacatgttgaagaggcagagaagatgggtttagattatatggatgttgaagcattgaagaagcttaaacaaaaacaagaaattggttaagaagcttgccaagaaataccatgcctttttggcatcagaatctgtcattaagcttatcccccgtcttttgggccctggcctcaacaaggcaggtaagttcccaaccctcgtcactcatcaagaatcaattgattctaaagttaatgagacaaaggctatggttaaattccaactgaagaaggtgctttgtatgggagttgctgttgggaatgttgccatggaagagaagcaggtcttccaaaatgttcaaatgagtgttaatttccttgtttcactcttgaagaagaactggcaaaatgtgaggagcttgtcgctgaagactaccatggggaagccagtgcgcgtatactaaaatcttttgtcaagggagttttgtaggcgagctgtaatacttataagtgtgctttgaatcgtcaaattttcttgttggttggctgttttaccattttcttttctctgaatgcgtagatgtcatggccctagacctctagacttgattttgaatttttgctggagagtagaaccaagttttcatcactcactataa

SEQ ID NO: 1576 - DNA, 780 bp, Cephalotaxus harringtonia
ggaggcgataacaacggtggtgggagatagcaaggagaagccgaagaagtttgtggagacgatagagttgcagataggcctcaagaattatgatccccagaaggacaagcgcttcagcggctctgtcaagcttccccacatccctcgccccaagatgaagctctgcatgctcggtgatgcccaacatgttgaagaggctgtgaaaataggtttggactacatggatgtagaaggattaaagaaaatgaacaagaacaagaagcttgttaagaagcttgcaaagaaataccatgcttttcttgcatcagaagcaattattaagcagattcctcgactccttggtcctggtctaaacaaggctggtaagtttcctactttggtgtctcaccaagagtctttggagggaaaagtaaatgaaacaaaagccacaataaagttccaattgaagaaagttctgtgtatgggtgttgctgtgggtaactgtggcatggaggaaaagcaaatattccagaatgttcagttgagtgtcaactttctggtgtccttgctcaagaagaactggcaaaatgtgcgctgtctgtatctgaagagtaccatgggcaagccatcgcgtatattctaattgtgcattttagtggtagcttttgctcaatgaactatggaatatgttttgttttattgattagggaaagaggtttaaacaattttgttttgttgatttcggtgtaactttatgctgaagcataagttggccaataggcaaggtccaatgcatgttgt

SEQ ID NO: 1577 - DNA, 830 bp, Fagopyrum esculentum
accttctctgttttcgcctgcagccatcgaactagagcagccgcaatgagtaagctttcgaacgatgccttaagagaggccatatctaccatctccaaagctgcccaggagaagccgaagaagttcaccgagaccatagagcttcagattggtctcaagaactacgatccacaaaaggacaaacgtttcagtggctccgtcaaactcccccatgttccccgccctaagatgaaggtctgcatgctcggagatgcgcagcatgttgaagagtctgagaaagttggtctagactctatggatgttgaagctctgaagaagttgaacaagaacaaaaagttggtgaagaagcttgccaagaagtaccatgccttttggcatccgaagctgtgattaagcagatcccacgtttgcttggtcctggtcttaacaaggcaggaaagttccccactctggtttcacaccaggaatcattggagaacaaagtgcaggaaatcaagtcaacagtgaagttccagcttaagaaggtgctctgtatgggtgttgctgttggaaactgtggaatggaggagaagcagatcttccagaatgttcagatgagcgttaatttccttgtctctttgctgaagaagaattggcaaaatgttcgatgcttgtacctcaagagcaccatgggaaggccagttcgcatcttctaagctttttcatatgttttctagtgttgttgctgtaatggattgccaattttgtttgactttgttttacttcgcactgaaattcttcaattcaagtttgatactcaatcctcccagcatattagatttgaaagttta

SEQ ID NO: 1578 - DNA, 716 bp, Flaveria ramosissima
cttcagagtgatgcccttagggaagctattacccaaattaccaccgatgctaaagaaaagaaacgtaatttcactgagaccattgagcttcagattggccttaagaactacgacccacaaaaggacaaacgttttagtggaactgtgaagttgcctcacattcctcgaccgaaattgaaagtttgcatgcttggagatgcccagcatgtagaagaggctcaaaagattggtcttgaatacatggatgtcgaaggactcaagaagctcaacaagaacaagaagctggtgaagaagcttgcgaagaaacaccaggcgtttttggcttctgaatccgtcatcaagcaaattcctcgtttgttgggccctggtcttaacaaggcaggaaagttcccaacacttgttactcaccaggaatctctcgaggctaaggtgaatgaaactaaggcgacagttaagtttcaactgaaaaaggtgttgtgcatgggagttgctgttggtaactgcagcatggaggaaaaacagattttccaaaatgtgcagatgagtgttaatttcctcgtttcattgctaaagaaaaactggcagaatgtgagatgtttgtacttgaagacaacaatgggaaagccagttcgcatcttttaggtgtcaagtctgtttttctttcaaatttgttgcgaggtggtgactgttttgacttatcagatatctgttatgtg

SEQ ID NO: 1579 - DNA, 941 bp, Linum usitatissimum
tccttcctggtattcagagtttccaatcatgagtaagctgcagagtgagacactgagagaagccatctcagccatcaaagccgctgctaacgaaaagcctcgcaagttcaccgagacagtcgagttacagattgggttgaagaactatgacccccagaaagacaagcgtttcagcggctcagttaagttgcctcacatccctcgccccaagatgaaggtctgcatgctcggcgatgcccagcacgtcgaagaggcgaatgcaatgggactgcaatccatggatgtggaaagcttgaagaagctgaacaagaataagaaactggttaagaagctagcaaagtcttaccatgctttcctggcttctgagtctgttatcaagcagattccccgtcttctaggccccggtctcaacaaggcaggaaagttcccaactcttgtgagtcatcaggaatccctggagtcgaaggtgaacgagatcaaggcaaccgtgaaattccagctgaagaaggttctgtgcatgggagttgcagtaggaaacctcgatatggacgagaagcagatcttccagaatgtgcaaatgagcatcaacttccttgtttccctactgaagaagaattggcagaacgtgaaagtgttgaacttgaagagtacaatggggaaaccacaaagcatcttctgagaaggtttctgtgggacaagattgggactttttgggttttgagtgtaacggttagagaactatagctctaatatttagagggttttgctcaaaagatgcattggacttgcaattcgttaagaaattgttctttctcttgttacattgttgaaacttgttcattgtctctttggaacaatgatgataaacccctaaaagcagagaggagattggttcctcgtacatttgactcatttactgttttaatctacattgttgaaac

SEQ ID NO: 1580 - DNA, 853 bp, Fraxinus spp
agtgaggcccttcgggaagctatctcagtaatcaccactgatgtcaaggagaagaagcgtaacttgtttgagacaattgagctccagattgggactgaaaaactatgatccacagaaggataaacgttttagtggctccgtgaagttacctcacattcctcgtcccaagatgaagatttgcatgcttggtgatgctcagcatgttgaggaggccgaaaaaattggtcttgaatccatggatgtagaggctttaaagaagttgaacaaaaacaagaaactggttaagaagcttgctaaaagatatcatgctttcttagcctccgaagctgttatcaagcagattccccgtctcttaggacctggtcttaacaaggcaggtaagttcccaactctcgttagtcaccaggaatctcttgaatctaaggtcaatgaaaccaaagccacagtgaaattccaactgaagaaggtgctttgcatgggagttgctgttggaaactgtgctatggaggagaagcagatctttcagaatgtgcaaatgagtgtcaactttctagtttctctgttgaagaaaaactggcagaatgtgaggtgcttgtatttaaaaagtacaatggggaagcctcagcgcatcttttaaggagataacattctgtttctgttgatccggctttagggaatagtagtgtggagctaaagcaatggaatatttccctgtaatagcaagtttttggttgtctatggtctctatactttgttcagacgtcatagtgattgttttgtttttctactgagatgggattgatttttgcttactgtaccctcaatatttttatcaggaatagccagtttactg

SEQ ID NO: 1581 - DNA, 908 bp, Silene vulgaris
taaaccctaatttttcggttttggtgattgcggtttcgtgatttcatcatgagtaagttatcaagtgaggctgtgagagaagccattgccggcatttctagtgatgctaaggagaagggtaggaagtttacagaaacaattgagctccagattggtctgaagaactatgatccccaaaaggataagcgtttcagtggctctgtgaagttgccccatgttccccgccccaagatgaaagtttgcatgcttggtgatgctcaacacgtagaagaggctgagagaattggaatggaatccatggatgttgaagcgttgaaaaagcttaacaagaacaaaaaattggttaagaagcttgctaaaaagtaccattctttccttgcctctgaatctgttattaagcagatcccccgtttgctcggtcctggtctcaacaaggcaggtaagttcccaactctagttagccaccaagagcccttggaaaacaaagtgaacgagaccaaggctaccatcaaattccagctgaagaaggtgctttgcatgggtgttgccgttggtaactgcagcatggatgagaagcagatcttccagaatgttcaaatgagcgtcaacttccttgtgtcactcttgaaaaagaattggcagaatgtcaggtgtttgtacctgaagagtaccatgggcagaccctaccgcatcttctaagagagttgccgcccaacgttgtttcgattgttcgagttctctgccttttcttttttttccttctattgtggaagtagggtagtggtaatcaatttaaagtttagtatactgagacactcctgaatttcttaatattctgtttgtttcatgatgctcaatgtaacttggagctgcaacgagtcgacgactttatttaatagatttgtttt

SEQ ID NO: 1582 - DNA, 822 bp, Helianthus annuus
aagaagtgaagtttcactaaggaaaacctaacaaaaatgagtaagcttcagagtgaagccctgcgtgaggccattactcaaattaccaccgatgccaaggaaaagaagcgtaacttcaccgagactatcgagctccaaattggactcaagaactacgacccgcaaaaggataagcgtttcagtggcaccgtgaaattgcctcacattcctcgtccaaagttgaaggtttgcatgctcggagatgctcagcatggggaagaggcccaaaagattggtcttgagtacatggatattgaaggtctcaagaagctcaacaagaacaaaaagctcgtgaagaagcttgccaagaaacaccaggcttttttggcttccgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcctttaggtgttttatcgttgtttttggttgagccagtttcaggaagcatttccatttaatgggtgctattgtttttgacttgttggatgtttgttttcttattgtattagatgctgctatgaacattatggttaatggtta

SEQ ID NO: 1583 - DNA, 991 bp, Malus domestica
tcgaattccgttgctgtcgctacttctcctttcaccctcactcagtagcggcagcccgaaaatcctgttctttcgtcttccttcttcaggaagttttttcgcagcgaggacaaagatctaaccaaccatgagtaagctgtcaagcgatgggctgagggaagccatttctcagattaagacgaactctgagacaaagaagaggaagttcactgagacagtggagcttcagattggtctgaagaactatgacccccaaaaggacaagcgtttcagtggttctgtcaggcttccacacattcctcgccctaagatgagggtttgcatgcttggagacgcccagcatgttgaagaggcagagaagatgggtttggattatatggacgtggaaagcttgaaaaagctgaacaagaacaagaaacttgtgaagaagcttgccaagaaataccatgcctttttagcttctgaagctgtcattaagcagattcctcgtcttcttggccctggtcttaacaaggcaggtaagtttccaaccttggtgagtcaccaggaatctctggaggcaaaacttaacgagaccaaagctatggtgaagttccaacttaagaaggttctttgcatgggtgttgctgtcggaaatctcgctatggaggagaagcagattttccagaatgtacaactcagtgtcaatttcttggtttcattgttgaagaagaactggcaaaatgtgaggtccttgaacttgaagagtacgatggggaaagctatccgtatctactaagttaatctttattgaaaactttccaagtgaaggaagcatcagcgtaacttttttgaaagacatttatacctttcggtgttctattttgtttttgatgactttgatttcgttgttaaaccataatttagtacttgatgttgctctggatgaatgcttttggaaaattttgaaggaaagccttttctttctccccggtgtttggtggatggtgat

SEQ ID NO: 1584 - DNA, 920 bp, Malus domestica
cacttagcgcggcagtcccgaaatccagttctagggtttccttcttcaggaagttttttcgcagcgaggacaaggatctaactaaccatgagtaagctttcaagtgatgggctgagggaggccatttctcagattaagacaaattctgagacaaagaagaggaagttcactgagacggttgagcttcagattggtctgaagaactatgacccacaaaaggacaagcgtttcagcggttctgtcaggcttccacatatccctcgccctaagatgagggtttgcatgcttggagatgctcagcatgttgaagaggcagagaagatgggtttggactacatggacgttgagagcttgaaaaagcttaacaagaacaagaaacttgttaagaagcttgccaagaaataccatgcatttttggcttctgaagctgtcattaagcagattcctcgtcttcttggccctggtcttaacaaggcaggtaagttcccaaccttggtgagtcatcaggaatctctggaggcaaaacttaacgagaccaaagctatggtgaagttccaacttaagaaggttctttgcatgggtgttgctgtcggcaatcttgctatggaggagaagcagattttccagaatgtgcaactcagtgtcaatttcttagtttcactgttgaagaagaattggcagaatgtgaggtctttgaacttgaagagtacgatggggaaagctatccgtatctactaagttcataatctttatcagagactttccaagcgaaggaagcatcggcaaactttttttctaagacatttattgcatatgtttcagtgttatattttgttttcattaactttgatttcgtcgttaaactacaatgagtactcagttgttttagatgaatgcttttggaaaattttgaaggaaag

SEQ ID NO: 1585 - DNA, 1076 bp, Ceratodon purpureus
gttgcgtttcttgtgttcgtctcaattctgccgcaaccatgagtaagcttcagagcgatgtcctcagggaggccatctcccagatcaccaccgccgcgaaggagaagaaccggaagttcacggagaccgtggaacttcagatcggtctgaagaactacgacccccagaaagacaagcgtttcagtgggtccgtgaagctgccccacattccccgccccaagatgaaagtgtgcatgcttggagacgctcagcacgtcgaggaggcgaacaagatcggcatggagtgcatggacgtcgagagcttgaagaagatgaacaagaacaagaagctggtgaagaagatggcgaagaagtaccacgctttcttggcttcggagtctgtgatcaagcagattccccgtctgttgggacccggcttgaacaaggccggaaagttccctgcgttggtgtcccaccaggagtcgcttgaggcgaagatgatggagacgaaggcgatggtgaagttccagttgaagaaggtgttgtgcatgggagttgccatcggtaactgcgagatggaggagaagcagatcttccagaacacccagatgagcgtgaacttccttgtgtccctgctcaagaagaactggcaaaacgtgagggtgctgtacttgaagacaaccatgggtgcccccgtccgtatctactagttttaaaggcgtagacagtcagggccctgaggttagagcggtgaagtattacaaactgtttcaaaacatgctttattgtagtggaagccactttcaatgatttgaatgacaattttgcacgacctgagtttgctttcagtgtttttgtgccggatgtctccaactagttcttccttgttgcgatttacaccttcactcagaatttggatcctgtctaaggttgagacacccatagtcgacagtcgacagatgaccaatagccgatatcttctaattcctagatatgaaagaacagatgtacctcatttgtatatatcggctattggttcggaagtacttttcactttgaaaaattgtacaaatttcaatattgggagataattcatg

SEQ ID NO: 1586 - DNA, 1008 bp, Mesembryanthemum crystallinum
  misc_feature (14)..(14): n is a, c, g, or t
  misc_feature (731)..(732): n is a, c, g, or t
  misc_feature (748)..(749): n is a, c, g, or t
  misc_feature (764)..(764): n is a, c, g, or t
  misc_feature (784)..(784): n is a, c, g, or t
  misc_feature (790)..(790): n is a, c, g, or t
  misc_feature (831)..(832): n is a, c, g, or t
  misc_feature (836)..(836): n is a, c, g, or t
  misc_feature (838)..(838): n is a, c, g, or t
  misc_feature (848)..(848): n is a, c, g, or t
  misc_feature (856)..(856): n is a, c, g, or t
  misc_feature (860)..(860): n is a, c, g, or t
  misc_feature (872)..(872): n is a, c, g, or t
  misc_feature (886)..(886): n is a, c, g, or t
  misc_feature (919)..(919): n is a, c, g, or t
  misc_feature (922)..(922): n is a, c, g, or t
  misc_feature (927)..(927): n is a, c, g, or t
  misc_feature (929)..(929): n is a, c, g, or t
  misc_feature (932)..(932): n is a, c, g, or t
  misc_feature (937)..(937): n is a, c, g, or t
  misc_feature (950)..(950): n is a, c, g, or t
  misc_feature (957)..(957): n is a, c, g, or t
  misc_feature (964)..(964): n is a, c, g, or t
  misc_feature (968)..(968): n is a, c, g, or t
ggtgttgtaggtgnacgattcgtgcctaatgcggcatgaggttttatcaagatttgcagagtgacatttaaccgccgtcactatgagtaagcttcagagtgatgctgtgagagaagcaatctcttcgatctataatgattcgaaggagaagcagcgcaaatttactgaaaccatggagcttcagattggtttgaagaactacgaccctcaaaaggacaagcgtttcagtgggtcagtgaggttgcctcacattccccgccccaagatgaaggtttgcattctcggagatgctcagcatgtggaagaggcagagaaaattggaattgaaagcatggatgtcgaagcactaaagaagctcaacaagaacaagaagttggttaagaagctggctaagaagtatcatgctttcttggcatctgaggctgtgatcaagcagattccccgtcttcttggacctggtcttaacaaggcaggaaagtttcctaccctggtcactcaccaagaatcattggaaaccaaggtcaatgaaaccaaggctatggttaagtttcaactgaagaaggttctttgtatgggagttgctattggaaatttggctatggaagagaagcaggtcttccagaacgttcaaatgggtgtcaacttccttgtttctctattgaagaagaactggcagaatgtccgctgcttgtacctcaagagttccatgggtaagccataccgcatctacnnagcttgttcagtctcnnccaatggaaaagcangagtttgcaacatcttaaanaagctnggagaagaacgatacagcatgcaagggtattcatatggttnntggncntttctggacnggaattangacnaagttgggaagnccatatatttgtgnatgtacctgctttttgtggaaaatttggtgcanttngtacnancanagaantaccagtttgctngcaatgntcaagtngaanattcaggtgcatctttaatttggttaaatcatccggttgg

SEQ ID NO: 1587 - DNA, 1205 bp, Quercus alba
atagagcgagcgcctcacaccagtcattgctttgctatatatactctcattttagccgccacaaaccctagctagggttcccttctctttcttctggtacaaaatctgctagtgggtgtttggaaacaagagagtttcaaagatgagtaagcttcagagtgacactctaagagaggctatctccactctttttgctggatccagagataagaagagaaatttcactgagaccattgaactacagattggattgaaaaattatgatccccagaaagataagcgtttcagtggttctgttaaattgccacacatccctcgcccaaagatgaaggtttgcatgcttggtgatgctcagcatgttgaagaggctgagaagatgggtttagattatatggatgttgaagcattgaagaagcttaacaaaaacaagaaattggtcaagaaacttgccaaaaaataccatgcgtttttggcatcagaatctgtcattaagctgatcccccgtcttttgggccctggtctcaacaaggcaggaaagtttccaactcttgtcacacatcaagaatccattgattctaaagttaatgagacaaaggctatggttaagttccaactgaaaaaggtgctttgcatgggagttgcagtgggcaacgttgctatggaagagaagcaggtcttccaaaatgttcaaatgagtgttaatttcctcgtttcactgttgaagaagaactggcaaaatgtgaggagcttgtcgctgaagactaccatggggaggccagtgcgcgtatactaaaatcttttggcaagggaattttgtaggcgagctgtaattcttataagggtgctttgaatggtcaagttttcttgttggttggctattttacctttttactgttctctgaattcttagatgtcatggccctagaattgttttggaatgtttgttcgagggttgaaccaagttttcattttcacttgccctataatacattgatgaatattaggtcttatatatgttgccgtccagctggagtgaaattgatggtaaaatttaattatgtggatgataaattgctctcattatgtacttgaagtctggcaggctgtgaaaatgtggactagaattaatgcagttcaattagcccttaaatttcttgttttctcgaacagtaatggctgtttggattgaggtgtgaggggagagt

SEQ ID NO: 1588 - DNA, 879 bp, Physcomitrella patens
gtgtacaaagccacgactagggtatatctgaagctctttcacagctctgcagcgccgttgtgtttctcccggtacagttagttctactccagccatgagtaagctccagagcgatgtcctccgggaggccattacgcagatcaccactgcggccaaggagaagaaccggaagttcactgaaactgtagagcttcagattggtctgaagaactacgacccccagaaagacaaacgtttcagcggctctgtgaagctgccacacattcctcgtcctaagatgagagtgtgcatgcttggagatgctcagcacgtcgaggaggcaaacaaaatcggtatggaatacatggatgttgagagcttgaagaagatgaacaagaataagaagctcgtcaagaagctggctaagaagtaccatgctttcttggcttccgagtctgttattaagcagattccccgtctgttgggacctggtttgaacaaagccggaaagtttcccacccttgtgtcccaccaagagtctttggagtccaagggtcaggagttaaaggccatggttaagttccaactgaagaaggtgttgtgcatgggagtcgccatcggtaactgtgatatggaggaaaagcaaatcttccagaacacacaaatgggtgttaacttcctcgtgtccctgttgaagaagaactggcagaatgtccgagtgttgtacttaaagacaaccatgggcactccggttcgtatttactaggttccagcgtatacgagttgagcattccaatgggtctgaaagaccagaatttgagattgtgaaagtctattcttaatacggacgcaactatctatcaattttgcacaatgatgctttcatattttcattccccg

SEQ ID NO: 1589 - DNA, 843 bp, Artemisia annua
aaactttacaatcatgagtaagctttcaagtgaagccctcagagaggcgattacaagcatcactactgatgctaaggaaaagaaagtccgtaacttcactgagacaattgagctccagattggtctcaagaactacgacccacaaaaggacaagcgtttttctggtaccgtgaggttgcctcacattccacgtcccaagttgaaggtttgcatgcttggagatgctcagcatgtggaagaggctcaaaagattggtcttgagtacatggatgtggaatcactcaagaagcttaacaagaacaagaagcttgtgaagaagcttgccaagaagcaccaggcttttttggcctctgagtcagttatcaagcagattcctcgtttgttgggacccggtctaaacaaggctggtaagtttcctactcttgtcagtcaccaggaatctcttgaggctaaggtgaatgaaaccaaggcaactgttaagtttcagttgaagaaggtgttgtgtatgggagttgctgttggtaactgcagcatggaggagaagcagattttccagaacgttcaaatgagtgtcaactttcttgtttcgttgttgaaaaagaattggcaaaacgtaaggtgtttgtacttgaagacaacaatgggaaagccagttcgtatcttttaggtgctttctttggtttttgatttggttgttgggagattagtacttgaaagcttttaccgataatggtggctgtcgtttttgaatttttggatttctgtttttctattgtattagatgatgctatagacaatatgtttaatggttgccgagctattatctttactatctgtcttcct

SEQ ID NO: 1590 - DNA, 868 bp, Guizotia abyssinica
atcggcaggcagtttgaaaccctactctcagggttcttaccggagaagttaaatttaggagaggagaagcttcagaaaatgagcaagcttcaaagtgacgccctacgagaggcaattactcagattactactgatgccaaagaaaagaagcgtaatttcactgaaaccattgagctccaaattggtttgaagaattatgatccacaaaaagacaaacgtttcagtggtacagtgaaattgccccacattcctcgtcccaagttgaaagtttgcatgcttggagatgcccagcatgttgaagaggcccaaaaaataggccttgagtatatggatgttgagagtctgaagaagctgaacaagaacaagaaattggtgaagaaacttgcaaaaaaacaccaagctttcttggcttctgaatctgttatcaagcagattcctcgtttgttgggccctggtttgaacaaagctggtaagttccctactcttgtttcccaccaggaatcccttgaggcgaaggtcaatgagaccaaagcaacagtcaagtttcaactgaagaaggttctgtgcatgggagttgctgttggaaactgcagcatggaggaaaagcagatttttcaaacgttcaaatgagtgtcaatttccttgtttctttgctgaagaagaactggcaaaatgtgcggtgcttatacttgaagacaaaaatggggagccggttcgcatcttctaaggagtttatttgttctgatgttttcattttgggttattgttgaggttggtatgttcctcattaaaaccggaatagttttcttcgcttgtcacatttctgtttttgtaacacctcaaaatctattttacttggagatttatt

SEQ ID NO: 1591 - DNA, 1391 bp, Pinus taeda
gcgtgcaatcctttgaaggaagggtatttggtgatcggcgccgggaatattgaacaagaaagaggacgttgaagctggacatagtgccagattcgttgttttcggcttcaggagctcctggacgggtggaaatttatctggattaacacaggcgtttaggtgttccaagtcggcaaatttggagtttgagcggccgattccttgtctttttaacagcagttttgctgcagttttcgcttcttttttcaaaatttctgttggaaatccagagtgaaggcgtttcctcctaacttgagtacattcccgtcatttggcgaggaagaaagcttgttttggttttaagatggttgtgctttgttgagattcgatttacttgttttcaagaacttttatagggcaaaatcctttatggcttctggcaacagctgggctgatcagtgggacaataccaataacaatgaagagtacaacaataactccgagtcctatggaaggaaggagaaaggaaacggtaaaatggctaaggtgaaagtggttgcagtatcaggtctggagaaggccaaggtagttgccactgttggtagaaattaagtaaaaataacctatgtttaatagttacacaaaaaaaactgtcattataatatctccactctgatccacactcagaaaacacggttaggctttcccatggtactcttcaaatataggcacctaacattctgccagttcttcttcagtagtgatacaaggaagttaacactcaattgcacattctgaaaaatctgtttttcttccattccacagttccccacagcaacccccatgcatagaaccttttttaattgaaatttgacagttgctttggtttcattcacttttccctccagggactcttggtgagatacaagggtaggaaatttgccagccttgttgagaccaggcccaagaagccgaggtatctgtttaatgattgcttctgaagcaagaaaggcatgatatttctttgcaagtttcttaaccaatttctgttttgttcatttctttagtccttcaacatccatataatccaagcctaatttttcagcctcttccacatgctgagcatctccaagcatgcaaaccttcatcttagggcgaggaatgtgaggtaacttaacagagccactgaaccgcttgtccttctgaggatcataattcactgagacaattgagttacagattggcctcaagaatttacgttgtttctccttagtatctcccatgatctgggagatggcctccctcaacgcatcactctgaagcttactcatttttgccctcgccttgcgccttccttctgcacgcgctctcctacacaggaccggccctcgattagggtttaagatcgaact

SEQ ID NO: 1592 - DNA, 914 bp, Linum usitatissimum
caggaaccggatttcttttgctcatttgaacgcatccagccatgagtaagcttcagagtgagtcgttgagagaagcaatctcgaccattaagactgctgcacaagagaagccgcgaaagtttaccgagactatcgagctccagattggtttgaaaaactatgacccgcaaaaggacaagcgtttcagtggctctgtcaagttgccccacattcccaggcctaagatgaaggtctgcatgcttggagatgcccagcacgtcgaagaggcaaatgcaatgggtctgcaatccatggatgttgagagcttaaagaagctgaacaagaacaagaagctagtgaagaagcttgccaagcagtaccatgctttcttggcctctgaatctgtcatcaagcagattccccgtcttctcggccctggtctcaacaaggcaggaaagttccctacacttgtgagtcaccaggagtcccttgagtcgaaggtcaacgagatcaaggccactgtcaagttccagctgaagaaggtactctgcatgggtgttgcagtcggaaacttggacatggacgagaagcagatcttccagaatgtccagatgagtatcaacttccttgtctccctgctgaagaagaactggcagaacgtgaaggttctgaacctgaagagtaccatgggaaagccagtacaaatcttctaaaaaccgtgttgggttgtcacttgtggatcgatcggtctgtttttttttgaagtactcctgtaaggttttcaagttctttagctgtgagtggttgaaactatacttcttgtctgtggtttgtactagatgatcatttatgaaagttttgtttcgggttttcgacatttgtttcgtttatggttcctgctcatgttccgccaatgtatgctcttgttagacatt

SEQ ID NO: 1593 - DNA, 974 bp, Linum usitatissimum
gactgcgagctaaggagctgccaggaaccggatttcgttgatcatttgaacgcattaagccatgagtaagcttcagagtgagtcgttgagagaagcaatctcaactattaagactgctgcacaagtgaagccgcgcaagtttaccgagactgtcgagctgcagattggtttgaagaactatgacccccaaaaggacaagcgtttcagcggctctgtcaagttgccccacattcccagacccaagatgaaggtctgcatgcttggagatgcccagcacgtcgaagaggcgaatgcaatgggtctgcaatccatggatgttgagagcttgaagaagctgaacaagaacaagaagctagtgaagaagcttgccaagcagtaccatgctttcttggcctctgaatctgtcatcaagcagattccccgtcttctcggccctggtctcaacaaggcaggaaagttccctacacttgtgagtcaccaggagtcccttgagtctaaggtcaacgagatcaaggccacagtcaagttccagctgaagaaggttctctgcatgggtgtggctgttggaaacttggacatggacgagaagcagatcttccagaatgtccagatgagtatcaacttccttgtatctcttctcaagaagaactggcagaacgtgaaggttctgaacctgaagagtaccatgggaaagccagtacagatcttctaaaaatcatgttgggttctcgcttgtggatcgatcggtctgtgtccttttttttgaagtactcctgtaaggttttcaacttctttagctgtgagtggttgaaactatagtacttctctgtggcttgtactagaagatcatttataaaagttttgtttctggttttcgacattgttcttccgttatggtgcctgctttgcaccatggccacagttctataatcctacctataatgaagaatttcatagattgaagcggacaattg

SEQ ID NO: 1594 - DNA, 909 bp, Ocimum basilicum
aaaccctaattagggtttcctcatacagaagtgaagttttgaaggagaaaggagaagtatctgagccatgagtaagcttcagagcgaggcccttagagaagccatctctgtaattaagaatgattcggctgagaaaaagaggaagttctctgagactattgagctccagattgggcttaagaactatgatccccaaaaggacaaacgtttcagtggatctgtgaggttgcctcacattccacgtcctaagatgaagatttgcatgcttggagatgctcagcacgtgggggaggcagagaagatcggtttggagtacatggatgtcgagagcctcaagaagcttaataagaacaagaagttagttaagaagcttgcaaagaaataccatgctttcttggcttcagaatccgtcatcaagcagattcctcgtctcttgggtcctggtctgaacaaggcaggtaagtttccaacccttgtttcccaccaagagtccctcgagtctaaggttaatgaaaccaaagctaccatcaagttccagatgaagaaggtgctttgcatgggtgttgctgttggtaattgtgatatggaagagaaacaaatcttccagaatgtgcaaatgagcgtgaacttcttaatttctcttccaaagaagaattggcagaacgtaaggtgcttgttcttgaagagccccatggggaagactcaacgtgtcttttaagacgacaagtctcgttattggagcttttcgtgcattctttttgtaagagatagatattaatgaaaattttggatagtattcatccttgattatgtttttgaatgttacatcactacaaggatcgatcatattgctgagacatttcaagagctctgttctttttaatgttagatgatgatttcatttgaatg

SEQ ID NO: 1595 - DNA, 1084 bp, Castanea mollissima
ctttgctatatatactctcattttagccgccacaaaccctagctagggttcccttctctttcttctggtacaaaatctgctagtgggtgtttggaaacaagagagtttcaaagatgagtaagcttcagagtgatactctaagagaggctatctccactctttttactggatccaaagataagaagagaaatttcactgagaccattgaactacagattggattgaaaaattatgatccccagaaggataagcgtttcagtggttctgttaagttgccacacatccctcgcccaaagatgaaggtttgcatgcttggtgatgctcagcatgttgaagaggctgagaagatgggtttagattacatggatgttgaagcattgaagaagcttaacaaaaacaagaaattggtcaagaaacttgccaagaaataccatgcttttttggcatcagaatctgtcattaagctgatcccccgtcttttgggccctggtctcaacaaggcaggaaagtttccaactcttgtcacacatcaagaatccatcgattctaaagttaatgagacaaaggctatggttaagttccaactgaaaaaggtgctttgcatgggagttgcagtgggcaatgttgctatggaagagaagcaggtcttccaaaatgttcaaatgagtgttaatttcctcgtttcgctgttgaagaagaactggcaaaatgtgaggagcttgtcgctgaagactaccatggggaggccagtgcgcgtatactaaaatcttttggcaagggaattttgtaggcgagctgtaattcttataagggtgctttgaatggtcaagttttcttgttggttggctattttacctttttactgttctctgaattcttagatgtcatggccctagaattgttttggaatgtttgactgagagttgaaccaagttttcattttcactgtccctataatacattgatgaatattaggtcttatatatgttgcgatccaagctggagtgaaatcgatgataaatttaattatgtggatgataaattgctctcattatatacttgaagtctggcagggtgtgaaaaa

SEQ ID NO: 1596 - DNA, 1021 bp, Prunus persica
gcgctgaacatgctctaacaaaacgtagcagctagggtttttataaagcgccaaagttcccttccgccttttgcctcactcagcagcagcagccctgcaaatcctgttctagggtttcgctctctttcttgaggaagtatttgcacaggaattgcagcgaggaaaaggctgtaaccatgagtaagctctcaagtgacgggctgagagaggccatcgctcagattaagacaaactcagaaacgaaaaagagaaatttcaccgagacagttgaacttcaaattgggttgaagaactatgacccacaaaaggataagcgtttcagtggctctgtcaggcttccacatattcctcgtcctaagatgagggtttgcatgcttggggatgctcagcatgttgaagaggcagagaagatgggtttggactacatggatgtggaaagcttgaaaaagcttaacaaaaacaagaaactggtcaagaagcttgccaagaaataccatgcctttttagcttctgaagctgtcattaagcaaattcctcgtcttctaggccctggtcttaataaggcaggtaagtttccaacattggtgagtcaccaggaatctttggaggcaaaagtgaatgaaaccaaagcaatggtgaagttccaacttaagaaggttctttgcatgggtgttgctgtggggaatttggctatggaggagaagcagatttttcagaatgtacaactcagtgtcaatttcttagtttcactattgaagaagaattggcagaatgtgaggtccttgaacctgaaaagtaccatggggaaagcaatccgtatctactaagttcttaagctctatcagagacttttgtagcggaggaagcattagcagaactttaattaagacatttcttgcaaatgattttatgttcccttttgtttttgttgactttgatttctttgtttaaattataatgagtactgtatttttggtttgaacgaatgttggaagattttgaaagaaattttcttcacccc

SEQ ID NO: 1597 - DNA, 948 bp, Linum usitatissimum
gaatttcgcccattacgccggggggaaaagccgcccgtcaccactcttcttcttctcttgtttcaccgcgagctcagtagcttctttcctctagcctctccgactggtaatcatgagtaagcttcagagcgattcgttgagagatgcgatcacaaccatcaagactgctgcacaagagaagccgcgcaagttcacggagaccgttgagctccagattgggttgaagaactatgacccacagaaggacaagcgtttcagcggctccgtcaagctgccccacattcccaggccaaagatgaaagtctgcatgcttggagatgcccagcacgttgaggaggctaatgccatgggtctgcaatccatggacgttgagagcttgaagaagctgaacaagaacaagaagttggtgaagaagcttgccaagcagtaccatgcttttttggcttcagagtctgtcattaagcagattcccagacttctcggccctggtctcaacaaggcaggaaagttccccacacttgtgagtcaccaggagtcactcgagtccaaggtgaacgagatcaaggctacagtgaagtttcagctgaagaaggttctgtgcatgggtgttgctgttggaaacctggacatggacgagaagcagatcttccagaacgttcagatgagcatcaatttcctcgtctcccttctgaagaagaactggcagaacgtcaaggttttgaatctgaagagtaccatggggaaaccagttcagatcttttaaagaggggtgtcttcacttgtcatctcttgttataaagtacttgtctttttttgtaaggttggagctttcatagctgtatcatttgaagttattcttatctgggtgactgcaggtatcgtactgctaattcagtaaaatttttgctggaaatttgcaatttgtgttagttgttcaccatgtttcgc

SEQ ID NO: 1598 - DNA, 905 bp, Euphorbia peplus
gcttcagagtgaagcattgagggaggcaattacaactatcatgactgcttcaaaggagaagaagcggaattttactgagacaattgagctccagattgggcttaagaactacgatccccaaaaggataagcgtttcagtggctctgtgaaattgcctcacattcctcgccctaagatgaaggtttgcatgctcggagatgctcagcatgttgaggaggctacagcaattggcctccaatggatggatgttgaggctctcaagaagctcaacaagaacaagaagcttgtgaagaaactcgccaagcagtaccatgcctttttggcttctgaatctgtcatcaagcagattccccgtcttcttggccctggtctgaacaaggcaggtaagttcccaactcttgttacccatcaagagtccttggagtctaaagtcaacgagacaaaagccacagttaagtttcagttgaagaaggtgctatgcatgggtgttgctgtcggaaactgcgccatggaggagaagcaagttttccaaaacgttcaaatgagtgtgaacttccttgtctctctactcaagaagaactggcaaaatgtgaagtgccttaacctgaagactacaatgggttccccacaacgtgtcttttaaggagttagcttttgaattgcagttgaacttgagagacagtttcttgataactatagaaaaatttatttaatgcctcagtctttcaatttggacggctgttttgttttgttttgttgtgatgaaaccagtaggcacactgtaatgttagtttttttgagagatgaacttggtttaccatgtttgccgtaatgtttattttcttactagttgtcatctgttatatgtttgtctaagctgtttgtagcagataatctaagcaatt

SEQ ID NO: 1599 - DNA, 835 bp, Linum usitatissimum
gagctcagtagcttcttccctctagcctctccgactggtaatcatgagtaagcttcagagtgattcgttgagagaagcgatcacaaccatcaagactgctgcacaagagaagccgcgcaagttcaccgagaccgttgagctccagattgggttgaagaactatgaccctcagaaggacaagcgtttcagcggctccgttaagctgccccacattcccaggcctaagatgaaagtctgcatgcttggagatgcccagcacgtcgaggaggctaatgccatgggtctgcaatccatggacgttgagagcttgaagaagctgaacaagaacaagaagttagtgaagaagcttgccaagcagtaccatgcttttttggcttctgagtctgtcattaagcagattcccagacttctcggccctggtctcaacaaggcaggaaagttccccacacttgtgagtcaccaggagtcactcgagtccaaggtgaacgagatcaaggcgacagtgaagtttcagctgaagaaggttctgtgcatgggtgttgcagttggaaacctggacatggacgagaagcagatcttccagaacgttcagatgagcatcaatttcctcgtctcccttctgaagaagaactggcagaacgtcaaggttctgaacctgaagagtaccatggggaaaccagttcagatcttttaaagagggttgtcttcacttgtcatctcgtcttaaagcacttgttttttttgtaaggttggagctttcatagctttatcatttgaagtttgttcttatctgggtgactgcagatatcatactgctaattcagtacaaattttg

SEQ ID NO: 1600 - DNA, 738 bp, Amborella trichopoda
  misc_feature (700)..(701): n is a, c, g, or t
  misc_feature (709)..(709): n is a, c, g, or t
  misc_feature (716)..(716): n is a, c, g, or t
ggtctgggttttgcataacatctgtactctcagttgaagaggcgccggtcctcagagagagagacagggagagcctagcttgagagagaaatttagagaggcgccacaatgagtaagttgcagagtgatactttgagggaagtcatcggcaaggtgatgggtgatgcaaagaagaagaatcgtaaattcacagaaacaattgagcttcaaatcgggttgaagaactatgatccacagaaagataagcgtttcagtggctcagttaaattaccccatgttcctaggccgaagatgaaagtctgcatgcttggagatgctcagcatgttgaagaggcagagaagatgggattagactatatggatgttgaggggctaaagaagcttaataaaaacaagaagctggtgaagaaactcgcgaagaaatatcatgcttttctcgcatctgaagcagtcatcaagcaaattccaaggcttcttggacctggtctcaacaaggcggggaagttcccaactctggtttctcaccaagagtcattggaatccaaggtgaatgaaacaaaggccattgtcaaatttcaactaaagaaggtcctctgcatgggagttgctgtaggaaattgcgccatggaggagaagcaagtgttccaaaatgttcaaatgagtgttaactttttggtgtctctcttgaagaagaactggnnaaatgtcnggtcttngtatctcaagagtactatgggg

SEQ ID NO: 1601 - DNA, 832 bp, Musa acuminata
ggatcgcggtccatcggtagggctttcctccacccggaaccctcgcggaggctggtcgatcgaaggaagaaagagagacatctgagcaatgagcaaattacagagtgatgtcctgagggaagcaatctcccaggttgttggtgattctcgggagaagaaacggaaattcactgagacagtcgagttgcaaattggtctgaaaaattatgatcctcagaaggacaagcgttttagtgggtctgtaaagcttcctcatattcctcgccctaaaatgaaagtatgcatgttgggagatgctcaacatgtcgaggaggcagagaagataggactagattatatggatgttgaaagtttgaaaaagatgaacaaaaataagaagctggttaagaaacttgctaaaaagtaccacgctttcctggcatcagaggctatcatcaaacagattcctcgtcttcttggccctggtctgaacaaggcagggaaatttcccactttggtcactcaccaagaatctttagaatcaaaagttaatgagacaaaagcaatggtgaagtttcaactcaagaaagttctttgcatgggtgttgcagtgggtaactgtgcaatggaggagaagcagatctttcagaatgtgcaactcagcgtgaatttccttgtctctttgctgaaaagaactggcaaaatgtgagatgcttgtacctgaagagcaccatggggaagccattccgagtgtttaagtagctcctttctcagctggtgatcataaatctaattctacttatcttcagatttgtcatagcagtattgaagtctaggttattaaaactcatgt

SEQ ID NO: 1602 - DNA, 630 bp, Adiantum capillus-veneris
gtcgcgggagcaagacgaagcagcatgagcaagcttcagagtgatgtgctgagagaagccatcacacagctcgtatcagagtctaaggaaaagaagaggaagtttgtggagacagttgagcttcagattgggctgaagaactatgatccccaaaaggacaagcgctttagtgggtcagttaagcttgcacacatccctcgccccaagatgaaagtgtgcatgttaggagatgcccagcacgtggaagaggcggaaaaaattggccttgattgcatggatgtggatgctttgaagaaaatgaacaagaataagaagctcgtgaagaagcttgcgaagaagtatcatgccttcttggcctctgaagctgtcataaagcagattcctcgccttctgggtcctggtttgaacaaggcggggaagtttcctactcttgtctctcaccaagagtcgctggaggggaaattgaatgagacaaaggctacagttaagtttcagctgaagaaggtgctatgcatgggggttgctgtgggaaaccttgaaatggaggagaagcagctttttcagaatgtgcagctgagtgtgaactttctcgtctcgcttttgaagaagaactggcaaaacgtgagagtc

SEQ ID NO: 1603 - DNA, 872 bp, Physcomitrella patens
gacctctttcaacttcacaccgtcgtgaggactccctggttcgtgcgtaatttgctgcaaccatgagtaagcttcagagcgatgtcctcagggaggccatcactcagattaccactgccgctaaggagaagaataggaagttcacagagactgtggagcttcagatcggtctgaagaactatgatccccagaaagacaagcgtttcagtggttccgtgaagctgccacacattcctcgccctaagatgcgcgtgtgcatgctcggagatgcccagcacgttgaggaggccaacaagatgggcatggaatacatggacgtcgagagcttgaagaaaatgaacaagaacaagaagctcgtgaagaaactggcgaagaagtaccacgctttcttggcctccgagtctgtcattaagcagattcctcgtctgttgggacctggtttgaacaaggccggaaagtttcccactttggtgtctcaccaggaatcgcttgacgccaagtgccaggagaccaaggccatggtcaagttccagctgaagaaggtgttgtgcatgggagttgccattggaaattgtgacatggaggagaagcagatcttccaaaacactcagatgggtgtcaacttccttgtatccctgctgaagaagaactggcagaatgtccgcgttctgtacttgaagactaccatgggcacccctgtccgtatctattagttgtgtagaacgtggattgtaaggcatctttcagtcaatgccaatgaaaattatggaggtttctatttctgttccagcttcctttcattgctgcaaatcgaattctgtacccttccatgtttcaattcagagctgttttttggcatcatacgctggagt

SEQ ID NO: 1604 - DNA, 906 bp, Linum usitatissimum
gaccgcgagctcagtagcttcttccctctagcctctccgactggtaatcatgagtaagcttcagagtgattcgttgagagaagcgatcacaaccatcaagactgctgcacaagagaagccgcgcaagttcaccgagaccgttgagctccagattgggttgaagaactatgaccctcagaaggacaagcgtttcagcggctccgttaagctgccccacattcccaggcctaagatgaaagtctgcatgcttggagatgcccagcacgtcgaggaggctaatgccatgggtctgcaatccatggacgttgagagcttgaagaagctgaacaagaacaagaagttagtgaagaagcttgccaagcagtaccatgctttttttggcttctgagtctgtcattaagcagattcccagacttctcggccctggtctcaacaaggcaggaaagttccccacacttgtgagtcaccaggagtcactcgagtccaaggtgaacgagatcaaggcgacagtgaagtttcagctgaagaaggttctgtgcatgggtgttgcagttggaaacctggacatggacgagaagcagatcttccagaacgttcagatgagcatcaatttcctcgtctcccttctgaagaagaactggcagaacgtcaaggttctgaacctgaagagtaccatggggaaaccagttcagatcttttaaagagggttgtcttcacttgtcatcccgtcttaaagcacttgttttttttgtaaggttggagctttcatagctttatcatttgaagtttgttcttatctgggtgactgcagatatcatactgctaattcagtacaaattttgctggaaatttgcaatttgtgttagttgttcaccatgtttcaacttgtttcatttctcaaccctc

SEQ ID NO: 1605 - DNA, 1142 bp, Oryza sativa
agcccaagaaaaagcacaaaaggaacaccaagtcgaactctcctcaaccctagcgcacagccgccgccacttcgccctccgcttccgccgccgccgcgccgccgccaccttcctcgttgcggaacagtgtgctcgcaccgccggcgccatgagtaagttgcagagtgatgctcttagggaggcaatctcacaaattactagtgaatcccgcgagaagcagcgcaagttcgtggaaaccattgaactgcagattggactgaagaactatgaccctcaaaaggataagcgtttcagtggatctgttaagttgcctcacatcccccgccctaagatgaaggtgtgcatgcttggtgatgcccagcatgttgaagaggcagagaaaatgggcctagactatatggatgtggaagctctcaagaagatgaacaaaaacaagaagctggttaagaagcttgcaaagaaatatcacgctttccttgcatctgaggccatcattaagcagattcctcgacttcttggacctggtcttaacaaggcaggcaagattttacttgtttatgggaggtctatattgaaaagcagctacataattgtgtccaaacgaggcaaattcccaacgttggtgactcaccaggaatcacttgagtccaaggttaacgagactaaggctacagtgaagttccaactgaaaaaggttctttgcatgggtgttgctgtaggcaactgtgctatggaggagaagcaaattttccaaaatgtgcaaatgagcgtgaacttccttgtctctcttttgaagaagaattggcagaacgtgagatgcttgtacctgaagagcactatgggaaaagtgatccgggtgttctaaatggttttcttcatgctcctcgaatttctagagacttccctgcttggaacttttattgttttctcaactatcatttttttgtgcaacaagttcagaaatcatttttgatgttatcgattaacttgacttcaaccgttgaaatctttctgtggtactccaagtggtcggtaacctgctgtgcgaattattttttcctgcaccacattattgtctgagaaccagcctgtgaatcataattctttcaagaatggcaagattgtgacacttggcactgtta

SEQ ID NO: 1606 - DNA, 1071 bp, Sarracenia psittacina
tctccgtggagcagccatcgaaagcaaaaatcgtttaccatgagtaagctacaaagtgatgcagtcagggaggctatctcccaaattgctggagatgcaaaagaaaaaaagacgcaactttgtggagacaattgagctccaaattggtttgaagaattatgatccccagaaagataagcgttttagtggttctgtgaaactgccacacatccctcgtcctaagatgaaagtttgcatgcttggtgatgctcagcatgtagaagaggccgagaagataggcttggactatatggatgtggaaggactgaagaagcttaacaagaacaagaaactggtcaagaagcttgccaaaaagtatcatgcttttctagcatctgaagctgtcatcaagcagatccctcgtctcttgggccctggtctaaacaaagcaggaaagtttccaacattggtctctcatcaggaatcccttgagtcaaaagtgaatgaaacaaaagcaacagtgaagtttcaacttaagaaggttctgtgcatgggtgttgctgtgggtaactgtggtatggaggataagcagatattccagaatgttcaaatgagtgtaaactttcttgtttcactgctgaagaagaattggcaaaatgtgaggtgcttgtacttgaagagtaccatgggaaggccagtccgcatcttttaacaagttttgtatttgtggaaagctgtgtagcgaatccacagtttaaaagagccttcttgttttgtttttgtttgggtggttgaggaagaggaagattcactgagctttgtttttgtttttttcatcgattctggtatgaattgctcaaacttgaacttagtatacatccgtgttcttttttgatcaatattggctcatttttgatcaatattggttctttttgatcaatattggctctgttctggtattgattctggtatgaattgctcaaacttgaacttagtatacacgtgttcttacaacttatgattttttttctctcttattccagttataagctacagttttatcgaacattcacaacttctgttataaattct

SEQ ID NO: 1607 - DNA, 904 bp, Artemisia annua
acggggattgatagcggcactttgaaaccctaatagcagggttcttaccacagaagtgaagtttaacgaaaggaaaagtcagcaaacatgagtaagctatcaagtgatgctcttagggaggcaattactcagatcaccaccgatgccaaggagaagaaggtccgtaactttgttgagactattgagcttcagattggtttgaagaattacgatccacaaaaggacaagcgtttcagtggtaccgtcagattgccccacattcctcgtcctaagttgaaggtttgcatgcttggagatgctcagcatgttgaagaggcccagaagattggtcttgagtatatggatgttgagagcttgaagaagctgaacaagaataagaagttggtgaagaagcttgctaagaaacaccaagcttttttggcttctgagtctgtcatcaagcagattccccgtttgttgggtcctggtcttaacaaggctggtaagttccctacccttgtttcccaccaggaatctcttgaggcaaaggttaacgagaccaaagccactgtgaagtttcaactgagaaggttctttgcatgggtgtcgctgttggaaactgcagcatggaggagaaacagatcttccaaaatgtgcaaatgagtgtcaacttcttggtttctttgttgaagaagaactggcaaaacgtgcgatgcctatacttgaagacaaccatgggaaagccagttcgcatcttttaagaagtttatgggttgctatgttttcattttggttaatgttgaggatggtactggaaagttttccaatgaacaggaaatagtcctttttggcttgttacatgtttgtttggtactatatttttggacaccttactttagatgttatattatcgaagttacttctg

SEQ ID NO: 1608 - DNA, 726 bp, Triticum aestivum
cagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttgggcatcagagggcatcatcaagcagattccccgtctccttggtcctgggtctcaacaaggcaggcaagttcccgaccctggttactcaccaggaatccctcgagtccaaggtgaacgagactaaggcaaccgtcaagttccaactcaagaaggtctttgcatgggtgttgccgttggcaacctcggccatggaggagaagcagtcaacagacatccagatgacgtcaactccttgttcccttctgaagaaaacggcagaattgaatgctctactcaagacacatggggaaccatacaggggttcaataagccctttgcaatccgcaagtccggaccaggtttatgaataacttgtaaaatagttttggc

SEQ ID NO: 1609 - DNA, 731 bp, Brassica rapa
caaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagaca

SEQ ID NO: 1610 - DNA, 777 bp, Physcomitrella patens
attcttctctcggtttgtcttctccagctttgttcttcctccgtgtgggcttgggccgtcaccggtagttatcaatcatgagtaagcttcagagtgatgttctgagggaggcgatcactcagatcgtggctgcagccaaggagaagaataggaagttcacagagactgttgaacttcagatcggcctcaagaactatgacccccagaaagacaagcgtttcagtggctccgtgaagcttccccacattcctcgtcctaagatgaggatttgtatgcttggagatgcccaacatattgaagaggcgaccaagaatggtatcgagtgcatggatgtcgagagcttgaagaagatgaacaagaacaagaaacttgtgaagaagctggctaagaagtaccacgctttcttggcttccgagtcggtcattaagcagatccctcgtttgttgggacctggtttgaacaaggccggaaaattccctgcgcttgtatctcaccaagaatcgcttgagtccaaggtgctagagtccaaggctatggtcaaattccagttgaaaaaggtgctgtgcatgggagttgctattggtaactgcggaatggaggagaagcagatcttccagaacacccagatgggtgttaacttccttgtgtctttgctcaagaagaactggcagaacgtgagggtgttgtacttgaaaaccaccatgggtgcccccgtacgcatttattaattacggaacttggctagtaaagcgtatacctggttcgtattttcttaag

SEQ ID NO: 1611 - DNA, 800 bp, Citrus clementina
atgcttcggagaagagaaagagaaacaagtagacgacccctattgtttcagcggaagaaactcaagaaaggaactactacacgttttaattgggtcgggggaaatacaaaagacaagagtgagattgagaatagtaaactatcgagtgaggtgctgagagaggcggtctccactatctgtggggacgcaaaagaaaaaaaccgcaactttgttgaaaccattgagcttcaaattgggttgaagaattatgatcctcaaaaggacaagcgcttcagtgggtctgttaaacttccccacattcctcgtcctatgatgaaagtgtgcatgcttggtgatgcccagcatgttgaacaggctgagaaaatcggtatggactacatggatgtggaagcactcaagaagcttaacaagaacaaaaaacttgttaagaagctggccaagaaatatcatgccttcttagcatctgaagctgtcatcaagcagattcctcgtcttttggggcctggctcaacaaggcaggcaaggaagttcccaacactggtgactcatcaagagtccctggaagcaaaagttaatgaaacaaaagccgtggtgaagtttcaacttaagaaagttctctgtatgggtgttgctgtgggtaattgcagtatggaggagaagcaggttttccagaatgtgcagctcagtgttaatttccatgtttcattactgaagaaaaattggcaaaatgtaagatgtttgcacctgaagagtaccatggggagaccacaacgcatctgctaaagatcattggcttccca

SEQ ID NO: 1612 - DNA, 759 bp, Zingiber officinale
agaagaagcgcaacttcactgaaacaattgagttacaaattggtttgaaaaattatgatcctcaaaaggataagcgattcagtcgctcagtgaagcttccgcatattccacgccctaaaatgaaagtttgcatgttgggtgacgcacaacatattgaggaggcagagaagataggacttgattacatggatgttgaaagtttgaaaaagatgaacaaaaataagaagcttgtgaagaagcttgctaagaagtaccatgctttccttgcatcagaagctatcattaagcagattcctcgtcttcttggtcctggtcttaataaggcagggaagtttcccacattggtttctcaccaagagactttggagtctaaagtcaatgagacgaaggcaatggtgaaattccaactcaagaaggtcctttgcatgggtgtcgctgtcggcaatgttgccatggaggaaaagcagatttttcagaacgtgcaaatgagcgtgaatttactcgtgtcgttgttgaagaagaactggcaaaatgtccgatgcttgtatctgaagagcacaatggggaaaccctatcgcatcttctaactcttcgtatgcccgagttcgagcttgccgtctcaagatcggactttttagctgaatgtttttcggatatcaatcagtataaaagaacagaagctatcttacagttagtcatttgtttgatcagtctgaaagaacagaaaattcagttatattaatcagtaatatatatatt

(The sequence listing continues in the following parts.)

What is claimed is:

1. A method of increasing biomass of a plant as compared to a native plant of the same species which is grown under the same growth conditions, comprising expressing within the plant an exogenous polynucleotide comprising a nucleic acid sequence encoding a polypeptide having at least 95% global sequence identity and conservative amino acid substitutions with respect to SEQ ID NO: 493, or encoding the polypeptide selected from the group consisting of SEQ ID NOs: 493, and 5288, thereby increasing the biomass of the plant as compared to the native plant of the same species which is grown under the same growth conditions.

2. The method of claim 1, wherein said polypeptide comprises an amino acid sequence selected from the group consisting of SEQ ID NOs: 493 and 5288.

3. The method of claim 1, wherein said exogenous polynucleotide comprising a nucleic acid sequence selected from the group consisting of SEQ ID NOs: 289, and or a codon optimized sequence thereof.

4. The method of claim 1, wherein said exogenous polynucleotide comprising the nucleic acid sequence selected from the group consisting of SEQ ID NOs: 289, and 962.

5. A nucleic acid construct comprising an isolated polynucleotide comprising a nucleic acid sequence encoding a polypeptide which comprises the amino acid sequence of SEQ ID NO: 493, and a promoter for directing transcription of said nucleic acid sequence in a host cell, wherein said promoter is heterologous to said isolated polynucleotide.

6. The nucleic acid construct of claim 5, wherein said nucleic acid sequence is SEQ ID NO: 289 or a codon optimized sequence thereof.

7. The nucleic acid construct of claim 5, wherein said nucleic acid sequence is SEQ ID NO: 289.

8. A transgenic plant comprising the nucleic acid construct of claim 5.

9. The method of claim 1, wherein said nucleic acid sequence encodes SEQ ID NO: 493.

10. The method of claim 1, wherein said nucleic acid sequence is set forth by SEQ ID NO: 289.

11. The method of claim 1, further comprising selecting said plant expressing said exogenous polynucleotide for an increased biomass as compared to a control plant of the same species which is grown under the same growth conditions.

12. The method of claim 9, further comprising selecting said plant expressing said exogenous polynucleotide for an increased biomass as compared to a control plant of the same species which is grown under the same growth conditions.

13. The method of claim 11, further comprising: (a) isolating plants or regenerable portion of said plants selected according to the method of claim 11 having said increased biomass so as to obtain isolated plants or regenerable portion of said selected plants; and (b) planting or regenerating plants from said isolated plants or regenerable portion of said selected plants to thereby obtain plants having increased biomass.

14. The method of claim 12, further comprising: (a) isolating plants or regenerable portion of said plants selected according to the method of claim 12 having said increased biomass so as to obtain isolated plants or regenerable portion of said selected plants; and (b) planting or regenerating plants from said isolated plants or regenerable portion of said selected plants to thereby obtain plants having increased biomass.

15. The method of claim 11, further comprising generating a plant line by: (a) isolating a plant or a regenerable portion of said plant selected according to the method of claim 11 having said increased biomass so as to obtain an isolated plant or a regenerable portion of said selected plant; and (b) using marker assisted selection of said isolated plant or regenerable portion of said selected plant for selective breeding of plants having increased biomass.

16. The method of claim 12, further comprising generating a plant line by: (a) isolating a plant or a regenerable portion of said plant selected according to the method of claim 12 having said increased biomass so as to obtain an isolated plant or a regenerable portion of said selected plant; and (b) using marker assisted selection of said isolated plant or regenerable portion of said selected plant for selective breeding of plants having increased biomass.

17. A method of selecting a transformed plant, comprising:
(a) providing transgenic plants transformed with an exogenous polynucleotide comprising a nucleic acid sequence encoding a polypeptide having at least 95% global sequence identity and conservative amino acid substitutions with respect to SEQ ID NO: 493, or encoding the polypeptide selected from the group consisting of SEQ ID NOs: 493, and 5288, and
(b) selecting said plants for an increased biomass as compared to a control plant of the same species which is grown under the same growth conditions,
thereby selecting the plant having increased biomass as compared to the control plant of the same species which is grown under the same growth conditions.

18. The method of claim 17, further comprising: (c) isolating plants or regenerable portion of said plants selected according to the method of claim 17 step (b) having said increased biomass so as to obtain isolated plants or regenerable portion of said selected plants; and (d) planting or regenerating plants from said isolated plants or regenerable portion of said selected plants to thereby obtain plants having increased biomass.

19. The method of claim 17, further comprising generating a plant line by: (c) isolating a plant or a regenerable portion of said plant selected according to the method of claim 17 step (b) having said increased biomass so as to obtain an isolated plant or a regenerable portion of said selected plant; and (d) using marker assisted selection of said isolated plant or regenerable portion of said selected plant for selective breeding of plants having increased biomass.

20. A method of producing a crop comprising growing a crop plant transformed with an exogenous polynucleotide comprising a nucleic acid sequence encoding a polypeptide having at least 95% global sequence identity and conservative amino acid substitutions with respect to SEQ ID NO: 493, or encoding the polypeptide selected from the group consisting of SEQ ID NOs: 493, 5287, and 5288, wherein the crop plant is obtained from plants selected for increased biomass as compared to a control plant of the same species which is grown under the same growth conditions, and the crop plant having the increased biomass, thereby producing the crop.

21. The method of claim 17, wherein said nucleic acid sequence encodes SEQ ID NO: 493.

22. The method of claim 17, wherein said nucleic acid sequence is SEQ ID NO: 289 or a codon optimized sequence thereof.

* * * * *